United States Patent 10,407,724 (METHODS AND COMPOSITIONS FOR SCREENING AND TREATING DEVELOPMENTAL DISORDERS) - sequence listing, part 20

SEQ ID NO: 359 - DNA, 1078031 bp, Homo sapiens
agttaacagatattgattttctgtcataatgatgttgtgagacaatctaagaggaattaaaatttaaattcatgtattcctcctttttcctctgttctctaactgtaatatattttaattacagatggaggaacagatagatgttagataaataggtatataatatatagatcatccaaaattcttattcttatggttttatgtagtcagtatttacctctatttttctgcatgtttatcattccaatttagttcattacttcctgcacctttgatgtcatatatataaacaggaaataacacatggtggccgggatgtagagagagccacaggacttgtgaataaaatccacaggcaaggatgtggcgattccttttgcaatattggagggaatgccaaaccctatgtttgctgtggaaaagagtatgttagttcctcaaaacatcaaaatggtattgccatatgattcagcagctccacatctcaggatagcaaaagaaatgaaagcagagtcttgaaaaaatatttacacatccatatttgcagcagcattattggcaatagctaaaacgtagaagcaattgaagtgtccaacaacagatgaatggataagcaaaatatgatatatacatacaatggaatattattcagtcttaaacatgagggaaatattctgacatatgttgcaacttggatgaaacttgagaatattatgccaagtgaaataagttagtcagtgaaggacaaatacagtataattccatttgtataaggaacttaaagtggacagagtcacagagatagtacaatgatggttgccagaagctggggggaggaagacatggggaagtattgcttaatgagtatagagtttcagtttcacaagatgaaacgagttatggagatggatggtggggatggctgcacaatgttatgactatatttagtaccactgaactgtgcacttaaaatggttaacagagtacattttatgttatgtgtattttaccacaataaaaaaataaaataccttaggaacattttcctgaaagagtccacataaaattcattttaatgcatgtgtttatgcatagatttctatttttctcttttctatttatattccaaattagaatataatgctaatcaatcatagtggctgtgtttcttccttcctctagtctgcaagtagcaagcaaatgtaataaactacttattcatgtcacacctatttattttctgccttataccaagcttgtgggattctattaaatacaacatttttatacgtacacctatgcaatacccattagcatcgccttcctaaatcaggggaaattgagtgtctgtaaggtgcggtaacttactaagatacaaaactcagcattaaagtctgtatacttcaatatcctgccctcttctcatttgtctttactgccttttatgtatgtgttagatgttcaataaatactcttttttaaactgaatttaagccgtggagcagtgttttgttgaacaataaatatgatattggacactctttctccctttcatttatgatgcagttcatgaaaaagagaaattctttcattgtgctagaagcttaaaataatgaaaatgccactttctacattaaacagaaactgaagggaaacaagatgaattggatgagacatagaaaacaagtgggaaagaaatctagtataatttcccctttgtgcacctttgttatttagcatttgagaaaatgtttcccccaaatatcttcccatcttaattcatgtctataaagtagacatttatgtctcaccttgtcaagaagggcaaactctaacataaacatttcccaaaaatgcttcctgctaaaacgtaagctcagtctggctagaaattaagctcattcataaaaattagttggcagctaatctttgcatgctgttctctgaacttgagtgaaagctgtccatcaggcatacagggaatgacggaaaaggtgacaacagaagatgaatgctatgtcactaaccttcaaagacgaccttccttttctttcaaattcttgatatcttaagacttcattaattcatctttctttgcccttggttcaacattgtgctataccaaaactcatgtaaaacaatgatctattgtaataaaaatggcatttttctttcatgtagatgcaagctatctggcatttttacaatcaacatacttccgttgttaatttttcattctgtattggcagtaattgataggtatttctgaagggatgaaggtgtttctgtgttcattgagatccaaacttttttagacctagtggtgtttgtaaaacaatttgtgccagctgacaaaggaccactgtggcagaaagcagcaaacttgcataagatgtcactgcctcatcagttggctttgaaaactaggggcttactctatagtcctatgaatcaaagacattgattgatgtagtataagattacaatcatattttccttttgacagtcatattataaggcatgatgtattgcaattaatctcaattagctgatcacaattaaaattaataatgtttattattgctgataaacaatcatgactctcctgttctcaaatgtgcaagtaattcttgtaattttaatacaaatttgcatattattactaattgatttaatctcattgtatttggttcatggatccaatttattaaaatattgataatggggcaatgatttgtctccccatttcatttacactaaaagacacaattcgtacaatggtctgcaagcccatcatgatctgccgcatttgttactgagttaaaacaatttttctatattcaagatacatatttatacagacatatagatatgtgtttttcaaatatcttctcacaatttttgagctgccttttgacttgcttggttgtcctttgaaacaccaatgtctttaatttttaagaaatgttaaataactaatttttattttgttgatcatgtttttggtgttacagctatttctttgctagatccaaaatcctgaagattttcccataagctttattctagctcttgcatgtatatctttaattcatttaagttaatatttttgtatgctttggggtaaggattccaatttattattttgcaagtggcgatccacgtgtacgttgttgacagagtttgttcaaagaaggtctcttcctcattgaattgcacatggcaccactgtaagaatccattgactatagatacatagttttatatatggactctcaattctcttccatcaatctatatatttttccttcatcagtattgtgttgtcttgattactgatgctttgccataaggtttggagcatgggggtgtgaattatcctaacatgttttcttttttcaagactattttggctattttaagtcccttacaattccacgtgtattttagaatcagcttgtaagtttctagacagaaatctgttgggatacttgcagggattacgtcaaatctgtagttcaacttgtaaagtactacaatattaaatcttccaattcatggctgtaagatatttgctaattatttagatcttctttaaacaataatttttaattttcagagtaaaatcttatatcacattttccaaattaattattatttctttttttgatgctattgtaaattgaagtgttttcttaatctcattttagggttttcattgtagatgtgtgcaattgatttttgtatatttatcttgtatgctgtaatattgctgaagtaattaactagttctatcgttcagtggattccttaaaattttctatatacaagaatgttatttgcaaataaagttttatttcctcctgttcaatatgggtgactcttatttctttacttgccgatttgccctgcataaaatcttcagtacagtgttgactagaagaggtcaaagtacgtatcctattcttatctctgaccatagcgggaaagtatcctttcttttaccactaagttgaatatttgcttttggcttttcacaggtgccatgtatctggtgtagaaagtactctattcctggctcattgagtttttatttttatttttaatcattaaagcatttggattatgttaaatgtcttttctgaatctatcgagatgatcatgaaattcttgtttcttattctatggataagatgtattaccttaatggattttgggctgttaaatcatcctgagattactagtataaatatcactttgtcatagtgcataattcttttacatgttgctagatctgatttgttagtagtttttaaggaattttgcatttatacttatagtagttttatttttctatgctatttggactaatttttgtatcaaggtaacactggccccacagaataaattgggaagtgaatatttctctttttaaaaaaagttagtcaagaattaatatcaattagtcaatactaacaaatatgatcaatattataaattattaatttctctaatttttattttcttccttctgcttgctttaggtttagtttgctattttttccattgcctttatgtggaaggtcatcttatctcatcctttcctttgtcttttcattttcgaaatagtgtcttttttgcatcaggtgagctccccaggttggtagtactccatgtttattgctgtacaacaatgacaggtaatatgtcctgaagacaatggaaacttaacattcaaaatcctcctagatttcaccttatgtgatatgtcttttcctttgattggtccaatttctaccctttctctattataaaccatgagtacaatggcattcaatgagttctgtgagtctttctagtaaattcttgaaactgagggtgttctggggaaaccctgatctggcagttggtgtcaaaagtgcgaatcgtcttatatggcctcttcctttgaactttgcatctggacccaaactctgcacaatttgggccagcagtctcgtgttgactttgcagcctaaattatcttgtagtttgtctaatcctcaaaaatttgctttcatcaaatattgtatttgttaccccaaaattaccatcatgtatttttctccaaataactaacattaggagaaatagccagctgaatctgtaactcaacagaaacaagtgatccatataccatataagtggccatttcattttgcctccttccaccaaatcttagcaacctcaaccattgccgtgagccactgtaggcctaccatctacaaaccaacaagtatcttttaaaaacacttcatgctcccatttgataaatttcccagcaaagggatgcttactttaactctatgcaagtggctcatactcgcaaagtctgcagatattattcatgtagtgtgagaaaatcatcccagagatgccagcacattctcctacccatgatctgcttagtttgcaaacatattcaggccatgggtgagagatttgtatttcacagtacaacaattttatggaggacattgaaacttagattgagcattttagtacagtcacacatcactgagtgatagggatacgttctaacagatgcatccataggcaatttcatcattttgcaaacgtcagagagaatattacaaacacctagtttgtacagcctaccatgtctggttatatggtagagcctctctctcctaggctacaaacctgtgtactacattactgtactgaatattgcaggcaataagaacacagtggtaagaagttatgtatctaaacatacttaaacatagaaaagtatgtaaaaatgtgtattataatctcatgggaacacttttgtatatgcaatccatctttgactgaaatgttattatgcatgacatgactctatgacaaaaataaaatagtacattttttaaaatgtacaaatgtatcaaacatattataaaactaaaaatatttattcagtgtaagaatttgtaatgatcacaaaatgttcacagcttatatttaagtacagtttcaaatgcctagtgcaattactatttatttctttttgtattttaaacatgtatataataaacatttttcaggttcagcaatatatatcaatcctacaggctcttataaatattagttaaaatcaattggtaaattcatgtgtatatacgcatacctgtatcagtgagcatgtgtgcatgtatgtttgtgtaaacgtaattatatgtgtgtgtaaatgtaattggatgcatccttatatttacccttacctgcaagatttccaagattcatttattatctttagatgatgggcatttaaagatttaccaaatacaacggtaatagtggaaaatatcaagatgttattaaattcatcttgtgcaataattatttctataaatttatgtttcttgtaaaacttgcagtaatgctcatgcacaaaataattttctaaataaaaaataaaaacgttttctcagtcattaattcttaaaattatttctccccaataattaatgtgaattaattcttaattcttaattatagaataatgttgcccttcagagttcggaaacttttacatgttgtacacatttcactaaccagaacaacttctgaaatattggcattaattaatgtcactcagcaattattgatttcaaaggcattaaataccattcatattctgaatcacaagggtactttggcatcttttttaatcaagctctctgtatcatcatctacactttaattacttaacaaacatttctctgtatgagaaagattgagcaggttattgtgcttttttaagatacaacttttgcttaatctagagataggcaatgctccctataagggacaaagagaaaaataaatgagcaatagagatgcgacaggcatggaaaaagacactacatttatcaaacaaataggtcccataaagttttgagtcaattagaatatgtttgtatcagtctgtctacagttttacacctgtcaaaatgtacttgaactacaacaactaccctgaacaattttgaaatgtatgattcctctgaaactgattaaaagaattatggtagagtgaaattctgattgacataatttgggagagaaattattccttggacatcaacctctgccaagatagtttataatgacattgagactttttgatttacaaaatttgttatataaaaaatactaagacgatggcagataatacacagaatttaattaaaattgtactacaattaaatgtctaaataaattagaagggtacatggtacatctaattgtatgtttatatattttatttgtgcatttttttcctagggttgcttttgctttagtttgtaaaacgttcttatttttatgataatgtagcacatactaaataaagaaaaatcaggaaatagaaaatgaagaaaacattagttattgtcaaccaaataaaaattgtgcaatctctaagcacatgaagtatgtattatttgtacagcatgtagaacgtttatgcttcacagcgtgaggtagagactgcaaaaccttgaacttgggacaaataagaaagtaaggaaattttcacaacatattaatattatagaaaatgttgaacttaacagttaaggtacaagtagtgaaaaatgatagtatttaaggagatctagaaaatttaatctatacctgtaatgtgtgagaagtattagaataatgcttgtatttctggatttgcatcaatttctattgagactggaaacataatagaagtgagggaaaaagaatttaaattgtggatacttgagttttatacctaggagttcgagaaatacattttgttactatcaaagcagttggcacaagagtgtacaaaattccctaattgtgtctatgtggagaagacatagacaaacagagaatagtaaaacagaaatagcaaaaaagcacaaacaaattttacctgtaattttaagtaaaagccaattagagaaggaaaacatgaaatttgtgttttatcaaaatttttctctttctcataatgcagttgaatatattactggaaaaaaattgaagcactggtatgttcacaaaaaaagtaaaatataaggtcaaaaccatgggaatgcagggagcagacaaaatataactaaacaccgaaactgattttgccttatggacgtgtaccaaaatgaatgagtgcagattcctactgtcatacatcacataagacagtaaagaaatacatagtttttcccaagatagagcatcacacaggagctcctccctaaagctaggaccaaaatttatatcctgagtataaagaagaatcagaggtaaattagtcccatttcacattccctggaaatggcaaataaaaatgacttgagattggacagatttaaagaaactcaatcactaatgatttagagcaagtaatttaaaaattgtttaaatgtgcaacccaaacatacgtccaaatccctttaggccaagaattaacataatgtggtcccagaatggtggtgcctttagtagaatcacaaaaaaattcaaattctctttggcaaattttctacttacaaatcctcaaaagtgcacaaaaataattttcagagaaaaataaatatttgtcattcaaaggcatctaagtatgcaaggaaatgatattccaccatttgaaaggaaagcagaaaaggagtacaaacagatccacaaaggttccttagtagatctatcacttagattataaagcacatttgctttcaaaaatttttttaaaaaagaatatattgttaggagactaaaaaattgatgtagcaaatttgaaaagaagtttgtataaaaatatagttattttaaattaaaaactcaaaaatgaactcatcagattagacatgactatggtgagagttcataaatatttcagaatgcattacagaaaatttaaaaaaaaggaaaatgtggacagaatgatgaagagacatggaagatacagtgagaaagtgtagcatgtgtttagtgagtgttctcatagaagaagggaactgggaagggacaatatgtgatgatattttgggtgaaagttctctagacttttgtaagacactaatctgcatattcaaaaattctatgcatgctaagcaagctataatggagataaacctacacctatgtatctcctagagaaatagtaaacaaccaggaagggaaaaatatttcaattagcactagaaaaatgaaattacttttagttatattgaaatctgaaaaaatgaaaggtaaaataaacaatattatttgctaagaataataatgccattctgaaattctcaacgaagaaaaatattcatcaacctatggctaaataacatatttagagacagaaaacaaaatgccaccagcagaattccactaaagaaactaaagagaatctctgaaaatattcttcagaaatgttgaagttctgaaatcaaagagtgaacacagagcaaaatatattgtaaacatacagatagatctaaataaaaaattaggtgttgaaacaaaaatatatttaaaattagataatcactgcaatatgtatgttaggaagaaaattattagggctggagtattcaaagaacccttaactgtctgacaagaacagaaaagtgagtatgactttgcaactctttttctttttcgaatggaatggaatggaattgaatctaatggaattgaatggagtggagtggaatggaatggactgggagctgagattgtgccattgcgctacaggctgggtgacagagtgagacactctcaaaagaaaggaatggaatggaaagcagtggaatagaatggaatggaatggaatggaatggaatggaatggaatggaatggagtggagtggagaggagtggaacggagtggaatggaatcggatgtaatggaatatagtggaatggaatggaatggaatcatcatcaaatggactcaaatggaattatcatcgaaaggaatcatcatcgaatggaatcgaatggagtcatcctcgaatggaatcgaaaggaatcatcatcaaatggacttgaatggaatcatcatcgaatggactcgaatggaatcatcattgaatggaattgaatggaataattgaatggaatcgaatggaatcatcattgaatggaatcgaatggaatcatcctcaaatggaatcgaatggaatcatcaatgaatgcacttgaatggagtcattatcaaatgtactcaaatgaaatcatcatcgaatggaatcgaatggaatcatcatcaaatggaatcatcatcgaatggaatcgaatggaatcatcattgaatggaatcaaatggaatcatcaaatggaatcgaatggaatcatcgaatggaattgaatggaatcatcatcgaatgaaatcaaatggaatcatcatcgaatggaatagaatgcaatcatcaaacggaatcaaatggaatcatcatcgaatggaattgaatggaatcatccaatggaatcaaatggaataatcatcgaatggaatcattgaatggaatcaaatggaatcatcaaatggaatcgaatggaatcatcatccaatggaattgaatggaatcatggaagggaatcgaatggaatcatcattacatggaatcgaatggaatcatcatcacaaggaatcgaatggaatcatcattaaatgatatcgaaaggaaacatcgaacggaatcgaatggaataaatcaaatggaatcgaatggaatcatcattgaatggaatcgaatggaatcatccaatggaatcaaatggaataatcatcgaatggaatggaatggaatcatcatcgaatggaatcaaaaggaatcatcaaaaggaattgaatggaataatcattgaatggaatcgaatgaaatcctagaatggaatcgaatggaatcatcgaatggaatcaaatggaatcatcaatgaatggaatcgaatggaatcatggaatggaatctaatggaatcattatcacatggaatcaaatggaatcatcgaatggaattgaatggaataatcatcgaatggaatcgaatggagtcatggaatggaatagaatggaatcatcatcgaatggaatcgaatggaattatcgaatggaattgaatggaatcatcattgaatggaatcgaatggaatcatcatcgaatggaatcaaatggaatcattgaaaggaatcgaatggaataatcatcgaatggaatccaatgaaatcctcgaatggaagggaatgcaatcatcgagtggaatcgaatggaatcatcatcgaatggaatcgagtggaatcatagaatggaatcgaatggaatcatcatcgaatggaatcgaatggaatcatcgaatggaattgaatggaacaattatcgaatggaatcgaatgcagtcatccaatggaatcgaatggaataatcattgaatggaaacatcaaatggaatcgagtggaatcatcaaatggaatcgaatggtgtcatcatcgaatggaatcgaatggaatcatggaatggaatcaaatggaaacatcatggcatggaagcaaatggaatcatcaaatgcaatcgaatggaatagacatcgaatggaatcatctaatggaatcgaatggaatcatcaaatggaatcgaatggtgtcatcatcgaatggaatcatctgatggaatcgaatggaatcatcatcacatggaatcgaatggaatcatcatcaaatggaatcgatgggaatcatcaaatggatcaatggaatcatcaaaaggaatcaaaaggaatcatcttcgaatggaatcgaatggaatcatcactgaatggaatcattatcaaattgatttgaatggaatcatcattgaatggaatcgaatggaatcatcgaatggaatcaaatggaatcatcatagaatggaatcaaatggaatcaacgaatggaattgaatggaatcatcatcaaatggattcgaatggaatcacccaatggaatcgaatggaataatcatcgaatggcatcattgaatggaatcatatggaatcatcgaatggaatggaatggtgtcatcatcgaatgtaatcatccaatggaatcgaatggaatcattgaatggaatcgaatggaatcattgaatggaatcgaatggaatcatcgaaaggaatcgaatggaataatcattcaatggaatcaaaaggaatcctcgaatgcaatcaaatggaatcatcaaatggaatcaaatggaatcatcatcaaatggaatcatggaatggaatcgaatggaaacatcatcacatggaagcaaatggaatcatcaaatgcaatcgaatggaataaacatcaaatggaatcatcgaatggaattgaatggaatcatcgaatggaatcgaatggtgtcatcattgaatggaatcatccaatggaatcgaatggaatcgaatggaataatagaatggaattgaatgggatcattgaatggaatcgaatggaatcatcatcaaatggaatcaaatggagtcatccaatggaatcgaatgaaatcatgatcgaatggaatagaatggaatcatcagatggaaacaaatggaatcatcatcaaatggaatcaaatggaatcatcgaatggaattgaacggaatcatcatcgaatggaatcaaatggaatcatgaatgaatggaatcattatctaattgaatcgaatggaatcatcatcaaatggaatcaaatggaatcattgaatagaatcaaatggaatcatcaaaaggaatcaaatggaatcataatcgaatggaatcaaatggaatcaacgaatggaattgaatggaatcatcatcgaatggatatgaatggtatcatccaatggaatcgaatttaataatcatcaaatggaatcatcgaatggaattctatggaatcatcgaacagaatcgaatggtgtcatcatcaaatggaatcatccaatggaatcgaatggaatcatcgaatggaataattgaatggaatcgaatggaatcattgaatggaatcatcatggaatggaatcaaatggagttgtccaatggaatcgaattgagtcatcatcacatggaatcaaatggaatcatcgaatggaattgaatggaatcatcatcgcatagaatcgaaaggaatcatcatcacatggaatcgaatggaatcatcattgaatggtatcaaaaggaatcatcgaatggaatcaaatggaatcgaatggaatcatatttgaatggaatcgaatggaatcatcatcgaatgaaatcaaaaagaatcatcaaatggaatcgaatgcaatcatcatcgaatggaatcgaatggaatcatcatcgagtggaattgaatggaaacttcaaaaggaatcgaatggaataatcatcaaatggaatcaaatgaaatcctagaatggaattgaaaggaatcatggaatggaatcgaatggaattatcatcaaatggaatcaaatggaatcatggaatggaatcaaatggcataataatcacatggaataaaatggaatcatcgaatggaatcgaatggaatcatcatcgaatggaattgaatggaatcataatagtatggaattgaatggaataatcattgaatggaatcgaatggaatcctcgaatttaattgaatggattcatcgaatgaaatcgaatggaatcatcatcgtatggaattgaaatgaatcatggaatgcaatcaaatggaatcatcattgaatggaattgaatggaatcatcaaatggaattgagtagaatcatcatcgcatggaatcgaatggaataatcaaatggaatcaaatggaatcatcatcacatggaatcgaatggaatcatcattgaatggtattgaaacaaatcatcaaatggaatctaatggaataaattgaatggaaccgaacagaatcatcatcaaatggaatcaaatggaatcattgaatggaatcacgatagaatgaaatcgaaaaaaatcattgaaaggaatctaatggaatcatcatcgaatggaatcgaatggaatcatcatcgaatggaatcgaatggaatcatcaaaaggaattgaatggaaaaaacatcaaatggaatcaaatgaaatcctcgaatggaatcgaatggaatcatcgaatggaatcgagtggaatcatcattgaatggaatcaaatggaatcattgaatggaatcaaatggaatcctcatcgtgtggaatcaaatggaaacatcaaatggaatcgaatggaatcatcatcaaatggaagtgaatggaatcatagaacataatcgaactcaatcatcaaatggaatcaaatggaaaaatcatcgaatggaatcgaacagaatcattgaatggatttgaatgcaatcatcatcaaatggaatcgaaaggaatcatcaacgaatggaatctaatgcaatcatcatcaaatggaatcgaaaggaatcatcaacgaatgaattgaatggaatcgtcaaaatgaatcgaatggaataaacatcgattggaaacaaatggaatcctcgaatggaatcaaatggaaacatcgaatggaaatgaatggaatcatctttgaatggaatcgaaaggaatcatggaatggaatagaatggaaacatcatcacatggaagcaaatggaatcatcgaatgggattgaatggaataatcatcaaatggaatcactgaatggaatagaatggaatcttcgaatggaatcgaatggtgtcatcatcgaatggaatcatcccatgcaatcgaatggaatcatagaatggaatcataaaatggaatcaaatggaatcaacaaatggaatcgaatggaatcatcatcgaatggaatcgaatggagacatccaatggtatcaaatggaatcatcattgaatggaatcgaatggaatcatcaaatggaattgaatggaatcatcatcgaacggaattgaatggaatcattgaatggaatcgaatggaatcatcatcgaattgaatcaaatggaatcatcatagaatggaatcttcttccaatagaatcaaatggaatcatcgttgaatggaatcgaatggaatcatcgaatggaatcaaatgtaatcatcgaatgaactcgaatggaatcatcaccgaatgaaattgaatggaataatcaactggaattgaatggaatcatccaatggaatcgaatagaataatcatcgaatgggatcatcgaatggaatcaaatggaatcatcgaatggaatcgaatggtgtcatcatcaaaaggaataatccaatggaatcaaatggaatcatcgaatagaatcgaatggaatcatcatcgaatggaatcgaatggaatcatggaattgaatcgaatggaatcatcatttcatggaatcgaatggaatcatcatcacgtggaatcgaatggaatcatcatcgaatggtattgaaaggaaacatcgaatggaattgaatggaacaaatcgaattgaatcaaatggaaccatcatcgaatgaaatcaaatagagtcatcgaatggaatcatcatcgaatgaaatcgaaaagaatcatcgaatggaatcgaacgcaatcatcatcgaatggaatcgaatggaatcatcattgaatgtaattgaatggaatcattgaaaggaattgaatggaataatcattgaatggaattgaatgaaatcagaatggaattgaatggaatcatcgaatggaatcaaatggaatcatcatcgaatggaatcgaatggaatcatggaatggaatcaaatggaatcatcatcgcatggcatcaaatggaatcatcacatggaatcgaacggaataatcatcgaatggaatcgaattgaatcatcaaatggaatcgaatgcaatcatcgaatggaatcgtcatcgaatggaatcgaatgcaatcatcatcaaatggaatcgaatggaatcgaatggagtcgaatggaatcatcatcaaatggaatcgagtggaatcatcgaatggattcgagtgtctgttcagacaggtctgggggatatctaaaggactcatgaaaggctgtttttttctgtgttgctagaataaagaacatataaggaatggacatttttaagaaactctgcaaggagacctaacaaaccacggatgcttagggcaaaaattagagtttacacatatagtagatcaccttcagcacaggaagaaaagttggagaagagtatttggaaaactaagacattcaaaatcattcacgtacatgggagagtctagaaagtcacatgtatgcataggttaagccatatgctgaaaaatgacataagaagaccctacacttttaccttggccgatccctcccctcagtgcaagctctgtgcaagagtgaacttgaacttcactcagtgcaagagtgaacgcacactttgtggcggctttaaagaacccagcacaaagctagtctgcatggcctagagacatattttgctggataatgattacttgtttttctttgtttttgttgtatttgcctgttttcttagttcctgacatacaagaaaatcactgtcaaaacattagcttaacatttgttaaggaaacaaaaagcctttggtgaccacaccttataaagcaaacagttttgtaaatcactttggaaaatttcactaaaaaaaatccttaacaatataataagaaaagaaaatttaaaaccacaaaacattactgtgtttgtagggggggttctgatttacagagtaaccacatagtaattgtaattattataatgtccagttttcaaaaaaagttacaaggcatacaaagaatgggaaagtatggctcattcaaagaaaaaaaacaaattgacagagaatatctctaaggaaacccagacatcaaacttactagacaaagactttaaaacaactctcttcattatactcaaatgtcaaaaggaaaacataaacaaagaaatcaaggaatcagaacaaatattaaaaagtaggaatatcaacagagataacaaattctggagcggaaaactacaacgataaaaatttaaaaatcaccagagggatttaagagtatatttgcacacacagaagaagacatgagcttgaagataagaaaatggaaaatattgactctcagaaacagataaaaaatgagcagagactaatgaatctgtgggacatcatcaaatagatcaacattcatattctaaaaggataaattatgttgttgaaaactttagcattctttcttttcacctttctttcttcctccctccccctcctcctcctttttacttttcttcctcttcctttctcttcttctgtctctccttcattatcccttttgctctgtttctctttctccctttctcttttctttcaattatctcaattacgaagagatgtttaaatacccttaccatgtgagttgatatggttatttctgcctttagttcttttttgagatttatagtcactctaagtaaagagataacccaaacataagcctcataaacaggcttccataccattcttaatttggtcctgtaattcttcattgctgtgttaactttctgatgcttttaaggatgttttataacaaattgtttagttttttccaatggagtgtttattctgaattatctaattcatattgtaagtatagagggagtttaatataaaattattaagctgacatttgtgaaagaatgtatttgtgcatttaacaaatatgttaatcctcagactgttattgggcagctgagcatacagcaataaaaataacataatttttatgtgtgcaatatttatggaatacgttactggaccaaataaataatttagttaataacatgacaaagaacagaaattgtatacactataaagcatagtaatggaataatgaatgattaaagttattaatattaggtagaaaataaagggtatctttgagagcagaaatcaaggaagcaagcaattcgccttacgaggaaagagttacctgtggataaaggagaaactgaaaaatttacaagtcaagactttttgagcaaaaacaaaaatatgattattagtcaccaattcagtacagtgaaaaaaaagttgaagagatatcttggaagtaaaccatgttgtggaagagcatgtagggttttgataatcatgggattattctgaattaattttaaatgcaataggaatatatgagataatttcagcagagaataacatgattgtgtttgcatttcaaaggggtgtatctggtgcaccgtgtagaataaataggttatgtgagcaaataaattaggaggctattgtaatccagagaaaaaaggcagtgacttaggtgagaatgctgtcaggatgagtggtattagtggtgagaagtcgttaggccatggatgtatttcataggactggccaagagaactgcagctaaattggagtgtagggaatgaaatggagaactcaaagatgactctgagcactggaaagtgacagctgtcactgaagcatgctgatgcctcttattaagagagttacttgggaatggcaagatcaagacttctcactttcaaatttatgaaaaatattgttttcagaacgaatgactttgggatcagaaagccaccattctaattgatggttccacgactacacgggctcacactcccaagaacaaaagtaaataatcacaaaggtgcttcctgataatctagagaatggagaattactgtaacatctttctgattttaggagaggtagcagttccctgtttagcctaaacgctattttttttaaagctcagcaaagagactccaatataattttcaaacgtgtgtaacttaaattctcatatgaaataccactatgcttaaattagtcaaaacattttccctatctacaactctatcttgtcactgcaatcattttcacaaaagtgactgcagctcacagacactaaaaggagaaaatccagggtaggttacctgatctagttagtttcgaagacaggatctagagattatttaatatgaaataggtcacctgaaatgtttactgaaaacagcttgggtcagcccagttttctaccactgaaccatgcatttggtttaaaaaacacaacaactctggggaatatcagctgcttccaactgtgttgaaggtgttaaagaaaaaagcataaaataaaaaatgatcatctgaggcctttatagtctctgctcaagacactagagtcttccattcttaatgaaacacccaaatatcttaataattgggcaaaatctaagtatcagagagataattttatcttgaagattgttaaattataatggtgattcactaccttgccacgtctctgagtcaaaaattaggtatttgtttaggaatcaatcataatctgcaatttggaaataggaagattttagaagactcagacattgactttcttgtgtgcaaaaaaaagacgtattgagataagacaagtctttccttgcaaggatacctctaatgctcatacaccacctcccctaacattaatagagcttccaggtcagtaaccagtgtcagagagcagcccatgcaactacaaattcaatagatgtcgaacacagggtcaagcctagaataagaagtcttagctaattaagtatgcttttttccccaaactcatattaacaaaaacttggatatgtcagagaatgcattctaagttcactcaacataggagggagaaacataattttaaattaagagctgaagcattcttgtcctaacagaaagcaaggaaaacgaaatatcacaccacaggagggatttcacaaattagtgtcaacatcaaaaccttaaaataggcaaggagaatggagattcacagtgaactcttgtacttgttttattcagagaagagatggttctgagagaatgacagtgaactaaccccagctggtttagttggtgctttcaactgctgcttctgatcaacttctttagctagaaaaaattgatgaggattttggcatgtggtattagagatggttattaactttttcctcttatttgcattgttcaatgtagtaaatactagctgtgtgtggctacttcaattcaaattaattacaatgaaatatacttaaatattgaattttttagtcactgttggttcattattgaatatcttcagctaagatttcccatctaaatacactaagaggtggcttagttaactggttgtccacaaatattgaagctgttgttaactcctgatatattctctgcaaagagaatattcatgagcctcctcctgaaatcagcagcctagagacagttttataaattggatacaagttggaaatctatatactctttaagtttttgaaatattagcttcccagggaagaaaatcaaattcataagatatgttaggacaatttaactcaagatgttcaaaactgaaatgacatattctacaatatgtgataaaaccaccccctaacaacttaaagcaaaacagggattgaccttaaagacctgccttttcctcatcccccagccaatcagttttcaaatcttgcattttattttgaaaggttcttatccccctggtctcttgtttctagatttggcacatatttttgttacctctatctactgacttttctctcttcaaacagtatctatgcctgccaaatgtgaacatacaaaaaacaaatcagaatgtgccattctgatttaaactgcttattagttaataccctcaaggcaacatctgggttcttggctgcaatgagtcaagcctacttacatctttttttgtctttggctgcacatttcctatcacatcacactccagcaatgccaagctgtgccggccttctaccccatctccactattttgccctccgccgccgcggctttttgccccccccccccgcccctccccggctttttactctccgagacttttcgccccccgtcgccgcggcattttgccacccgccaccgtggctttttgctgcccgccgccgcggctttttccccaccgcggctttttaccgcccgtcgccgcggctttttgcccacccgccgccgcggctttttgcccccaccgctcctcggcgttttgcccgccgcggctttttgcgtccccgccgccgtggctttttaccacccccccccacgtgccgcggttatttacccgccggagctttttgcacccccgccaccacgactttttgaacccccgccgccgcggcattttgccccccgccgcagcgactttttgcccgccacggctttttgcacccccactgccgcggctttttgccccccgacgttgcggctttttgccgcccgccgccgcggctttttgccccccgccgccgcggctttttgccggtcgcggcttgttgcccccctgccaccgcggctttttgcccccaccccccggtgccgcggttatttgcctgccgcggctttttgcccccgactgccgcggctttttgcccgccacggctttttgcccctcgctgccacggctttttgcccccccgctgccgcgattttttgccccccgcggctttttgcacccccgccgccaaggctttttgccccccgacgtcgcggctttttgccgcccaccgctgcaccggctttttgcccgccgcggctttttgacccccccgccgccgcggctttttccccactgcggttttttgccccccgccgccgcggcattttgccccccgccgccgcggctttttgccccccgccgccacggctttttgcccccccgccgtcgcggctttttgacccctgccgcagcggctttttgtcccaaggccatcctcagaagcatgagtggaacagagtgaagggaaagctattttcttctaaagctcaaaaatcttgaactttcaaataggaataagtgttatttttgctccaagcacacatttgagaaatcttccatttagcggatctgatgataaacccacattttttgtttgttttaatctgaaaatgtatttgtatggttcttggaaattttttttgcatataaaattatattttatcagcttatttcaagttttatttaccattttataattactcctaaaatgtcattgattaaagaaagaatcatctattgctccaactgttctttactaaaggtaattttctttttaacctcatcaggctccttttaagctctcaaactgaccttattttttttttacagattcaatgcattaagtcaatttatttgactgaatttatttatgtatttattttcgctatcacaagtagaaaaagcctgtaagttgctatgccaaaatcctgcctctagatggcaaacaaaccccacaatacacaaaagagagccaaattcttagaaaccctgggaaaggaagagggctactgtcccattaacaacttggagcccttaaggcaagaatgaggtggaacatctggaacatctgggaggagacagcagggtgcagagtagtggggaacctgctctgtgctctgagactgaaagcccagccttgcctctcaccgctgccttgactgtgtccccatctgctgtgaagtgaatggtgtcttctaaattcatgctgagccctaattgctgaaaagtgtaagacatgcaatggggggattatgtgcatcttcctgacaccaacatgatgctgaggaaggagacttcttgttttctcttaggattcttttactaaccaagattttgcctctactgcgtatttccctttgctgattgtccctcccttttgacagaagatggcccagggcattcactactaagtctcaacctcttacccaaagtcgtcagtctagggttgctctttccttcatgctatttttgtgtgtttcttttcttgtaatcatcttggcaataaaataatcacttttttctttctacctattaaagatgttaccttagttaattacagtggtttccttcagaatgataaatagtctttcaaaatgatgtaaagagatctaaatccgtgtgctccagaagttgaaagaagctctgtctagcacgggtgccagtgactctcccagagtgctccatgcagctggccccacagagtccctctgtgctgtcatatcacccactgccttctgtgaatgagatattctgattggaatcctggtggatgctatttgagccagtgcccccacaactcctatgaaagccgaggaccacaggcccctgaagacaatcacaggtctctagactcacagctcatgaccgtcctctgcagacacaacttctccccggatggctgagggttgtcattgtctgtgtccttccttgtgcatgacaacaggagacatagaaggtctgtaagcagccctgcaagccagtttctgagcaagccctcctgtgtggggccctcttacctggacataggtgcgtaaaccaaaaatgaaactctaagctccctaaccaactgaatgaactcctcctctcagccaaggacacaccaaaatcaacttgaaatacaatgcagtccatgatcggaatggatgattggatatgccttaacttaccctcttccctttaaaattcaggcacaactgaccagcttttaatatgaagacagagaccttgagactgacaaagaaaactctttataccaataagataccaatgtgacagataccacgtcctaagagaaatcaaagtattttccccaagatattgttatttaatgtatttaaaaatgcctctgcaaagctggttcttgtgggaaaaatctacattctgtagagattcctttttaagtctctttcctgacccagagagatttaactaagagtttggcaccttttaagtctactaagaaacaattacaatctattctctctgaagcctgctacctggaggcttcatctgcatgatgcaatcttggctccaaaaccctttttctaaacccagaaactcccttgtgttgattacaggtcattaaataaactatttcaaccacctatgaaatctttgaatccaactatgacctggaagtccccaacatcccccctcctttgggctgtcctgtctttccatatcaaagcaatgtacagcttacacgtattgattgatatcttatgtctcccgaaaacgtgtaaaatcaacctgtagcccaacgacctttgacacactttctcaagacctcctgaggctgtttcactgatatttctttaactttgacaaaataaatttctaaactgattgagacttttctcagatacttatttgtttataggtatcactggatacacttaaggaattgaagagatttatgacattgagaaaactaggaagccagggtgtgtggagagagagagagagagagagagagagagagagagagagattgtgatgtatgtacaggactaacactgagacctggttatgtaatggtgtagtactgagtatcatccccaaatagtgaggtttcattccaagaagactacgcatgtatctcatttgggaaaacagcttttgcaggtgtaaattaaggagcttgaaacagggagatggtcttagattaatcaactgggacttaaatgcaaactcaagtgtcctaaaaaaaacaagaggtagagacacatttagcatagactgaagtggagaaggcaatgtgaacacagagacagagattgcagtgatgtgtccacatcccgggagagagaagccaccagaagctggaagagctaaatcagactgctccctagagcttcagaaggagccagaactgatgactccaagatcttagcccagtgaaactgatctggacttctgaactatgagagattccattcctgttgtttgaagctaccacatttttgagaacttgttacagtagcccaaggacactaacaaaaatggggctccgggaaaatccagactaaaggtgttgtgttggtttgcaatctccttgcttaactttctgatactagacataaatagatcagtgaaaaattttgtgattgaagcaatgtacatgaaacctacagtgtacagagaagcatctgttagttataagataaatatcgataattttagttgaaaatgacatatgactgttaatatctcacataacattctgagttactccagaatgcataaaaggggcactagatactcttctcatgtatgtgtgtgtgtctgtctatacatgtatgtacacttcatggtgcatcagctggcggaaccctcaggacaccccttcacatccccagtgctccatttcacacatgaggaaactgttcatgacagcacatggctgatttgcataaaagtcacttggtcagcagttgttgaagctgaacttggaatctaggtctgtctgaccttaactatgttccttccacagagccacgttcattccatagaggaacccaccacctataaaaccagaaaagagacaaagccagaagtgcaggttggatttcttaacacaagctcactgcgacctctagtcctcatcacgctgacactaagcttaaacccagacccttctacagttttgtctacaaagcacaatttgcccaaagcctttacaaacaccaacagcctttctttcagatatggcagcagggtcacatcttacacggccctgatcacattttctctcctctgccatccccatctctctgactcagtcctcgcttgcagccataaaaatggatgagttcatgtcctttgtaggggcatggatgaagctggaaaccatcattctcagcaaactatcgcaaggacaaaaaaaccaatcactgcatgttctcactcacaggtgggaattgaacaatgagaacatatggacacaggaaggggaacatcacacaccagggcctgtcgtggggtggggggaggggggagggatagcattaggaggtataccttatgtaaatgacgagttaatgggtgcagcacaccaacatggcacatgtatacatatgtaacaaacctgcacgttgtgcacatgtaccctagaacttaaagaacaataataataataaaaaaaagaatgagtcttgtacatctaatttgcctcacaaatgttaaaacagcaaacccgcatccccttcctcttctcatgtgctgtgagggatgacctccaggctctcagatactaagattgtacaagacctaacccagagaattactcaagacactctacataagaagaattgtggtgctagctctcctcatagaaaaatattttctgtctcttgttgagattgacagcaaacacaaaaacacggaactatttgggagaacagaagacagtgatacactagggaagtaaaacacaccccttccccttgcattggtttcctgttgctgctgtaacaaattaccacaaccttactgctccacataacacaagtgtattatcttacatttctggaggtcagaagtctcaatgaagtaaaatcaaggagtaatagggctctattcagtctaggcttcaagagagagaatccaatattgagcattccgtctttctgatgttcccacattcctagcagcctggcccgttcctccaccactccagtttccctgtccattgtcccaggtcctctctggctgttaccttcctccctccctattgtaaggacccttgtgattatgatggtctcacccagataattcaggatactctcctgaccccaaaattctcaaccatgtctgccgagttatttttgacatattcataagtaacgatcatagattccagatattaggacaatgatgtctttagtgggtgtattattcattccacaaacaactctcatcatccacacaatggtcttcccctaaggtagaataaaaatatcacaaggcagatttatgaggcgatcgacctagaaaaaacctgagactctaggactgtctgatgtgtggatgtcaaatcctgggagattctgagtctctgctctatgtggactctatgttgtgtagccatttgtggaaggcttctgtgattttgtgacctagagaaaatgaatctctgctaaaatcaaatctaagaaagattggcaaagggaatttaaatatttcctaaatttttggaatttccctaggcattaaaacatgagaagtggcaataattcaaaccaacgatgccctccaagaataaggatttttccaatgcattaggttgggtcccctcagtgagaaggatgccaaagattcgcatgtagacagtatatttacaaagtgcgggaaacaagcaagtgagcaagggaggggaggagggaaagggaaagtgaaaggtgcctcagaaggagccacctctgaggatgacgagagctcaagcccacatagaaacacaggaaaaatgcctctgttattccacctgagaggtgagggagctgggggatgtgtacacctcccttgtcatcactgattgacagccgtcctaggggatgctaattccaggccatgaggtctgcctcatttgcagcctgagctgcttccccaggttcagatagagcagtgaaggggagaaagggccatagagagtcagctgaagtataatgactagaatccccaaggcgtagtaacaatgactgctaaaattatgcacaaagaaaaagcgcatttgaatccagagatgtatctctctgaatctggatatatggatcctggcagcctgttcagtagccatttcccagaaatccagtcctctggaaaagcagcaggaggtttgtgcacaggctgcactaccttggtctggccactggtagtcgtgcatgagaactactccctggagtatttctcagtccactgacactgatgtaattggctccacttcccctgctgttgagccaggccaacatgccctggacaaaggcatctgtgtgaagtattgaggttcaaatcagtgcttaagatatgtttggatgcaaaatactttttcatctacatgggcagtgtcttggcagaagatggagattctctctaaatggatgtgagacagggtggctggcatctgggtcagtatgatgccctggtgcatggcaagaacatgcattgggcagcagctgccctcactaaggagagaggttcactgacctggcttttcacccctcacctgctctccagaaagccagactctagggcagatgctcctgagactccaagaacagtctggtggggagcgcagctgagagcattactcaggggatgtggcttttgtcatcctactttgaaacaattgactatctgagcctagattgatagagggcttcaagttgattttaatccaggctcctatagtcagcgagtgaaacagagattttagttgaaataatgacacctggtattactagtcagctctccatgctggagaaccataagaaattataccaaaggcaggaaaggggatagatagaatatggggatcatcacgccaagaataaggtgcagcccatttagcccctgggtcttaaagagacccatagctctggataatggcagatctatgcctgacacagttatcatctttgtgcatcttcagagaattgtttttccttttactcctaggaacaatgtcttaagtttgttagtaaattctatttaatttattaaagatgctgctgataaattctttttatattcatttcaaaaaagaagcaatttcacaccgacagagacattgttattatagcactaaatacttttacactcatcaaattcctttgagactaactgaaatttctgacagccctacattctactactttattgtaaattttctgccaaaaaggatgctttcctatacactcctaatacaagtataaatatattatttaatctagtcttaggttgatttaaaattttgaaaattcactccaaaaatatgttctgtaaccatatggccaccaatgagaaatgtattctttcaaggtaaatctgtgctgtcctggtctgacctgggactctggggatactgcgcccgtgtgctgagttactgagatgagccagccctgcagctgtgctcagcctgccccatcccctgctgatttgcctgttcctagagcacagccccctgccctgaagaatttttataggctgttcacacccggtgcaggagtcagccccagtcaggacacagcacagaagtgagggcccccactcagctcctggggctcctggtgctctggctgccaggtaaggaaggagaacactaggattatactcggtcagtgtgctcagtactgtctggaacttcagggaagtcctctgataacatgattaattgcaagaatatttgtttttatgtttccaacttcaggtgccagatgtgacatccagatgacccagtctccatcctccctgtctgcatctgtaggagacagagtcaccatcacttgccgggcgagtcagggcattagcaataatttaaattggtatcagcagaaaccagggaaaactcctaagctcctgatctatgctgcatccagtctgcaaagtgggattccctctcggttcagtgacagtggatctgggacagattacactctcaccatcagcagcctgcagcctgaagattttgcaacttattactgtcaacagagtgacagtacctctcccacagtgttacaagtcataacataaaccccaaggaagcagatgtgtgaggctgggctgccccaatgctctttctggtgcctctatctgctgagggaagttctcaaactcagtcaggtttggaaagtcattgggagattttcctagaggaggtcaggaggttcctctgaaccctaagcctctttcgccctcatccccagcagaaaagacgtgacaatgcctgtcctgactgaataaagaagagagataagtccagctgaggagtctgtgttatgggataatcggaatttgtacagcaaaagagaagctattctcagtatttcaaggagaaattattcaagttgaataaattagagtctaaaccacagtctttccgaagcctgtggagtgttattcatgaagtaggtactagacacaggggattctcaggtgctacttcagaagccatggtgcacctgcacctggtggtatgtgctgaacactgtgtgatgatcctcggtcctgtctgggaagcccagggctgggggtgctgatgctctcagctgcctgcagcacatctccaggtgattctccagtccacacctaactgcatgtgttttacttcaggtgtcagtgtacatgaatccaccactctgacttcccaatctcatgacagtaattagttgtaacttattgtgacctcatggagcaactctgaagaaaccatagagagaaaaggagttttggaaaatgtgctcccagaagtgatagtaatgatggggaattgacagctgacggggaagtaaggtgactctttccacaaggctcaacattttgccagttatgaattgttgcaaaatacatttgaatgtgctttcaagtactatcagtttggggtcatagctgaaaaacttatattaagtcacagataaaatgggaaaatcaggaaattgtatgaaatatacaataacactgtgtgtgatggctcaggtctgtaatcctgtgatagttaatactgattgtcaacttgattacattgaaggatgtaagcattgctcctgggtgtgtctgtgagggtgttgtccaaggagattaatatttgagtcagtagtctggggaaggcagaccccctacttaatctatgggcaccatttaaccagctgccagtgaatataaagcaggcagaaaaaagtgaaaaagtgagtctggcccagcctccaagcctacatctctctcccgtcctggatgcttcctacccttgaacatcggactccaagttctttagttttgagactcgagctggctttccttactcctcactcctcatgcctgcagacagcctgctgtgggaccttgtgatcctgtaagttaatatgtaataaacccatatatatatattgaacttattagttttgtccctctagagaaccctcactaatacagatttcggtaccaggatggttctgcaggaacagaatattaaggttggagttcttttgttggttttggggtttctggatttggctgctaaatatgattagatcccaaaatgctaaggactctacttttaatagtgtagagaacattgacagttcttggcatgaaaggtttaaacagctatgcaaaacaaattcatttgacactaatgaatcatcgctcttgagaggcaaggagtttagtgactctgtacctaatacccttgacaaacaccttgcaaaatagatttgtgaggacagcacctgcatctttgaagagccctgtaaaggctcttctctgtatgtcagatctaatggtgagaactgcagtcactcagttacaaaagttaaatacaatttggaataattggatcctgaagtggcaggggccaagtgttagcactcaaccctcaaaggcacggtgagcgtagctacggtaatgggcagaaaagacaaagcagcaatctgaacagtctgactcatgtagagctctggcattggctaactaatcacagttttcctagaagtgaaactgacaggaagactaatgcattcctacttaatttatgtaaggaggaaacttaaggtcaaacagataaaagactaattggagttataaaaacagagattcatggcccctcaatcaatttccagccttgagccagtttacagacccagaaccccttgaatgaaggggaggctgagtccccctgaggtgtccgtggcagataggaatgctgctttgaggctttggcaggcatccttaggtgaatcatggtggaggcccctagtattttgcagcaaggcccggtcatcttctccagttaactactctccttttgagagacagctcttgtcctatactgggcttttgtggaaactgaacatttgactatgagtcaacaagtcaccatgcgacctgaactgcctattgtgaactgggtgctttctgactcatgtagccataaagtgggtcatgtacagcagcattccatcatcaaatggaaatggtgtataagtgattgggctcaagcaggtcctggggggcacaagtaagttacatgaggaagtggctcaaatgcgcatggtctctactcctgccaccctgccttctctcccacggccagcactgatgacctcatggggacttgcctttgagcagttgacacaggaagggaggactagggcctggttcacagatggttctccacaataggcaggtaccacccaaaagtggacggctgaagcactacagcccctttctaggacatccctgaaggacagtggtgaaggacaatcttcccagtgggcagaacattgagcagtgcacctgattgtgcactttgcatggaaggagatatttccagatgtgcggttatatactgattcatgggctgtagccaatggtttggctggatggtcagggacttggaagaagcatgattggaaaattggtgacaaagaaacttggagaaagagtatgtagagggacctctctgagtggtcaaaaactgaagatatttgtaccctgtgtgagtgttgaccaacaagtgacttcagcagaggaggattttgataatcaagtggataagatgacccgttctgtggataccactcagcctctttcctcagacacccctgtcattgtccaatgagcccatgaacatagtggccatggtgtcagggatggaggctatgcatggattcagcattgtggacatccactcaccaaggctgaactctctgtggccactgctgagtgcccaatttgccagcagcagcagagactaacagtgaaccctttgtatggcatcattcactcgggtgatcgaccagctagccggtggcaggttgattatattggacctcttccaccatggaaaggagagaggtttgtcctcattggaacaggcacttactccggatatgggtttgcctacctgcatgcaatgcttctgccaagactaccatttatggactcaaggaatgccttatccactatcacggtattccacacagcattacctctgaccaagcactcactttacaggtaaagaagtgaggcagtgggctcatgctcacggaattcactggtcttaccatattccccatcttcctgaagcagctggattgatagaatggtgggacggccttttgaggtcgcgattacaacgtcaactaggttacaatactttgccgggccggggcaccatactccagaagaccatgtgtgctctgaatcagcgcccaatgtatggtattgtttctcccatagccaggattcacagatccaggattcaaggggtggatgtgaaagtggaaccactcactatgatgcactagcaaaatgtttgctttctgttcccacgacattaggttctgctttactagtcatcttagctccagagggaagagcgctgctaccaggagacacaataacgattccattaaactggaagttaagatggccacttggacgctttggggtcctcctacctttaagtcaacaagctaagaatggagttacagtgttggcggcagtgattgacccagactatcaagatgaagtcagtccgccactccacaacggaagtgaggaagagtatgcatggaatataggagatccattagggcgtctcgtggtattatcaggcactctgattaaggtaaatgggaaactacacccaatccaggtaggactacaaatggtccagatcctctccgggtcacgacctgctgaggtgcttgctgaaggcaaagggaatacagaatgaatagtggaagaaagtagttatcaataccagctacgactacctgaccagctgcagaaatgaggactggaactatcatgagtatttccttcttcttttgttaaaaacatatttgtgcatgtatgcacttgtactaagaaaatatcttcatttcatttcccttttctttatcaggtgacatcgatttgctgacctcatatcagcatttaagtattgtttactgtatgtaatagtatttgggttggggattggtgcatttccagttgtaggaaggatagtttattatgttggggtaattatgatcttactattgtctgtaatttaagactatgtatgatctcaggagatgtgtgtgggttcaagttcacaaggggtgggcttgtgatggttaataatgagtgtcaacttgattggattgaaggatgtaaagtattcatcctgggtgtgtctgtgagggtgttgccaaaaaaaagattaacatgtgagtcagtgggctgggaaaggcagacccacccttaatctgtgtgggcacaatccaatcagctgccaacccagccatactataagcaggcagaaaaatgtgaaaagagacaggcctcgcctcccagcctacatctttctcccatgctggatgcttcttgccctcgaacatggactccaagttcttcagttttggaaccctggctggctctttttgctcctcatccagcagatggcctattgtgagacttggtgactgtgtgagttaatacttaataaacttcctgtattagccagtgacatctagagggacagaactaacaggagatatatatatatatatatagatagatagatagatatagatatatatatagatatatatatagatatatatatagatatatatatatagatatatatatatagatatatatatatagatatatatatatatacatacacacatacatacatatatatatgcacacacacacacatatatatatatttatttataaaggggagtttattaacttataggatcataagttacacaatgggttgtctgcaaactgatgagaaaggagagccatggagtccaatgtttgagggcaggaagaaaccagcatgggagaaagatgtaggctgggaggctaggccagtctctccttttcaaatttttctgcctgctttatatttgctggcagcagattagattttgcccaccagattaagggtgggtctgccttccccagcccactgactcaaatgttaatctctttcggcaacactctcacagacacaccctgggtcaatacttcatatccctcaatcctatcaagttgacactcattattaaccatctcactccccttcatatatatatatgtatatagtcctttaattctgtcactctagagaaccctgactaatacatctacacttctgatggtctatttcttttattttaggtcatttatttcccctgggttgcctacactcgcttcttcccactcccctatgaaggacaatataagcctctggacctcactaagtcagggcatgtccctgcttgcactatgcatgacacttacctcttttactctttagcaatgagggaatgtcatccttacccagatgccagccacccgtctcacatccaggacagagagtctccatctcctctccagcaaatacccatgtatgtgggcatggtggcatgtccctgtgatcccagctactccataggcttagtggggagaatcacttgtgcttgagaattcaagattgcaatgagccatgatcacaccactgcacttcatgctgggtaactgagtgagaccctgtgatttttcccctacattttacagatttttttttactctttcttctattaatttatgttttgtccattcattttctgcaaacctttagagggcaaataggaagtttccctttttaacgtggtggctcacgcctgtaatcccagcactttgggaggccgaggtgagcagatcacctgaggttgggagtttgagactagcctggccaacatagagaaaccccacctccactaaaaaaaatacaaaattagcagggtgtggtggtgtgcacctgttatcccagctactcaggaggctgaggcaagagaattgcttggacctgggaggcggaggttgcagtgagcccaaattgtgccactacactccagcctgggtgacaagagcgaaactccgtctcaaaaaaacaaaacgaaacaaaaacaaacaaacaaaaaaaccctactgcctcactgaattaaagccgtgttcagcagtttctttgttatttcaaagagtggcatctgcttcagcagggtcagtttttaatgtatttgttttgtttcttttttctctggtgttcttttttattttattataattttttaaatttgagggatgaggttttcatagtactgaatatcaaacaatgaatccgcatgaatgattcacctaatttccttggttttagtcctctatacaggttttatatagcaaaagaaccatttaaagacttgggttacaaatgtattttattttacctctggcatgccttggcctgagaaagcattatatggtggcacaatatttgtaacattctcatcgccatctggtggtggttcgaggtatgacgttttgaaaatctagcaagaattaaaatatgtcaagttagaaagaaaaattccagattattattaagatataattcattttgccccaagtatatacttcagactaagcatcctggaactaggttctataattaaatagataaattacactgacaacaatgagaaagagccttatcattattattgtcttcctaataatagaaacttttataaatgcatgcaatcccaggtaaccaaaagtttccttataaagtgtaacagcggagcctcaaaggtggcactttggcaagcctctttttttgactatggcttttcagcttcctttgtgggctccttttctttcatctttatttaaataatatttccttatgttttatccccagcccgttgcttgcctctgtactgcctccctgcgagacttcattaagtatcagaattttacccatagctcatatgcttatgatgcttaccttttcagattcgtatatttaaatgttttgtggttatttcattctggatgtcctaactcaacatgtctcaccccgggcctgcttttggtctgcatttcctacctctattaatagcttcagtcattagccacggacaccagacagtctcggagtcatcctgaactctgtcttcccctccttccccaagtcaatcactaatcaagtcctgctaatacattaccttactatttctgaaatccatccctcttcctcattcctactaacatcctaatttaaaactttattatcttttacctggactattgtcttaagacaacaactttaatccgttgcttagcctaggtgtaatccacagaggatcttgtctgtctaaaatgcccctctagccacatccttcgcctgctcagatcttgtcattggctcccatgaactgaagttgaagtttaagctccttaggacagcatacacgcgcttctatgatctgttcccagaacatatttactggtttatttcatatcatggcccactttgtattttacacttttgaaatacagacaatcattacattctcccaatagtactaagctagtgtatgcctaaaagcctttgccaatattttatcttttgttgagaattctcttagcttattttgtcacgtggttaactccttatgtcctttcatgactcacaagtcaagacttcaggaaaccttctctaactcccaggctgggctgagtgacccttttctgggtaaataatgaactctaatcatactcttcatagcacttaccatactaatttgaagtctgaagtattccattgtctgcctcactttacttaggcaaaggaaccatgtcctagtctcattctggcctcaggagttcagcctgggtgacagtgggagactgtgtgtcaaaaaaaaaaaaaattgccaatgattgaagcctaatactgaagattctggtttattaataattagtctgttgctgggtgttaattgagctccccaagtgattactcatgtaggacttcaaaccaataatttagaaccttgtgactcaaaatctgggcaaaaataagcagcatcagtatcacctgggagcagcttccggtctcattttagatttactctgaatctaaatattatatttttattaaaaaaaaacaagaacagatgacaagcttcaactacatctaaattctttagatttactttaaaagaatcaacattttgacacaataccaaagtgaactaaattcgctttttttttttttttgagacatagtcttgctctgttgcccaggctggagcgcagtggtgcaatctcggctcactgcaacttccacctctccagttgaagcgattatcttgcctcggcctccaaagtagctgggattacaggcacatgccatcattcccggctaatttttgtatttttagtagagacagggtttcacaatgttgggtcagctggtctcgaactcctgacttcaagtgatctgcccacctcggccttccaaagtgctgagattatagacatgggccacgatgcccagcctaaatttgctttaatttggagtactggtctagaaaacacaaattccaaggagactcaggttcttaagttgatttcttgagtacaagttcttcaaatgcattctccaagattaatttttttttgtactttttaaattgacaaagattatacatattcatggctatacggggatgtttcagtacatgtagatggtgatcagatcagggtaattagcatatctatcatctcaaacatttattatttctttgtgttgggaacattcaaactactcctaggtattttaaactacataatatagtatcgttaactatagtcatctacagtactgtagaacactagaacttattactcctacctagctgtaattttgtatccattaacaaatctcttactattcctcctttctcgctacccttttcagcctgcagtatcctctgttctactttttacttctatgagatcaacttttttttagcttctgcgtgagtgagaacatgtggtgttgaaatttctattcctggcttattttgcttaacataatatcctccagttccatccatgttgctgagaatgacaggattttatttattcttttttatggctaaatagcattccttggtgtacatataccacattttaaaaatccattcatctgttgttggaaacctaggttgattccatatcttggctattgtgaacactgttgcaataaacatggggatgcagatgtctctgcaatataatgcttttctttcctttggataaatacccagtagtgggattgcttgaggggtttcaatactgttctccatactggctgcactaatttacattcctaccaacagtgcataagagttcctttttctccagctactcaggaggctgagggaggagaactatttgaaccctagaagcagagggagccagattacaccatcactgcactccagcctggacagagagtgagactctgtcaaaaaaaaaagtcccttttcttcacgtctttgtcagcatttgttatttttgtctcttctataatagccatcctaactggagtaagatgatgcctcactgtggctttgattagcatttccttgctgattagtggtgttgaacattttttcatatatttgttggtcatttgtatgtcttcttttgagaaatgtctgtcagagcatttgtttatatttaattagattgttgtgcttctttgctgttgatatgtttgaattccttgtatattcttgatattaatttcctgccggatgagtagtttatattttctcccattctgtaggttgtgttttcactcactttattatttcctttgctgtgcagaagatttttagcttgatgtgatcccatttatttattttttcttttgttgcctgtgcttttgatgccttattcataaaatattttcccagagcagtgtcctgaaggatctcccttatgttttattctagtagctttaccattttgggtcttatatttgggtatttgagatactttgagttgatttttgtatagggtgagaggcaggggtctagtttcattcttctgcatatggatacccagtttttccagcaccatttattgaagagactatcctttccccaatgagtgttcttggcatctttgtaaaaaatccgttggctgagatatgtggattttctgggttctttattctattccataggtctatgtgtctgtttttatgccaataccatgatgttttgggttactacagttttgtagtatattctgaggtctggtagcatgatacatccagctttgttctttttgcttaggatggctttggctattcaggatattttttgattccataaaatctctttggatttttttaattttgtgaagaatgttcataggtattttgatagagattgcattgaatctgtaggttgcttttgagtagtactgtcactttaacaacgttcatatttctgatccatgagtatgaatgtcttttcatttgtttgcatcctctttaatttctttcattagtgatttgtagttttcattttacctccttggttacatttatgtctgggattttttttggtaactattgtaaatgggtttgccttcttaatttctttttcagcgagtttgttgttcatatatataaatgcaaccaatctttgtgtattagttttgtgtcttgcacaaataatttctttatcttctagttctggaaataccaggtgctgtgtatgtaaagcaggaattttggttgaatattgtataattttctgaccccctgttactaatccagtttcccctgtactctgatcttccatgctacagacagactgacagatgctcagcaaatagtagctaatattttctaggaaactaggtgctaaacgagttttcttaaatttctacctccaggtctgtaagttgatttgaagcattaccagtttctggttctgcacaggttgttgagcgcaggacttctctcttccagtggaaagtccacctgctcacaaacaaccatcctttcctgcggccttcagacactgctcagtgtagcacccctcccagtctagaataagcacactcatcatcagtctctctcattttctgtcttatctccattccttctacacacagtttttgtttttgccaatgtttttaaataaacaactgtacaagcacaacaatgacaacagaaaccctccttcctcccagtgttgtagtgagcaaggaatatatttaacttcaaataaaagacaaaaacaaatgctggataaagctgacggaaagaaatgaaactgtaggtgctctggcaatatagaaatgatacaactaagaaaaatggaagaaaaggaaagagagagtattcctcagaatgattttactgactgctcactgtaatgcctgggagtcaacggatattgtttatagaaatgtaagcatacttaatggcaccaggggaaacaaagttaatatgattaaatcaaattgtgggatgaaaaatcacataaggaggacaagaaagagaatacagctaataccattgttcttagtttagagacattagctactgtctaaagaaagagatgattttatgaaattacataaggtagccatcagaataaaagtttaactcttccaaatatcacaacatcaaaacaaaagcaataaaaacaaacaagacagcaaaagacagatatgtacatataaatcatagcataatatactgtaatcaaaatataaccaaacacaatttatcattaaaagtaagtgggcttgactcttattagaggaaaaaatattgtcagattaaatcaaaaagcaaatctcaattctatgctggatataagataaagtgttacagaaagtttagaaataaaagtaaaggcaatgaataaaaggatcttctcttcatgcgttaggagtataaaacagtaagtaaacacatcatacagtttctgtttttacacttaaatggctggagatgttacaccactagtatgaatttacttcagatatataaaggatacacttttatgtggttagaaacagcaatgataatagttaaggtgaaaataacatctgcattgacgctaggaagaaagagccattgttgggtacatagtgatcacattaccatggagcaatctgttcccaactgaaatgcccttgcccttctattgaaatcatgtaagattctgcaaaagtagtgtttacttcccacaaatcagccatttgtgggaatggctgctattgttgtccacacggaatcagcatcagacctatatttagctgttgtaccattaagagtcatatttggccctttccagaggctgttatttcaattatattttggagaattagtctatttgcagacaaataattttaccagaactttgatccatatgaaatgaccctttggtagggatccagggattgagtttatttttaattactatagcatcctggtcaggttgagaaacagattacctttatatttccctggcatgtgagcagggctagatttagcgtgagaatgcttgaaagtttatagttttttagaaattttatttactgtgtgtctctttatcaaaataaaattaattctgaaaagctctattaaatgaattattttgagatggtcttttccccttcatccaatgagaggatatccacagatatgtcaggagcttgctttacgtagaaatgtgttgagggccacaggtttgggttcacctgggaatgtttagggacacctccccaagttgttgttgaagagtggggtaaatgtaagatagaattaggctcacggagaccagatgagagcatcatgtcaccccagaaacacagcatatacctaagagatctgttctcagtatcaaagtcttaagcaccgtaagattgcatatagaccaagacaacaactatatatatatatatatatatatatatatatatatatatatatatatatagttaataaaatcagttaatatataaacatatacttattaacttatttttatttttatcttcagacagcatcttgctctgtcgcctaggctggagtgcagtagtgcaattaaggctcactgcagccttgacctctggggctgaaactatcctcctgcctcagtctcctaatgtgctaggatgagaggtgtgagtcaccttgccaggcccagggcaataactatgcaatgtttatataatttggagcaaaaaaaatatttgaaatatgtgtgcattgctttttaaccttttctattgatttactttattaaatactgaatagaaacaatatatttataaaatatttattttatatatataataagcacataatgaacacctgtgtctccagtcttggtttaagaaattaagccaaaagtaatcataaatgcttatgattacttttgaagtcatctgtacaacttttgctgactacatccccttcttcaaaactctaatgatggccactgtgagcactgtgtatattgaattgtgttgtattttaataccgtgtgcactacattgttttcctagctggatgctattgcatttagtgagcataatgaattatatcaatataattcacttttgtcatttcattgtttcagcttttctgtactaattattgccaatatatttctactggcataaaaacagacacataggacagtggaacagaatagagatcgcagacaaatctacatatttacaaacaactcatctctgacaaaggcatcaagaacatacacggggaaaacaacagtcttttcaataaatgatcctgggaaaactgaataactatatgcagaaggataaaattaaacccatctcaccatacacaaaaatcaaatcaaataaaaatggattaaagacttgaatctgagacctgaaactatgaagctaattaaaaaaaaaagcataggaaaggctgggcgtggtggctcacgtctgtaatctcagcactttgggaggccaaggcaggcggatcacaaggtcaggagatcgagaccaccctggctaacacggtgaaactccgtctctactaaaaatacaaaaaaaaaaaaaatatagtggggcatgatggtgggtgcctgtagtcccaggtactcgggaggctgaggcaggagaatggcgtgaaaaaaaaaaaaaagaaagaaaaaaagaaagcgtaggagaaatgctccaagacattagtctgggcaaagatttttttgcgtaagacctcggaagcacaggcaacaaaagcaaaaataggcaatgggattatatcaaactaaaaagcctcaagcaaaggaaacaataaagtgaagcgccaaccacagaatgggacaaaatattttcaaactatctatctgataaaggattaacaagtagaatatataaggagctcaaacaactcaataataaacaaacaaaaaatctgattgaaaaatgggctactgaagaggctgaggtaggaggatttcttttttttttttttttttttttttttgagatggagtctcactgtcgcccaggctggagtgcagtggcgcgatctcggctcactgcaggctctgctcccccggggttcatgccattctcctgcctcagcctcctgagtagctgggactacaggcgcccggcaccaagcccggctgattttttgtatttttagtagagacggggtttcaccgtgttagccaggatggtctcgacctcctgacctcgtgatccgccctcctcagcctcccaaagtgctgggaatacaggcgtgagccaccgcgcccggtcaggaggatttcttaatcccaggagtttgaggttacagtgagctatgattatggtactgccctttagcttgggtgacaaagcaagaccttgcttctaaaaaaataatagttaaaaatatataaataaatacaatttaaaaatgggcaaaagatctgaacagatattttctcaaaagaagacatacaaatggccaataggaagatgaaaaaatattcaatatcactaatcatcaaagaaatgcaaatcaaaatcacaatgcaatatcatctcaccttggttgaaatgacttgtttcaaaaagacaggcaataacagatgctggcaaggatgtggagaaagggaaatactagtacactgttggtgggaatctacattaataaagccactatggagaacagtatggaggttccccaaaaaagtaaaaatagaactaccacgtggtccagcaatttctttactggatatatatccaaaataaaggaaattaatatatcaaagacatatctacatgccgatgtgtactgcagcactattcacaatagacaaaatatggaatcaacgtacaacaaatgaatagattttaaaagtcatatatatacataatggaatactactcagatacaaagaagaatgaaattctgtcattcgcagcaacataggtggcactggccatttggcttaacgtaatgaacataggccattgtgttaagtggaatgagccaagcacagaaaggcaaataccacatgttgtcactcatatgtgggcagtaaaaaagtggatctcatgaagatagaaagtaaatcggtggttgctagaggccagcaaggggagtgggaagaggagattaagagaagaaaatataaatgtatttatcaccactaaactgtcctctaaaaatgtacagatggtaaattatatatatattttttaactcaataaaaaattaaaaaaattctgctgtgtgtttatagggcacatgtacaagactttctctagggttgtatcagttttctgttcctgctgtaacaatttaccacaaattcagtggcttaaaataacacatttttgtgagatttgagtcagttttaaaaaacacacacaaacttattgtcttagaattgttttggttggaaatctggcatggctctcactgaactaatatcaagatgttggcaggctgcatttctttctaaaggctctaaaagagcatctgggttgttggcagaattccgttccttgtggttgtagatcctcagtttcttcctggttgtaaactttgggtcattcccagcttctaaaggtcactggctttccttggcttgtggccccctaccactgttttaaaagccagtaatagcaggccacatctttctcatactgccatctgtctgaatctcagcatccagaaaatattctctgctctcaaggaattatgagattagattggctcaccaaggtaattcaaggtaacttccccatttcaatgaccttaatggtaatcacatctgccaagtccctttgaacatgctaacttacgttagcatgttcaccttatctgaagactgggatgtggctgtctttggtggggggcaattattctgcctaacccaaagatacacaacttgcagatatacaactggttcatggagatgaaacattttcaaatctacaagaaaatgttttctaaaatgagcatttcatattagactttcacaagcactgtatcagaattatatttacttcataatgttgccaatactgatatcagatatttaattttctagccagttcaggataatgtgaattgtgaataatatatttgttcattcagtcaacaaacattttttatcagataccaccgatatgctggacagtgtcatggatcctaaaaatatagctgttatttttttttttaaacaaagtccccactgtgataaagcttttattctttgggacaggcagacagtaatccagataaataaatgcaagggcaaattgggggaaaaattggaatggagagctcagaatctggccccagagaagggcggagggaaaggggacccagttcagaatctcggtgcgtccacaccaaacaattccatgagggctgaggagacagagctgaaaggcttgtctgacatcacaagagacagaaaagtgagccccattttcatctctatcctggcaatgttcctggcttgatttcctccttccagcagacacaagaatcagggagcgcaccctgatggtaagatttttttcagaggcctattttgggcatcctggtgagaacctgagtccgtcactgaccacggcagcccagcatggtccccagtgcgtggcccaaggccaagattctctacctccatcctggaggcagaagaaatgtctgggggaaaatgagaggttttaggtggttggcactgggtgagaccaaggagaaattttaaagctgtgtgtcctggggccaggggcggtggctcacgcctgtaatcccagcactttgagaggccgaggcgggcagatcacgaggtcaggagattgagaccatcctggctaacggtgaaaccccgtctctactaaaaatacaaaaaattagccgggattggtggccggcgcctgtagtcccagctattcgggagactgaggcaggagaatggcgtgaaccgggaggcgcagcttgcagtgagctaagatcgcgccactgcactccagcctgggtgacagaaagagactccttctcaaaaaaataaaaataaaataaaaataaaaaatagaaaaagctgtgtgtcctttgtttcttcatattttgcagatttttgatgtcaaaatattttcatagtcaaaagagtgttaataaagaatgacttctctgttataaaaaccctaatagtgaatgtatttaccaagaagttagattctatctttggtttttttgttttttgccccgtagtttaaaaaaaatagttttattgtatggatattctatagttagtgtatctattcacctcttgatggacatttggtttgcttccagttgtttttactatttcaaataaagttgctacgaatgtttgtccaatcgtttggacatacgctttcatttgtcttgggcaaataagcaggatttgaatgactaggtggtgtgatatgttcaatttttttttttttttttttttgagacggagtctcgctctgtcgcccaggcccaggctggagtgcagtggtgcatcgcggctcactgaaatctccgcctcccgggtccacgtcattctcctgcctcagcctccggagtagctgggattacaggcgctcgccaccacgcccggctaattttttgtatttttattagatacggggtttcaccgtgttagctaggatggtctcgatttcccgacctcgtcatccgccagccttggcctcccaaagtgctgggattacaggtgtgagccaccactcccggccagtttaacttttaaagaaactgacaaagtggctgtatttccagcagcggtgtatgagcattcctgtttctttgtgttctcaccaatgtttagtatggtcagtcttttaaattttagctattctaataggcatgtggcagtatctcattgtagttttaatttacatttccctaatgatgaatgatgttgaacatctttcaatgtgcttacgtatcatccatctgtattctatggtgaaatgtctgttcagatctctacatttgtgttagactatttgttttcctattattgagtcctgagagttctttgtatattttggataacaaatgtatcttcaccagatatagcttttgtaaatttttactcccagtctgtgatttgtctttttattctctcgatagcgtttttctttctttctttttttttttttttttttttttttgacagagtctggctctgtcacccaggctggattgcagtggcacgatctcggctcactgcaatctccgcctcccgggttcacgccattctcctgcctcagcctctcctagtggctgggactacaggcgcccgccactacacccggctaattttttgtatttttggtagagaggggtttcatcgtggtctagatcacctgacctcgtgatccacccacctcagcctcccaaagtgctgggattacaagcgttagccaccgtgtttggccactggatagtgtttttcacaggtcagattaatttttatataaatcatttattttatttttattatgtaaaattttataatttttaattttatttttaatttcctttttaaaaggtaaataaaattttaagtgtaatgatgcaaaattttgtttaaaagtaaatgcatataaaaatgttgatatagactaaaaaattgaataagaaggtagttagttgtcacagtaggagtgaagtgaaaagcttcccctttcaccctctgaagattaaccgaaatgaactgaccatacacagattaataaaagaaagggtatacaaacttacttaaactgcaaaaacatgagagctatacacaaagtataagacttgaagatggctcagatcttaaacgctctcctcataggcaatagatatatagacccaggatgcagacattattttgtaaataatttcctttggaagctggatgggacagaataattacgggacggtgagagatggaactgcacaggaaaaagtttgtctttgtcactttaatcttatcattactagagaataattatgaatattttagaataatatatttttaagcccaaacctcaccaaatgttttttctaaaacaaatactttttgttgttgtttgtttgtttttgatactgtgtctcactctgtcacccaggtatggagtgcagtggtgcaaccatggctcactgcagccttggcctcctgggctcacgtgattctcctacctcagccttccaagtagctgggctacaggcatgcaccatcatgccctggtaattaaagaaaaaaataatttttgttagagaccaagtctcattatgtcaccctggctagtcttgaactcctggaatcaactgatcctcatgccttggcttcccaaattattgggattataggtgtgagccacagtgcctgaccacatatttctatacttcactgaagaaaggaaggtgctaggaaaattggttaagaactattttttaaaaagctattagtagtgttttattttattttattttttaatgattgattgatttttgagattgggatctcactatgttgcccaggctggtttcacattcccaagtttaagcaatacccctgcctcagtctcccaagtagctgggatgacaggtgtgtgtcaccatacccagctccattagtagcgtttttaacaattgtgggccactgagtaagaataattttttttaattaaaggttattttttaaaaagcacatttgtagaaaattactagcataatctgcctaaaataaatatacatattgaaaaaatgtttgctctgaacaaaaataaatatattcaccacacatacatacatacacacgcacacacgcacacacacacacacacacacacacacaaacattatggaagatttcaagaccaggcaataatttccactcaatccaaaaacaatgcaatcccagagctgtgtatttaggtgaaaaatatatcaggaatgggaggcattcaggtttaattttcatgttttggtagagttaggatgtgacttttcatttaaaaatattctttatttttttgctactattgtggtttctgtattgttactatacaatctgtaaactaaatagtaaaggagagaaaagtgattttcaaagaagctggcttgggaacaggtactattctgggaagatgaaaggtttcacttaatgactggtacctgtgccactctggttattttaactgttaaccttttagcaagaggtttttcttttaaaagacatcctttactatttgggaagctagtgcaatagtacacattgaggcccacataccacatgccaaatatttaaaaggcatatttctagctaaccactgtacatacatatattttttctctcttatttttattttagtttttttccttgtcaacaatttaatgtccacacttatcttctatcatcccactttgacaaataatttcataccttcaaaatgatgtggaagactagattggaatttagaaccgtggaacattgtaattgtacaggcaagtttcttcctgggaaaaaataaaacaggaagaaaaggctgggcagcctctggttcaggaaggaaattcgggagtcccttatagcagcatctctagtacttgggaaccgaacagacttctcggcctgtgaggctggaatgggcccttctggagaacacgacagagtagttatctactgcctttgcccccagggcccaggcaacacttttaccctccattgcttgtctccgaagttaaggggaggagacaatgttttgtttagtgacctcgacagaaaaggtgtcctcctgcaaccactcatttgttactttccttcttcctgaattgcctggacccactcctcctccatttgactggctctgtgcactgatgttatagtcaggaattgtggcttctaaaaatgtacacccgactctacccatagctggccctgtgaacctacatacttgctccactgtgtctccttctcatagagacactcttcctgctgagtctctgccctctgctcctagatccaaatggcatctcctaccctatccctgtatggcttaacctagggaaactctttcccagaggagtcaggtaaggagacggtggctgagcttcttacagacttaaaggagacatcctggaatttaggagtccatccttcctttctgtctccctggcagctcctgctgctgctcaaagtttagctttgtctctcatccaactcagactgttgctggtcctgatggcctctgcttagcagtattagtatgttcttgcattgctataaagaaatacatgagaaatacctttagttggctcacggttccataggctatgcaggaagcatggtggtttctgcttccggggaggcctcaggaaacttttattcaaggtgcagggcaaaaaaaaaaaaaaaaaaaaaaaaaaaaaaaaaagctaccagcactgcactgtgaggccctgatccctgagctaacttcatattattacctctacagcaagtgtctgtgagaacatagatatatttcttatgtgagtacacaatttacagaagaggaactaccctcccaaccaaaacaaaatgtcataattttaatttaccagcaaacctaggttgcttctgtgaaatgatctcatttgctgagttttaaaattgactaaatttcccaatttccaaatgaaaatatttagttatcttgccttgctatgtgtttttggttaatatgatgattaatttttggtctattacttaatatatttcatgattgttgatatggattataaggactcacaaaatagttttcagatgtctttaatttttttacttagtgtagatcctataaatggattaggagtattctattaactcccatgtattcagaaatcgaattggagtggtaaattctgtttgaggtaacaagggatatcaaaggaaaaaaataattttgtgactatgtcttctatacataaatttttcaggcatctttatcaatggcttatactaaagacattttctggatcatgggtgacagacagaagacatgcggataagtggcattgtgtacactactgcattttatcatctggtttatttttaaacttttatttctcttaaggatgttttattaaccggtgcatcaccagattaacagtctctggaacactaaacttaccagaaaatacttgttgattgaattaacaagaaaacaacattagaaaacagtggtggcttgtttttgtctgttgcagtatcttggagagtaaagcctaactctttaattttggccaaaaatataaagaaatacctgagaaacacctttagttggctcatggttccgtaggctatacaggaagcatggtggtttctgcttctggggagtcctccaacacttactggcagggtaattttgaagaagtcatgataagatggttgttacaattaaatgaaataatcaaaatggaagagcttatttagctgtcttccctaaatgaatcactggcaagtaagagtgtgattgattttcctaccagtcaggactcaccccttgaagctataggagggtaaacctctgaagaccatacaatttagggaacactaacacctcaaaaaactctgtaaacttcgttccttccttttctttcttccttccttccttccttccttccttccttctttcctccttccctccctccctctctctcttttctttctttgttcatttttgagacagagtcttgctctgtcactcaggctagagtgtagtggctggattatggctcactgctgccttgacctcctgggctcaagcaatcctctcacctgagcctccctagtagctgggactattggcatgctcagctaattttttcctccttttctttttgtagagacagggtctcatcatgttgcccaggctggtcttggactccttggatcaagcaatcctgctgcctcagcctcccaaagtgctggattacaagcatgagccactgtgcccagccttaagtttttttcatacaggaggaaagaatttgggaaagtaggtgtgtgtgtgtgtgtgtgtgtgtgtgttggttagggagccaacacatttttctgcaaagctttgaattctgtgcctcagtttttcatttttgttatgtgcaaaataaaatcatatcctgctatagatgtaaacctgtgagcggatcctactcaaaacctgattcaaactttgtgtagatctttgtctctctatggcataagaataaattcttctggttttcttccctcagaaaaagggacttagacttcccacaagccttccagaaagaactcacctgcctcatctgcctgaattacctcatagaccccatcactataggctgtgggcacagtttctgtaggccctgcctctgcctttgctgggaagaagcacacactcctgccctgcatgcagggagctgtcacagcaggaagatttcaaccaatattcttctgaagaatctagtgtccattgtcagaaaagccagtctctggcaattcctgagctctaatgaacaaatgtgcgggatccacagggagacaaagatgttctgtgatgtgggcaagagcctgctctgttttttgtgttctaactctcaggaacactggggcacagaaacactggcccactgaaggggcagctaaggaacactgtgtaagtgatgactcagagcactttgaaagctggagggcatcacaggtaaagagattaggaggaagatgaagagcatgaggattaatctattctttaccgagtgtcatgtactgcctaggcatcagtgatataactgttatcctgctatcaaatctactgataagtggctcatttaacttatatgcactcatcacaatgcaagaaatcctctgactgctcctaccatcatggcctctagccatgatatgacttgtctccacagtagcagaaactaatcgagtccctatattagggataagtggcatttatatatatatacaatttttatatataatttttatatgatatataaaatacaaataaattgttatacaatatttattatatacatatatatatacatatatatatatcacaatgccaaaaatgttttgtcttcgaaataatcacagtgcatttggatagacaaatgcatctacaaccaggtgacaacactgaaaataaaattgtagcagtttgaataggggattaaatgagttatttttttcctggggttcaaaaaaagaaacagcaacaaaaagtggtacttaagactgaaagttggccaggtgcagctgcttatgcctgtaatctcaacactttgggaggccaaggtgggcagacaacctgaggtcaggattttgagaccagcctggccaacatggcaaaacaaagttattactaaaaatacaaaaattagctgggcatggtggcaggtgcctgtaatcccagctactcaggaggctgaggcaggagaatcacttgaacccaggaggcagaggctgcagtgagccaagatcatgccattgtactgcagcctgggtgacaaaagcaaaactccatctcaaaaaaaaaaaaaagttctgggttatgacacagaacatatgcaacatgaatatgtcatggttatgaacatgtagactactcaagattgtgtatttttaaaataatagaatacgaggttaaaaaattagcatcacagaatgaaaaataagccacaaactagcagaagataattgtaacacataaaaacaaagacttaaatacaatggtaatataatgatagctattcttacaaagttgtttctatgtcgcaggtactattctgaacaacatacgtgcatcttgaattcgtgaagaattcctatataagaaaagcacaaacaacaacatttaaaatgagcaaaaaacccgaataggaatttcacagaagagaaaacataaatggcccataaacataataaaagatgctcaactacaattctaatcagggaaataaacattaaaaccccaaagagataccacttcatactctaggaaaaacctaaaaggctgtgaatatctagtttcattgaggaagaacaatgggaagactattcactgctggtgagggtgtagattggtacaactgctttggagaacagtttgatgccactcaatagagctgaacacacacatgcccaaagaccaagcaattccactccaggtacatactgtaaaaatactcctgcacatgtagaataggagacactgcataacaaagttaactagaacatgaggctgaggtgggaagatggcttgagaccaggagttcgaggctgcaccagtagctgggactataggcatgtgccaccgtgcctggctaattttttgctgttgtggttgttgttaaagatgaggtcttcctttattgaacaagctggtctccaactcctggcttcaagtgatcttcccacttctgcctcccaaagtgctgggattacaggtgtgagccaccatgcccggccaagttctgcttcttaacttgaggtagatactttgatgtttcattttcctttattgtacagatatactttatattctcatatgtgacacaagtcaaaatttaaaaaaacaatttaacgtttattccctttagatgaatgatgggcaaatttacataatgaattcattactgaaacaatgtatagatttcagactaggaaagtaactatttataaaagaaaagcttaaaacctgaaacagaaacaaaatcctgaaactgtaaaattgagtcaaactaaaatttaaaaaacaaagcaatgatataaagtatcatttgtccaaatgtgttctacaaaacgcttttttcttaaatatgtctgaggaaaaacaggttctaggagtaaaatatgtttgaaaaatgctgggttaaacaactgaacctatgaaggaaggaatagaacttctcaagctcttgactctggaatcttttttacacggcaattaacaccatgcttcttcttggatttgtatttcagataaacacaatctgggaaacattttataatacagagggccacaccagattgaatattgcccccaggaatgaaatgaaaacaggaatggattctccagtaagaggtacccagatatcctaatcttcagtagctgacctaaaccctggacaagtgggatcaaaccccattaccaaatacaactttttaggaactaagtggataatcactctgtgttgtatgaacatgtgggcagtgtgtttcctacacagcttaaaagtgcaacaaaaaaagatctaggtgtcatgtaaagaatttctaccactgttagggtaatggtggactgacaggcagagggtcttagatgtcacttaagtaaagttcaatagaagcttccagcacagatattcatgtttcgaattggaccgctcagttaaaaagtttttccattagacttcccctaatcaaattagaaattatctaattttctaataaagttttccccaggctcaagaaatctgtgaactggacctaagaaattcttcataatgtgcttttattaccataaaagatgcacatttattttaaaaacttctctacaccactatcataaacctttgaacacacttatttcttttggaagctaacttctgagtggtaacgaaatgtattcttaagaaaaaagtctgacacaatgcctttgtgtcttaaaatatgttaaaatattatttgaaaagagtcaaacatctgtctgttcagggtatcacagggcgtcaaactggaaaatgtggcactgccaggagtttctacctggtgaaggttggcagacttttctcttcagagggctcttgacagggtagcatccattatcttgccaatttaccaaaacctaggcccaatcctcagtcttataggttcagaattttatttttatcatcatcaatagcgtagctacattgcttagaagaaaacaaaaataaccatgtttcaatagaaatcaggatatagatgtattaatacagaatgacaaatataactgtgacagaaataggaatgcctgtttatggtcatatacggccaatactttcattacagccaaactcatacatgcagccaaataagaggcccctggatacacagggaatcagaataaaaaaagaagaactgaacatttaatagtcttctttcattcaatcaataatttttttaattaagcaactactatgtccaggtaaccttctaggtcctggggatacagaggtctctgcttacagaagtcatatgtaagtagcaggtgaagagtatgtgtttcacagaagtttattacaatatattaacaagagcaaaaaattttggaagcaatctaaatgttcaataatagagttccaattaaataacaataaatccaaataatgaaaaataatgcagccctttaagaataagcacttgcaagccgtaattcatgacatgggaaaattatcatgatggaaaaagaagcaagctatgtatagtgcacgatcctatacacacacatacatacataaatatttcctatccctttatatgcataagaaaacaagcgggaggaaagtcatatctttagtcaaatgttgtttactaacgtactattaatgattatcttttctttttctttatacctttttgcatttttcaatttcctaaaatagccttacataccttttatcaccaggagaaaaattacttctaaagtaatttcagtcaacatgcatactaagaactcttcagatttatctgttagaagctgtgcatgaatgccagtccttgcacctgtcttggaactcacagagagctcttttcccatggctttaagcaatactcaaaaagactagcatacctgaatttcctagtcctatgtttttttcatccaacagccagtcttgtatttctagctgttttctaaacatttcaaccaaaacattttacagataactcatacagtcatcctttgatatgcatggggaattggttccaggatcccccttgtataccaaaatccatggatgctcaagttactggtataaagtagtgtagtatttgcatataacctacacacatcctcctatatactttacattatctctagattacttaataacacttattacgatgtaaatgctatgtaaatagttggtacaccacgttgttttttatttgtatcattttttatcattgtattgttttttctgacaattttgttccacagttgtttgcatcagtggatgcagaacccatgaatatggagagtcaattgcatttcattatgcccaaaggtaaatgcataactttttccgcacagctaatcttctagcaaccccattgttgtccatggcaagcaggcgtagttaatctcgccctttcccgtttcaggttcattaaaaaactcttgtcaaagtctctttcatcccaccttattcttcattctcacttccatcagcatatcagtccaggccctagtaacattaatgttactaatggcattgttagtaacattacttaccagcattcaagtgggtcttcctgatgccattctctctcagcctgaaatcactgctgtttatatagaacttgtatgatgtcattcattggctcaaaaacttttaaagccttcctttttctaccaccccaatctaaatttctatgcctggcttttattaaaacccgtaatttggcaccaccctagctatttaactttattttccactattcgccagtctcctccctcatcaatgagaagacataccataatcaacctcaccactaacccttggaatatctaaagttaaaaatggtccttcctttcccctttacttgtatttaaagaacctgacgaattattcctcctctgctaaacttttcacaatttcttcaacctcatttatgtttcacattttcagaacatatcttgccatttattaggaatctcacaattaggcactctcatgtagatagatttacaatcatgtatgttgtcatcttctattaaattccatactccttgaaggcaggagccatgccttattctgtcctccagagtactcagaatgatgcagagcacacagaaagtactcaaatcttgttgactgatccagtgagaaatgaccaacttcagttccagcctctctttaacatgtacatagcaatttgggcaagtcaagctccatcctgaaggacataataggggactctttaagcacattattatgaaggcccttcagggataacaccggagtgatgaggtgccctataccagggataatggagacagagttcttgggattcatcactggggtcctcaaagcatcttccaagggcataataaggaaggactcaaacacctttgaatcttcgtgagaccaggcatgaggtcttttgaaagagttctttaactggagtgaatgtcaaagagaagtataataaaataaaagacctgagtagggtcccccttgttcataaaatgacactacctaactcaccaaatctcactgagccttggtttaactcaagaggttccatgccactataagaggtggtaactgccaactgataggaaatattttcatatgcatagtcatagtgccccatatttatgaacttcttaagagtcttcaaaaagctttctatatacattatcctttactttctaacttttctaaatacaaggtgagagagacacaagtgttctatcaaaacagaatctttgccgggcacagtgactcacacctgtaattccagcactttgggaggcagaagcgggtggctcacttgaggtcaggagttcgagaccaacatggccaacatggcaaaactccatctctactaaaaatacaaaaaattagccaggtatggtggcaggtgcctgtaattccagctactcgggaggctgaggtaggagaattgcttgaacccaggaggcagaggttgcagtgaacagagatcacaccactgcactccagtctgggcaacaagagcaaaacttcacctcaaaataaaaaaataaaaataaagactttggcaaggaccatgtcccacccagaatggtgcctgcctttttacagtttttcaggaagaggaaacattttctgcttctcttgctgaggttttttttaaccacccattaggaacgtatagatttcaggatcgaacactgggattccctcagcactaaaggagtaaaattgcaaacagagctgaaagtgcaatgtggaaaggtcaggctgaggaaggttcttagccagtagaccaagggcagaaaggacactgcctcctcagtctcccactagggaacttgtgattctcgtcccctgacctcagaattccttgtcatgtttgttttgtctccaagggaaggttttgaattacagaatttaaggctagagtgggcctcctgcagttaacattaaccctctctctccttcactggccgaggtgaagtccgggaccatgtagttctgacgtccactctctcgggggatcaccagttcacccacctcacctggcaagctgggccctagtttggcaacaggcatcttccacccacctgggaggcagggttcaacactctgcctctgaccttttttccttcctctgccacctgcttaggcagccagaaggggttgtccagccagcacctgggctttggtgctcctcaagcaggtggaggaagtttcaggcacctggctcctcaggtgtctgccatccagctgctcttcaggcctgcccagcagagctctcttgatccagctagaactggccagaactgactcactcaggaatgtgtagactttggcatcaggggcagctttaatttgcacaatttccaaataccacttttttcttctttttctgatgagtcatctccctagacttgcattttaaagagatagatagttatcaggttccagagaagacatggtagaacatttatatctcaaagacacagagctgagacttcaggtttagatacaataatttacctaaaccaaaaaggaaggtgtaggtaaagttctagtcgagacaggatggccaggaaaaacaccttaaaccaagggatggcttgctttgctgatttaagccaatggcttctttatcataagacttcccagtgatttagtcctccctctcttccagtgcacagacgcatgaccctccttacaaataaaaatgttctttatagatgtaaatttattttacaaaaatgtttcaaaataactagatgaaaatcatccttatgccagaaagacttgttttttttttttcattactagaaatgaaacagtaagtatttgttgtattgacatactaaggctaagacctatgtttaacaagaaagcctaataatagcactgtggttagactgtagcctatttttccaaaccatcattttattattaaggaaagaaaggatcaaatacctttcattcatctgatatgatcctttaaaacacattccactaataagtcccatttggaacagctgaaaatcttttaataaaactttttaaagatgagctcatggcttagtgtaaatttcacaagcttaattaggtcaaatggaaggaactcagatgagtagttgcccaatcagagcccattatttgtaaatcatcagcccccttcatgaccttaaaaactccactctgacctaattattgcaaacctatatacaacaaagtgaaaggattaattttcattcatcaacctctcaatcccagattttcaaagaaaaaacctatgtaaggaatacttaccaaaaccagacaggaaaattagagccttcatacttaagagtcaaatttgtttcactacagccaggtcacatacaattacatcatttggttcttcatacactctggaactgaccaggacagagtttagcatagaaaaactgtaagaaataggttccaagacatagaaattgcaaagtccaaaatgctatgaaaaaaactaatgtaaatgagagactcccctccctttgttttaaagaaatagacccatcagggaaatgcaaatcaaaaccacaatgagataccatctcacaccagttagaatggtgatcattaaaaagtcaggaaacaacagatgctggagaggatgtggagaaataggaacactttcacactgctggtgggactgtaaactagttcaaccattgtggaagtcagtgtggccattcctcagggatctagaactagaaataccatttgacccagccatcccactactgggtatatacccaaaggattaaaaatcatgctgctataaagacacatgcacacgtatgtttattgcagcactattcacaatagcaaagacttggaaccaacccaaatgtccaaaaatgatagactggattaagaaaatgtggcacatatacaccatggaatactatgcatccataaaaaatgatgagttcatgtcctttgtagggacatggatgaagctggaaaccatcattctcagcaaactatcgcaaggacaaaaaaccaaacaccacatgttctcactcataggtgggaattgaacaatgagaacacttggacacaggaaggggaacatcacacaccagggcctgttgtggggtggggggagggatagcattaggagatatgcctaatataaatgatgagttaatgggtgcagcacaccaacatggcacatgtatacatatgcaacaaacctgcacattgtgcatgtgtaccctagaatttaaagtataaaaaaaatagaaaaataaaaaaagaaagaaatagatgttctgaaaaaatatacacaatttttacagacaaatacatttataagttgtttttatcttaaaaattggggatatttcatatttataactaattattgagccttaagttttcttggccatttctaggctaataaactaagaatcatgtaaactaagccaaaatagaatagacataaaagtcctgaacacttcaacttcctatccttcacgaagtatacctcgcaaagctcatttgagagaggaaaagctttcctccaccctctgttttacagcgctgaggcttctcatcacatttctatgacttgtagcttaaatccatgttacatggtcactggcattgttaggacttctcttttaacactgtaggaattaatcaatttggtggcatatttaattaattctatcactagaggattgtaaaattacatatatgaatacctcactttagaggccacttaatttttttccaaggggatatttgactatatttcacttgtgtcttatttaatgattttataatttaaaccctaaattataagtctagaatttagaaagtatatttccccactggattacatttttggaaatattattttatatgtgcacaaatattacaaaatcactgtagacacctgcaaactatattatctttcaaaggcaatatttatattaaactggtataacaaaattgtttggtgcattttttccagtacattttgtgtatattacatgtttaacctttttttatccagcaaataatttttgagtatctactaagtgctaggttctgcattactaactgaatttaaagagtgaaataacagacatggtctcagacaataaaattaacattaggtcacctatttatatattttaaaatggtaattatgaaaactttctgagatttttaactagataacattataataacacacttgacgttgttaatatttgccagtgagcaaaaaagaaaataaaaagatggttttattcaatatacactttaaaattgcagaaaatagtcaagtttctctgctttgcagttgaatgtctatgtgtttttctctgcaacttggcttttgtggagtgaaacaattattcttccagcccaatgaaggcagaagagtaacaataaatctaatattttaaatgcttatcaaaagaaagtaaacacattatttcagaatactgagttcaataagttgacctacaaaaaaagtcaaactgacagtattactgaataaggaaaggcccaaagagacaaaatactttttaatttgtaacctcagtatgacacaacttaccctaactataaagaccctaaattaccaagatgggtgcttataatatggagagtaaaaaaagtcatttcacttttagcttttttatttctctcagaataaaaagtgtataaggagttgataaagaagttgatactataagttggtactacaatgacagcactttccaagaaaagacttttttctctcttacaaatatcatgttagcagtatttgttttctccagaaataatgaggaaataaaaacataagtatgtgggtaattactgtagtttcttaaagaaatgagttaggcaacaggctaataatgtatacttcgctggcttttgaatgccaacaatcatattctttataaggcacagagaagatttttctgaagaataagtatgtgaacctgaaaagtaatcaccacttggtagtgacaatatggatagggtgaagggcgtcaccaagaagcaatgaaaagatacatttgcagttaaatttgaaaaccatgatgtttaatacatatagtaataaagaatactttctcctatttcaaaattattttagaatttaagatagaagctaaaatacctagggataatgatatgactatcaaaaattaaaaattaaaggacattttgagtattataagttaagaatgagaacttattacccaatgaacaggggataaatcattatgctccctatccattgaattaaaagacaggcccattacctggataatttgaaagtttaattttatttaaaagtcttgtttcattcatcaagctaaaggattagctcccagaaatattctaggattgcatatccccaactctgtaggaagtatagaaagaatattataagggccaccatctaaatattattatgtaaataatttagtaccattccatttgcttttgtagatttaaaaatgtaaatggctttctcatattaggaaacatcatttttcaaaacccagataaacatagtatattgcaagagagtaattattttctttattaaaaaagaaatactggatgctaagtccaaaagacataaattattttatactaataactactaaaattttattcattaaaataaaaaatcaaagattttaaaatgatcttcaaatgattaataacatgttgaactttttcttctttctgtaaacctttttgagtcttaaaaatactaaactatacaagcaatattaaatagtatataaacttggattaaaatattcaaatttactagaatgtggacattggaaagaatgaaaataaacagaagcataaagcagcagatataaaattaagaaagcaactaagagtgcttaaagtacatattcatctgtagtctaatttctaccataaacaatgactcttctcagtaaaacacaaattgttcatgaagggaaaaagcatgttgtattagagaatattcaacataacttttttagtactaacttgtgcctgaagtattattggtttttctattatgaacttatgcacttgataatttttttcataaagactgtatgtacaactccattcaaaagcagttgttggtgggtttttttttttttttgagacagagttttgctcttttcacccaggctggagtgcaatggtgcgaacttggctcatagcaacctagcaacatttgcctcccaggttcaggtgattctcttgcctcagcctcccgagtggttaggactacaagcatgtaccaccatgcctggctaattttgtgtttttagtagagacatggtttttccatgttgactagactggtcttgaactactgacctgaggtaacccgcccaccttggcctcccaaagtgctgggtatgtgcaagagccaccatacccggcctcaaaagcagtttttaaaagcaaacacaatataacaccaaagttgaaaaattcatgctcacccaaggatgccaggtttaataaattatttatagaatactgcatcaaaaataagacaataacccaaaatataccattaaagatgtatccactcctacaactagagataattaatctatctggtagcaaatgatacttcagtcagtttcagcatgtctgaaatctttaaggacaaaagtgataaaacatgacttcattcttcattagactcttagaacacttgaaggaaaatgatttctgaagcacaaagaggtaaagaagtgtaatctttcaaaaagatattcagtgttcaaaatccaagagtgcaatatcaggcagggtgcggtggcttatgcctgtaatcacagcactttgggaggccatggtgggtggatcacctgaggtcaggagttcaataccagcctggacaacagggtgaaactctgactgtactaaaaatacaaaagttagccaagcatggtggtgtgcacccgtagtcctagctacctggggggctgagacaggagaatcgcttgaacctgggagctggaggttgcagtgaacccagatcatgccaccccactccagcatcagtaacagaatgagattccatctcaaaaaaataaaataaagagtgtaatatcatatcggtatacatagataatatactgaatgaaacaaatagaataatttgaagaggtatcttgacgaacaaggagtcattagaaaggttgtattcatgtctctgaaggaaattgcagtgtgagaaattaatactttgactactatactaaaagtttattgctaacatgtattgagttattaacatgtgttaggcagagtaccatataatttacaagtgttatcttatttattgtaggtaaaatgtaattttgaactctgggagtataaatgaattagatagaataaaattctatttaaatggccatcagtaaatcggtatctaggaacagggtgatacagtgcccaagttttctattcttactaaatgttgtgtttcattttcaatgttttcttggatattgctcttttttggtgactgatttttttttattttagaaaactaataaactgactcttcttggtactgactcttgggttttatagaagaaaaagtaatcaaattctgtacatttacctttacctcattttttctcttttaaatttaattgacatataataaatgtacatgttatgggatacagagtgatattttgatatatttatgcaatgcgtaaagttcaagtcagagtcattatcatatccattacctaaatcatgtattatttatttgcagtgagaatattcaaaatcttttatttatttgaaaacacacaataaattcccgttaactacagtcacccaacagtgctgtagagaactagaacttcttccttctctccagctgtaatttcgtatgtattaaccacatttttcttatactcttctttctcctactctttccaggatatggtaaccaaaactctactatctacttctacgagattaaaaattttagcttccatacataagtgagaacacgtagttatgtggtgtttatgtttctatgcaaggcttatttcacctaacataatgccctccacttgcattcttgttgccacaaataacaggattttgttctttattatgactaaataatattccattatatatgtatgtcatatttctttatccattcatctgttgatggacacttttgttgattccatatcttggctattgtgaatagtgttgtaataaacatgcgggtgcaggtaactctttgatatactgattttctttcctttgaatatatactgaaaaccatatgattaaattaataaacacaataaaagcgtttggcaaaattaaatattcttacatgacacaaaacctctcgacaatttagtatagaaaatatatgccttaacacagaaggacataaaggacaaatctacagctaagatcatactgagtgtggaaaaggtgaaagattttactgtgaacaagaaaaagattttactggagcaagaaaaagatgcctattttcaccaatcatatttcacatagtgaaagtcttagccaggacaattaggtgagagaaagaaataaaggacatctgaattggaaacgagacagtcaaattgtccctgtttaaagacaatgtgatcttatacacgaaaaaaaaaaaaaataagacgctaccaaaagcttcctagggtgatacataaaattaataaagttgcaggatataaatcaacatacaaaaatcagtagcatttctatatattgatagtaaactagctgaaacaagaaattaagaaagcaattccttttacaatagctacaaaaatgtacttagagataagtttaaccaaggaagtaaaagatttctacaacaaaaatgacaaatattaatgaaaggaatgaaggaaaacacaaaaaaggaaagacatccacgtttatagattgaaataactaatattcttaaaatgacccactatcccatgtgatttacaaatttagtacaatcactagcttgtatttttaaaagcacctttgctgcatattcttaagatattcagtgacaatgcctggattaagtttgaggtattattatatctattttatattgggcacaatataatattatcagaggtaatggttttgattggtcctaggtcatacagtaatatatacattgtgatttatagacatgctatcttttaatactcaggcatttagaaagttcatttagacaaagttataaaaacttgccttcctttctgcctatatcacctaaaaatcctaatttaagaggtaataacattttttatttgatatacaatttatcaacaaaataaaaatctaacaattatcatgtgcagagtgtgaaaatctcatcagattaaggaacacaaagacatctttttcatatttcgaatgtaaaactcttttggaaactgttatttttagaaacagttaaaaacattttttcattagtttttcatgtaaaattgtgacaaccagcatgaaataactgtcatcacagaagcatggtatattcaattccaaaacatattcttagtaagttttaatatatttatgtattatttatgcttagattgtaacccataatgtagatattatttttccttcaactcttaagaatattcttaaataataaaattaaaatgaattataatttttgttggttgggaaaaagaatagacacacacgtgacagtgcatcacttcacctcatcatttcatctcatttcatcatttcatctcatttcatctcattttatctcatctcatcatatcatctcatcatttcatctcatcatttcatcaaatctcatctcatttccattatttcatttcatcatttcatttcactatttcatttcatttcatctaatttcatttatttcattatgtcacttcatatcatctcatttcatttcatctcatcatttttcataccattattcatctcatcatttcatctcctcatctcatttcctcctttcaacatttcatctcatcatttcttctcatctcatttcaatttcatttcattatttcatttcatctcatttcattatttcacctaatttcattatttcatctcatctcatctcaattcatctcatctcatctcatcgtttcatatcatcatttttcatctcatcatttttcatctcatcatttaatctcatttcattttgtctcatcatttcagctcatcatttcatctcaccacatctcttcatttcatcatttcatttcaacatttcatcatttcatctcatcatttcatctcatctcatcttccaatttcatttcaatatcatttcatttcatcatttcatctcatttcattatttcattatttcatctcacttcatctcatcatttcatctcatcatttttcatctcgtcatttcatctcatcatctcatgttatcatttcatctcatttcttctcatcatttcatctcatcattttatttcatctcacctcatttcagtttcattatttcatttcctttcactttatttcatttcatctcatctcatcatttcatctcatcttacctcatttcatctcatcatttcttcttatctcatctcatcatttcatcatttcatctcatttcatctcatctcacctcatcgcatcatttcatctcatcctttcatttcatctcatcatttcatctcctttcatctcatctcacctcagcatttcatcatttcatctcatcatttcttatttcatctcattttatctcatcatttcatctcatctcatctcaattcaatttcctttcattatttcatttcatctcattcatttcatctcatttcattacatctcatttcctctcatcattacatctcatctcatctcatcatttcatctcatcattgcatctcatcatttcatctcatttcatctcatcattcatctcatttcatctcatttccatttcatttccatttcatcatttcatcatttaatttcatcatctcatttaatttcacctcatttcattttttcttttcattatgtcatttcatttcatctcattacatggcatctaatttcatttcatctcatttcatctcatcttttcatctcatcatttcatatcatctcatcaactcatttcatcttatctcatcatttcatcatttcatctcatcatttcatctcgtatcttctcatctcatttcaatttcatttcattacttcatttcattatttcatgtcatgtcatctcatcatttcatctcatcacatctcatcatttcatcattttatttcatcatttcatctcatctcaattttatttcaatttcatttcatttcattatttcatttcatttcatctcatgagttcattatttcattgcatttcatttcatctcatcatttcatctcatcattcatctcatcatttcatatcatcatttattctcaccatttcatttcatctcatctcatcatttcatctcatttcatctcatctcatttcatcattacatcttatttcatctcattttatgtcatttcatgtcatcatttcatcacatctcgtctcatctcatcttttcatctcatcatttcatctcatcatttcaactcattgcatctcatctcatcatttccatttcattattccatttcatcatttcatttcattatgtcatttcatctcatcacatttcatctcatctcatttcatctcatctcatcatttcatctcatttcatctcattatttcatctgatttcatgtcatcatatcatgtcatcaattcatctcatttcatcacatctcatcatttcatctcatcatttaatctcatttcatctcatctcatcatttcatctcatcatttcatctcatctcatcattgccatttcattatttcatcatttcattatttcatttcatctcatttcattattgcatttcattatgtcatttcatttcatctcatttcattacatctcatttcatctcatttcatttcatctcatcatttcatctcatttcatctcatctcatctcatttcatctcatcatttcatctcatttcatctcatctcatttcatcatttcatctcatcattccatctcatctcatttcaatttcatcattacatttcataatttcctttcattatttcatttcatttcatctcatttcattatttcatctcatttttcatctcatcatttttcatctcatttcatctcatcatttcatcttatcatctcatctcatttcatcatttcatcgtattgttcatctcatttcatctcatcattttatctcattatatcatctcatctcatctcaatttcattatttcatatcatttcatttcattatttcatttcatctcatcatttcttctcatcatttcatctcatcattttatccatcatctcatctcatctcatctcctttcaatttcttttcaattttgtcattttgtctcatcatttcatctcatcatttctactcaccatttcatctcatcatttcatcccatcatttcatcatttcatctcatctcaagtcatcttatcatttcatctaagtgaaatgatgtaatggaatcatgaaatgaaatggataggatgccctcagtgatgttaaatttaaaaattgttttcatgtattcatttttatatttatatgtatttatatttctatttacttatatttctttttacttattttaaattatatttttacttatttatttatagacaaggtcctgttctgtggcctaggcaggaatgcagtggtgcattcaaagttcactgcaacctcgagcaaacctcccaccttagcctcccaggtagctgggaccccaggtgcgtaccaccacacctggttaatattttattatttgtagagatggagtcttgctatgctgcccaggctggtctcaaactcctgggctcaagcaatcctcctgccttggcaacccaaaatgctgggattacagatatgagccacagtgccaaacctatttatttgtttatttatttaataaagaaaaggtctcactatgttgcccaggctggtcaactcctgcactcaaatgattcttcaaacttggcctctcaaaatgttgggattacaggtataagccaccatgcctggcctaaaaatagtattatatttttgcattatataattttcaattaggtaatatgaatattctgtacaggaaatatgcccttaattacataggaataaacatttgttatactgagaataatctaatagagctaaaaataaaaattaatttggagaggtcattagatacacatacattcttatgtttatacattctttcatatattcatatattcttttaacagtatcaatggtttggagttacgtgtacaaaaccatgacctatatgtaatacaactaataacaagcacttacaattcaaggcatattatatacaaagttttaacttctcatcatcagatttcgttttttttctttctgttttggcagatactatgaacacaacattcaactcacagacactatggagcccttactaagcataaagtactgtgaaaggctagggctaggacagaactgagacagggccagggataggacagaactggggcagggtcatggccagagaaaaaccaggggcagggtcacagccagggacatgagaggaccaaggccagggccagatgtagggcagaaccagggccagggcagggacatggcagggccagggccatggcaggatcagggccatcagaaggccagggcagggctagggtagcacagggccaaggcagggcagggtcagtgtagagcaaggaacgggccagggtatggcagggcagggacagggaggtccagggccagagtcaggtccaggacatggacagggcagggccagaaatatggcaggaccagaaaggggacagggaaggggcaaggccaaggccagagaaggaccacggtaaaaacatggccagggagggtccaggacaagggcaaggccagggcagaaccagagccagggcaggcaaaggcagggccagggcagggcagggccagggcaggtcaacgccagggtagggtagggccagtgtagggtgagggtagggccagggcaagttcagggccagggcaggactaagatagcacagggccaaggccaaggccctgtactaagatagcacagggccagggcagggccaaaggaggggccagggccaagcatggccagtgtggggcctggggattgtcagggccagggccagggtgaaggctgagccagagacagggccagagcaatggcagggccagggagaaggcagaaccagagaggatccagagaaacagcagggccagggcagaacaaggaccaggataaggcaaagccaaggccagggcagggcaacgacagggcagggcaagaccagggaagggcaaggccagggtagaaaaggccagtgtacagccaggccagggtaggaaaaggccatggtagggccaaggccaaggtggggcagggctagggtagcacagggcatggccaaaaacagggcagggccatagcagtggcaggactagcaacagggccagggtaagtgctggaccagagcatggtggggacaatacagggccaggacagatgatggcaaggcaggtccaaggtcatttcatggactcggtaggcctggggtcaggccagggcagggaaagggcaaggccagggagaaggctgggccggggccaaggcactgccaggacagggcaggaccagtgcagggtgagggcaaggccagggcatggatgggcagggcaggaccaacgaagggccaggagagggccacggcagggtcaaggccagaacaagggtatggctggggtcaggaatatggtagggcaagggctgggcccagactgggacacacagggcagagcatggcctgtacaaggcagggccagagccaggccatagagatgggagggcaacaccaaggcagagtcagggtagatccagggctgagcagagtcagggcgggtccatagtcgaggcagagctagggcccaagcagggccatggcagcaccagggcagaggagggcagggcaatgcaggactgggccatggcagtgcctggtcaacttcggggcagggccagaagcaggacagggccagggccaatgctcaggccagggacagggcatgacagcaagtgccagagcagggctgggccaaagttggggcagggcaaatcagaccaggacacctccaagtccagctctggccctgccttggccctggccccttcctgacctgaccttgtccctggccctgtcctatccatgccctgtgtgtttgaccagtgttttataaccagaatcctacaagaaacttaaatcagctctttttgtgcatttttagtagagatggggtttcacaatgttgcccaggctggttccaaactcctgagctcaagccatctgcctgccttggcctcccaaagtgctgggattacaggagtaatctggccaagtatttaacttctttatgcctgtttcctacatttggaaaatggggatgctttaagtacctagcacatagaattattgtgagaatcaatgcctcacatatttacatattgataaaattatactcatagaacagtactggaagcagagatagtattagttaaaatttagtgattatttactgtaaatattattactattacaaacaacatagtatagacattattaccactactatagttatcttaaaaatctaaaataaaaattttacataatagcctaatgtaatctcccctgctctgccccggctcagccctagtgccggctctgcccctagtcctaccacatccctggccctgacccttccctggtcctgccgctgccctggcccttcccatcttcaggccttaccatggccctaccctggtcctgaccctggccctaccccagagaaggggtatggcagagccagggaagggctggggcaaataagggacaggacacatccaaatccaggaaagggccagggccatgacagagccagggcgagtccttggcagggccaggttccaggccagggccaggaaagggtcatggcagggtcactgtatggccaaggtccaggccaaagccaaggcaggggcagggtcaggcctgcataagggcaggaccagagccagtgatacggcagggccagggccagggagggccagggctgtgtcaggacagaacaagagcagagcagggcaggaccagagccaggccatagagagagtagggcaaatgccaaggcaaggccagggtagtgccagggctgaggcaaggtcagggaaggtccagggctgagtcaaggctggaacaaagacaggggcaaaggccggggcagatctagggcacaagcagggcaggctagggcagggcaatggcaagaccaggccatggcagggccagcccaggatagaacagggcacaggcaggacagggccagggccatggctggggcaggacaaggaccaggaccagggtccaggccagggcaagggtatcaccagggcagaagtagggccagaaccagggtctgggcaggaccaaggagagtccattgcagggccagggttcagaccagggccagagcagggctgggacagggccagggccaggaccaggaaagggcaatgtcaggataagagccatggcaggaccagcaaccaggctagggccaggacagggacagggacagggtcagggctagggccagaatagcatgccagggtagagccaggccaaattagggccaggacagggtcaggaccagggctgggccagggtatggccttaagtagtgaagggccagggccagggtccatgccagtgccagcgctggtccagggcagaggcagggccatggccaggtcaaggacaaggctggcagggccaaggtctgggtcagggtcagcacaagaccaggacagagccaggggagggacagggccatggtagggccaggttaaatcagggacaagacacctgcaaatccacttcagggccagggtcagggcagggccagttcagggccagggccaagacagggccagggccagggctgtcagggtcattggcaggcccagggccatggcaggaccagggtcaggagcaagggtcaatgccaggccaacgccacagatacgaccaggtctgtgctagggccagtgtgagggccaaggtggggtcagggcagggccaaagggagggcaaggcaagggcagggtggaacaggcccagagtagcacatggttaagatagggcacgaccaaccagggcaggtctatggctggggccggggcatggaaagggccggggcagggccagagccagggcagggcaaagacagtggcagctccagggcaggcccagggttaggaccacggacatgtccaaggccagtgccagggcaaggacaagggcaggggcagggccagggtcatctaagaaccagggacaaagccaggcccagagcagggccaggacaggtacctggaagggctagggtctgggacagggccatggcagggccagggccacaaccaggtctgtgctatggccaggtccaacacagtgcccaggtaaggctagggtgaaggccaaggtagggccagggcggggtcaaagccaggcgagggccaaggcaggaccagggctggaaaggcagggacaggaaagcatagggccaaggcagggcagggccaggccagtgccaagacctgggcagggccagggaacagccagggcagggccagggccagggccagggccagggccagggcctgggcaggaccaggtttggggcaggagcaaaacaagggcaaggacagtgcaggatcttggcacagccagggcccaggacagtgtcagggcagggccaaggcagggtcagggccatggtaagaccagcaacagggctggggctaggccagtgacaggaccagagtcagggcaagggccagagcagtgcaaggccagggtagggccaggcatttcagggtcagggccaggggagaaccagggcaaggtctcaagcagggaagggccagggccagaacaggtccagggcagggccatgacagggccaggggctgtgttagggcaaaggcagggccagagcaaggtaagggtcagggccaaggccagggtagggacagggcaagaaatatggcatgaccaggggcaattccaaggccaaggctgggccagggctgagtcagggcagggcagggcagggcatggcatggccagtgcaggacaggacaagagccggtccacagagagagcagggctgatgccaagaaagagccaggctagtgccaaggctgaggcagtgtcagagcatgtctggggcagggccggggccagggccagaactgagccagggcacagccaaggcagggtagggcagggaaacagcatggccgggtcagtactgggacagggcagagcagggcaaggcaatggtaggggcagggcagggacaggccaatgcagagccacgttatgccggggccaggacacctccaagtccacttcagggccagggctatggcaggaccaagaccagggccagggtcagggccaggtctgtgctagggccagctccagagcagggcctagcaaagactagggtgagggtcaaggtaaggccagggcagggtcaaaggcagagtagggccagggcagggtgatgacacatccagagcacagcagggcagggtgatggcaagaccaggggcagaccactgccagctcagggccagggaaaggccagtgcagagccaggaaagggtcagggccaggaacaaggcagagcagggccagggccatggcagagtcagggcaagtccttgacaggaccaggttccaggccagggccagggcagcagcaggggcagggcctggataagggcagggccagggatatggcaggaccagggctagggccagggccaggccatagtgagggcagggcaaaagtcgaggcagggtctgggcaggtccagggagcggccagcaccaagcagggccaaggcacaaccagcacagcgtaaggcagggcaatggcaccactgggccatgacagggaaggtcagtgccaggagagggcagaacaggcaggcccatggtggggccagggcagggatgggccaaagcaggaccaggacatgtccaaggccaggtcagggccagaacaggattaggaccatgaccactggcagggccagtgccatgacatgaccagggtcaggacaaggggcagggccagagccagggccagagccaaggtcaggccagtgcaggttcagggcagggccagtgccagggcaagaccagggcagggacagggtagcacagggccaagacagggtcaggatgggaccagagctggacagggccgagacagtccaggtaacagtagggcaggtacagggcaaggcagggcaaaaccaggcccattgccaatgcaccagccctccctacaaggctcctacaacctggccactgctgcagcccgtccatcgctgtaagcctgaccccaaccctggctgcagccgcctgccctcctagcgcggccgctctcctaccgctctggcgcactgcagtctccattgctgccacccacccgcagcgaggcaagtcatggtgtcacaggctctaggtgtctccttctcctcctggcacggagcagctgggcgggcaaagccagaaaagcctagaggaagatgtaaggggtggaagggttagagcctcaacttgtcgtgctggccactgggtggcaggggccagtttcagcaaaggccctcacacccaccctccaaagtccagcctctccttttggcccaagctggctgggaactggggtctggggtgggtgctggagacaccacagcacccagctccccactccacaggaaccattgggcccaccagggctgcactccttggggaacaggagaagcagaaaaattcagacccagccagccctctgcacccaggtgccaattcctgttccggacgcctccacacacagggccctgtcccccgtggtgtccccaggggtgcctggcagcctctgaggcacagacccagagtgcacaggcctaggaaccacggtaggtgtgggggctctgccatgctcaggattcccacacaaacgctgcgtgcctgccgcactccagtaggaccaagagtgggtcgccctctggagtgtggagtcagggagaggagaaccactccttccttggatgccaactctgctgaccgccgccagcagtgcagcccctgatagcaccgaacttgcccgccctccacagctagtcctgccctcaatagcgccccccacctccatcccccaatgcctccagtagcgtatacccgatagtgccctaacctgtcctcctccatgggcattgcagccccagaaagtgcccataacccaccctccctgccatgggcagtgcagccctgtacagtgctaccaaccagtagccctaatgcaggcaatgacaacctggatagcgcccccaacccaccccacactgtgaaaggtgcagccctggataccccctgtcataccactctggtcgtgctgcagtctctgtcaccaccaccaccaatcacagtgaggcaagccagtgggccacaggctctagcacccagcagccaggcacggagcagctctcgccgatggctggctcctaccactctgaccacgctgctgtctctgtggccatcttctttgactacaaaagaataaaactaggtatcaataagaagagtaattttggaaacaatacaatcacatggaagttaaacactaccctcctgaataaatgactagcgggtaaatgaagatactaagacagaaattcaaaaatttcatgaaacaaagggtaacgaaaacacagtataccaaaacttgttacgcagaaagcagtacagaggcagagatttacagctataagtgcctaccatccaaacaaaagaaaaacttcaaataaacaatacatcttaaagaactagtaaagtaagaacaaactaaaccgaaaataagaaaataaacaagatcgtagcagaaataaaattgaaagaaaaaacacacaagattaaatgaaaagttggttttctggaaagcaaaacaaaattgacaaacttttaaccaggctaactaagaaaaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttgaacaatgaaaacatccaagaccagaacagatcggtaaaaagtaatgagattgaagccatcagaaaaagtctcccagtaaagaaaagcccaggaactgatgtcttcactgctgatggcttcacaccaaacaatttaaagacctagtacaaatcctactcaaactattttgaaaaacaggaggggatacttccaaacttattctatgagaccattattactgtgataccaaaatcagacaaaggcatcaaagaaggaaactacaggccagtatctctaatattgatgcaaaaatcctcaacaaaatacaagtgaatcaaattcagtaatacattaaaaagataattcatcatgatcaagtgggatgtatccctgggatgcaagggtcactcaacatacaatgtgatacatcatataaaccgaataaatgtcaactgaaactgaaaaagcatttgatgaaattcaacatcccttcatgctattaatcctcaaagaaacgggtacagaagaaacatactgcaacatagtaaaaactacaggaaagacacccacagctagaatcatatggagagaggtccaggctgcagtgagctgtgatcccaccactgcactccagcctgggcaacagaatgaaaccctgtctcaaaaaaaaaaaaaaaaacaaaaaacgtaaaaagaggtatgagcctcttttataggtacagtgactcacatctgtaatcccaacactttctgggaggctgaggtgagaggatctcttgaggccaggagttcaagatcagcctgggcaatataacaagaccctttatctacaaaaaatttttaaatatttgccaggtgtggcggcacgtgcctgtagtcttaaacaattatatgacccagatagtgtattccttagggatatacccaagggaaatgaaaatatacatccacactaaaatttgtacacaaatgttcacagcagcattgtgcataatagccaaaaattggaaaaaaaactcaagtgcctatcaacagaggaactgataaaatatggtatatccattcaaaagattactcagcattaaaaaagaatgaagtgctgatatatgctacagcatggataaaccttgaaaacactgtgccaagtgaagtaagtcaatcacaaaagaccacatgtagtaagatttcattctgtgaagcctccagaagagctaaactcagagacagaaagtaggctagttattgccagggactaggggaaaagggaataaggatgactgctaatgggtatgggatttcttgtggactgatgaaaatggtctgaaagtatctagatacctgtcttgtttgtgcgattctgtgaacatattataaaccacaaaattctgcactcaaggggttgatttcatggtaggtgaatttatctcatttatctttatctcaataaagctttttaaagacacttaaaaaagacatctgtataagctacaaatataacacactgagagactaaaatgcttaatttttccatttttcttcttcagcgcaatctcaagtccaaaagtctttccttcctatatatgcatattttgtccagtgaaacaagaaactctattaacttttttattagaaatttaaaaaagccaggtgtgctggctcacagctgtgcttccagctactcagaaggctgagacagaaggatcacttgaggccaagactgggagttcaagaccagctgaggcaacatagctagatcctgtctttaaaaatatttttcaggccaggcatggtggctcatgcctgtaatcccagcactttgggaggccaaggagggcagatcatttgagatcaggagttcaaaaccagcctggacaacatggtgaaaccccatctctactaaaaatataaaaattagccaggtgtggtggtgggcacctgtagtcccagctacttgggaggctaaggcaggagaattgcttgagccgggagggtggaggctgcagtgaggccaagatcatgccattgcactccagcctgggtgacagagcaagactccgtctcaggaaaaaaaaaaaaaaaaaaaaaaaaaaaatatatatatatatatatatatatatatatatatgtaaatatttttaagttaaaaccctactgaaatgaaactaataaaataaaattcaagttaattaaaaaatagttcctgaaatattaattttcaaacaattctattttagctttgactctgaacaaaatataaacctcaatttcaaaatatcacaaagattggctgggggcagtggctcatgcctgtaagtccagcactttgggaggatgaggcaggtggatcactagaggccaggagttccagagcagcctggccaacatagggaaacccagtctctactaaaaaaatacaacaaaaattagctgggtctattaaccccagctactcaggaggctgaggcattagaatcgctggaatctgggaggtggaggttgcagtgagcggagatcatgccacagcactccaacctgggcgacagactgagactctgtctcaaaaaaataaaaataaggccaggtgccgtggctcacacctgtaatcccagcactttgggaggccaaggtgggcagatcgcttgaggtcaaggagtttgggaccagcctgggcaacacagtgaaacctcctctctactaaaaatacataaattagctgcgcatggtggcacacacttgtaatgccagctacaccagaggctgaggcaggggaatcgcttgaattcgggaggtggaggttgtagtgacctgagattgtgctactgcactccagcctggacgacagagtgagactccatctcaaaaaaaaaacaaaaaaaaagaaaatttaaatttaaaatttaaaaaaatcacaaagactacaaatactcaggtttaagcaaattcccacctttcttgaattaacagtaattcatatttgctttgtcaaaaatgtagatatttacctgccccaacggaatgaaatcctaaaagcctagtgttctcaaatgatgaagagaaagaaacatgaatattttaattaataattttgattcagaattaattttaacctagctggagtatacataatcatttatgtatttacttatttaagagactgggtttctctgtgttatccaggctggaatgcagtggcacaaccttggctcactgcaacttgtacttcctgagctcaagtgatcctcccacctcagcctccagagtagctgagactgcaagtgcatgctaccacacccagctaatttttgcggagacgagcctcactatgtttcccacactggcctttaattccttggctcactacagcctcaagcccctgggatcaagcaatctgcctcccaaagtgctgagattacaggagtgagccaccgcaccccgcctattggatagtatatactaagcaacatgtaccctgcttttgcctagaacatactgaaaacatggcattaaaaacaatcacaaaagttgggagctgagaaaaatcatatactgtaaaacaaatctgacagatattaatctcaagaagctcctgaaaatgtctcaagaactcctatgctgcactctccctaataatttagactttctacagatattttctgatcatctaccgtgtgccaggcaccatgccacgtaccaagatgccatggtgaggtatacacaaaaccggctcctgcttgtaggaagcctactctctaaaacagtgcttgccaagctcgactgatccaacttgggagcttgtttaagttccaaatcggcttccctgctttggtgagccacaatccgtggcatttttatcaggtgctcccagtgattcctacgctctaacgggtttgggaggcaagggtgggggtaagctggagagcccagagccatcccgtccagcgggagccccacctctaaagtccatgtcgctcagcatccttccccctgactagtggcccaaacacagcacgaagctgaggtgggtggaacgctttccaaaacagcgctctatgatgagccactgacagacttgctcgcctccgggaacgaagagctcactcctcacaaaccccccccccccccccccccccccgggaaaggtagcacctgagcctcccgggctgcgccgacacctggacacctgtctccccgcgggtgccacctactgctccaggggactccagtccccaggttccgccccacggggactggggggaggggggaggcgccccgcgcattaggcgccaactgtataccgacccccccctccggagtgcgcaggccagcacccatacacaccctcacacacccacacacactcccgtggaaactgaggcaggcaggcggcggaccaggtcccgccgcctgacggctcgcggctgggattgaagccggaccttccgcctcacaggcgctcctcagccgctgaggcccggcccagctcccaccgccggagtctcacaaacaaagtctcctggcccgagcccctcacgcactcacctgcgccgacgccggcggcgattcgggctccagccgccttcagctccttgcgggggcccttgggtcggctcgggcgccggcggcggcgactgctccatatccacggggtccgggcggcgtccgcctcgagttaaaggtcccgccagctaggcgcgcgcgccagttccgctcgccatgttccagccgtgctgcgcgccgccgcggcgaccctcactgccccccaaccgcgcgcgcacccgctccccgcgcgccccccctccccgcgcgccccgcctcgcgccctctggagctgaccgctgttcccagtgtctcgcccacccccgcggggcccgtccgactcgacgggtgagcccgtggttcccggctccgcaccgtcgcctgcctctctgcagaccaccccggacccgacccctcagccacttccccacgctgcccctttcgcttcccccatgacgcggggcctaggacgagggtctgggccaagaggaacttccccgcaagaagtgccgagctaaggacgctactaagggggcgggatcgccacgtggaggtgtgcaagcacgtgcctgcgtccgggagacagccagactcaacggagaagctgagttcaagtcccacatctccactaacccttgcgtgttagggtcagggcttcaggacttgtttctcctaaatctttttttttttttgagacagtctctgtcacccaggctggcggctttttgcccgccccggcttttgcccccccgccgccgcgactttttgcccgccgcggctttttgccccccccctcccccccgccgaggctttttgaccccccggccgccgcggctttttccccactgcggttttttgccccgcgccgccgcgactttttgcccgccgcggctttttgcacccccactgccgcggctttttgccccccgacgttgcggctttttgccggtcgcggcttgttgcccccctgccaccgcggctttttgccccccatcgccgcggctttttgtcccccgccgccgcggctttttgccggtcgcggcttgttgcccccctgccaccgcggctttttgccgtgcgccgccgcggctttttgacgccgcggctttttgcccccaccccccggtgccgcggttatttgcctgccgcggctttttgcccccgactgccgcggctttttgcccctcgctgccacggctttttgcccccccgcccccgctgccgcgactttttgcccgccgcggctttttgcccccccgccgccgcggctttttgcccccccgccgccgcggctttttgcccccccgccgccgcggctttttgcctccgcggctttttacccgccgcggcttttcgcccctcgctgtcgcgactttttgcaccaccccccccgccgccgcgactttttgcccaccgcggctttttgcacccccgccgccccgggtttttgcccccccccccccccgccgccgctgccatttctaggctaataaactaagaatcatgtaaactaaaccaaaatagaatagacataaaagtcctgaacacttcaacttcctatccttcacgaagtatacctcgcaaagctcatttgagagaggaaaagctttcctccaccctctgttttacagcgctgaggcttctcatcacatttctatgacttgtagcttaaatccatgttacatggtcactggcattgttaggacttctcttttaacactgtaggaattaatcaatttggtggcatatttaattaattctatcactagaggattgtaaaattacatatatgaatacctcactttagaggccacttaatttttttccaaggggatatttgactatatttcacttgtgtcttatttaatgattttataatttaaaccctaaattataaatctagaatttagaaagtatatttccccactggattacatttttggaaatattattttatatgtacacaaatattacaaaatcactgtagacacctgcaaactatattatcttttaaaggcaatatttatattaaactggtataacaaaattgactcaatttcattccattctgccctgattttggttatttattttcttctgctagctttgggtttgtttactcttgtttttctatttcctttaggtatgatattaggttgttaatttaagatctttctaacttttcaatatgggcctttagcacgataaatttttcacttaacactgctttgcctgtgtcttagagagcctggaatgttgtatctttgttttaattagtttcaaagaatttattggtttctgccttaatttcattgtttacccaaaagtcattcaggcacaggttgcttaatttccatgtaattgtatggttttgagagttcttcttagtgttgacttctatttttgttacactgagcagtccaagagtgtggttggcatgatttctggggtttcttttaatttattgaaaataattttagactgatagtgtgatcgattttacaatatatgccatgtacagatgagaggaagatatattctgttgttgttgggtggagtgttctgtagatggctgttaggtccatttagccaagtgttgacttcaagtcttgaatatctttgttcattttctgtctctatgatctgtctagtaccatcagtgagatgttgaagtctcccactattattctgtggttatctaagtctctctataggtctctatgaacttgttttatgaatgtgaatgctccagttttgagcacatttatctatcagacagttaactcttcttgttgaattgaaccctttatcattacttagtgcccttctttgtgtttttgattgttgttggtttaaagtctattttgtctgaattagaataacaatgcttacccttttgtgttttgcatttgcttggtagatttttttccatccttttacttcaagccaatgggtattgttgtatatgagctgggtctcttgacaacagatacagttgggctttgcttctttatccaacttgccattctgtgagttttaagcggggcatttatactgtttacattcacagttaatattggcatttatagctttggtcctgccattatgttgttagctggttattatgcagacttgattgtgtagttactttacacgtcaatggtctatgtacttaaatgtatttttgtggtggccattaacagtctttcacttccacgcttagcactcccttaaggacctcttgtaaggcatgtctggtggtaacagattcggttagcatttgtttgtctgaaaaggatcttacttctccttcacatatgaagtttagtttggctggatattaagttcttggttgaattttttttttttttttttttttttttttttttgtgacagagtcttgctctgtccccaggctggagtgcagtggtgctatcttggctcactgcaacctccacctcctgggttaagtgattctcttgcctcagcctcccgagtagctgggactacagacacgcaccaccatgcccagctaatttttgtatttttattacagatgaggtttcaccatgttggccaggatggtcttgatctcttgaccttgtgttctgcccccctcagcctcccaaagtgctgggattacaggcatgagccaccacacctggccaagtatttttttttttaaagaatgctgaaggccgggcgtgttggctcacacctgtaatcccagcactttgagaggccaaggtgggcagatcacgaggtcaggaatttgagatcaccctggccaatatggtgaaatcctgtctctattaaaattataaaaaattgccgggtgttgtggtgcacacctgtagtcccagctacttgggaggctgagggagaagaattgcttgaacccgggaagtggaggttgcagtgagccaagatatcaccagtgcactccagcctgggcaacagagtgagactccatctcgaaaaaaaaaaagaatgttgaatataggcccccggtttcttttggattgtagagtatcttatagttccactgttagcctgatgggattctctttgtatgtgacctgccccttcactttagctgcctttcatatttttttatttcatgttgaccttggagaatctgatgactgtctgtcttggggatggtcatcttgtatagtatctcacaggattctctgcatttcctggatttaaatggtgacttctctagcaagatttgggaaatttttgtgggcagtatcctcaaatatgttttccaacttgcttgttctttctccctttctttgagtgatgccctgagtcatatgtttggtctctttacataatctcagatttctcagaggttttgttcattcttttttattctttattttcatctgactgagttgattcaaagaagtggtctttgagatctgagattctttcctcagcttggtccgttctgctgttagtacttgttattgtattatgaaattcttgaggtgcatttttcagctctatcagtttcgtttggttctttcttaaaatgcctatttcatctttcagctcttatgtcatcttattggattccttaaattattaggattggattttgactttcttctgaatctcaatgatctttgtttctatccagattctgaattctatgtctgtcatttaatcttgcttaacaaccattgttggagagttagtatgattgcttgaagacaggaagacattctggctttttacattgccagagttcttgcactagttctttcacatctgtgtgggctaaggttcctttaatgttttgaatcactgtcctttggatggagttttttccttttttatattctttaatgcccttgagggtttgactgtggcacaaggtagtttcagtcaaatggcttcatttctggaagatttcagggggcaaaggctcagctcagcactcctgaactgcactttctaactttgcaaggctggtaccatacctacagatttgttgtctggcccttcaatgttaagcactgaggtgttcccagttcactggcaacaacactctgatggggtgtgccagccaaagtgcttcattgtagtgattgtaacaaggtccccactcacacatatgtgccagcagcagcagcacacagcaggtatgcatgtgttggcaggggtgcagtgccagcaggagtgggatgggggtgttctgcatacttgcacgtgccagccggggcaatggtgctgtggggtgcactcatgtgctgctggagacagagtggcagcatcttcatgagttttatgttatcattctagatctttaaaaataatattttggacttctaacaaatgtatttgtgaacccagagaaaaaaagagtattattttgtgcatttttacttaatcatacccaagaaaattttactttacaatttgttcttttcactcaacaatagtcttgaggtttatccatctcaagatagatacacatgtagttaattccttttaattgtataagattacattgtatgtcaacagcagattttatttacaacgttataacaaaaataacattttatttgtctcattttacataaatataagtttgtctagaatagttacctgggttacatgcatttttagtttgatgtatactgccaaaatcctttcggtatggccactttaatttgccctaataccaacagcttatgagcctacctgttgttcttgaaaatccttgcaaatccttgatattattaaattttataatgttttccagtctgataattgaaaaaatggcatatttttgttattttaatttgcatttctgtgattattcacaagcttgaatatcttttatatatgtgttgtccttcagcttttccttatctgtaactagcctgttcatatcctttgtccatttttttgttgagttggtcttctttattaattatatctgttatatgcatttgtaaattatatgtattgcaaatatcagtagatatttaattttgtttgtgatgattttttttcactctaagaagtgtattttgttattttcaacagacagaattgccaatacacaacactgttcacttgactttgaaaatgaaaaagagaaaaagaggaagaaagagcagaattgcttttgaagtagtactttattatagtacttttgaagttacttttgaagtgctactttaatataattgaatgtatcaaaatctctttttatgtctaatgcctttgtatgtatcattcaaaaagtcctttttacctcatgatcacaaatatattattctacatctttattttgttgttcagagtcttgctgtcacccaggctgtagtgcagtggcatgatctcagctcactgcaacctccacctcccaggttcaagtgattctcctgcctcaacctcccaagtagctgggactacaggaatgcaccactgcacccagctattggtttcgccatgttggccaggctggtctcagattcctgatctgtccacctcagcctcccaaagtgctgggattacaggtgtgagccatcatgcctagcccactacattttcttattactacttttccttttgagcttttaacatttattatgtgtaagaatctatctatattcctttccacataaatagttatctcaacaccatttgtgaaagatttctttctttctcccactgatttaaaataccagttgtatgatgtaacaaatcccatagatttgtttccacactttgtattctcttttcttccaatttattttgtctatttatatgtcactattattcagttttaactattttacctttacaaaaacagtatcttgttttcttaagtttacttgatctttcattctaagatcttattcttccaaatgaattttataatcagcttgtcaagctcagtaaaaatccctgcaaagattttgattggcgtatctctgattaattcatttgggggagagattacatctttctattattgaggctttggccgggcgtggtggctcacacctataatcccagcactttgggaggccaaggcaggcatatcacttgaggtcaggagttcaagaccagcctggccaaaatggtgaaacaccgtatctactaaaaacacgaaaactagccaggcgtggtgttgggtgatggtaaaattggggctttttagttcacacttgtgaaatgtctctctaagtattcaggtattatcttaattactatattattagattcacaatttttataaaagtatagactgtcttcacagttttgttcttagatactttgtttttttaattgatgttgtggattaaattctctttgatcacttattcctggggaagccagctgccatgtcctgaggcagccctgtggagaaaaccccgttggaaaaaaactgaagcctgcaatggctacatgagtaaacttggaagcagatcttctccaccccaccctacctcatgggaaatcttaagtcgaggcatacagctaagccatgcccagattcctgacccacagaagtcataagacaataaatatttgttgttttaagctgctatgtttggggatgacttgttaagcaaaatgagaaaaataatacaacaggtgattacaatgtgcagcagagttcaggaaccactaaactagaccagtatgtggtcttagagaagtctagtctcttcttgagcccacagggaaatctgtagcataaactgcaccatagagttgtacagccagaagcaaatctcacatcagtccgtcattggcagatctgtctggagggaaagtagaggggtgcacaacctccctagtattcccaggtaggtgcttgtcagcaggacaagggttctagaaacctgcagatattagcagccaacaagcagcactgggagatgtgttcattgacctggtaaatggattctggcaggagcaccaaaagcatttctacacaggatatacttcacgctttataaagtaaatgtagaagagatgaggtgaaattctggataagatatgccaatagaaggtattctgagcaggagcctccccattcctcatgggtgtcatcaaccactccagaaatgttctcatttgcctttgtaacttaggtggccacacttgttttttttgggcagacaactctgttccttccttccttacttacttatttactcaagaggtaggaaatgtgtggaaggtagatttgtctgatcattcttacagtggtaatccaaataatcaactatttggtttccccagaggtctctcctgctcccagcgtctgtcatttcagggcttggaccacttttagaagcacatgtatcttttgaggcaatcttatttacacacatttttgtttatggtttccttttttcaatcctaaattgtctgtctcttatctttctggcatatgcttagtttcttgtccattgatgattcaccttttgctttcttgttaggttatgaatttttctattaactttacatcttcatttcaaaggatttaggaatagagggagaggctgcaacctgtgctcagcccaacattttaaaccacgtctgtataaaattttagctagcagtaaacaatgcatgaaaagttttatcaccattaaattgcattcactcaaatttgaaattcttctaaacaatgtttgttacaaatttattataaactacttgtacttataaaacactacttgattaaaaagatgcttttaaattaattttcattctttctttcagttttgttttaggtgctgtctctcctgttgttgttgtcctttacacgatggtgttgcaagaaaatggatatggtgttgaggaagacattccaacattactaatggctgctagcagtatggatgacattctggctatcactggattcaatacatgcttgagcatagtcttctcctcgggtaaacaagaaaatataacaaccaccagatcattcatgaccttttttgtgagttctttaaacagggtttctggctttgcttcttcatgtattaaccaagactgttcaatttaacatctttttaatctccatagaaagctcattccagaccaaggaagatatttcagtggcttaagatacaactacttaacacacatgatctcactttaataatcatgtgacaattaatttgataaaccatattattactatttaactgcttctgttgcttttgaattttatcagttctcattggaaaaaattaaacagcaatattatttgtactactaatattttaataggcatttttgaaatgtgcctttttggccatcctaataaacaactggttgctctattataagacaacataaacatacagagctgggacagccatatgcctttttggtagtgttaggacaagatcctgcaccagttctgattcccaaggtgatatctggtcttgaatatcactacagaaattgtgaaactaaacatttccacatttaataatgctttaattatctgcaatgtttgagtcttctgtattattgaaatgctaaactatttttaagttgaaaagtaatatatatacttttatagtttctcttaaaataagaaaatataaataaatcagaaaaagaggaaaagttaaaaataaaatctgcaatagtcacatccagaagaaaagaatcatttccttctgaaccttttgatataaatccacccatattcccttcccttccctttttcccttcttcccttcccttcccttcccctctcctcccccttcccttcccttacccctctctctctgtcaaatattcttataaaaatcagtgaatattgaccaatatgttcttttatttttttttttttttgaggcggagtcttgctctgtcacccaggttggagtgcagtggcacaatctcggctcactgcatgctctgcctcccgggttcatgccattctcctgcctcaacctcccaagtagttgggactacaggcgcccgccaccgcgcctggctaatttttttttgtatttttagtagagccagcgtttcaccgtgttagccaggaaggtcttgatctcctgacctcgtgatccgcctgcctcggcctcccaaagtgctgggattacaggcgtgagccatcgcacccggcctaatatgttcttataacctgaattgttttacacttaactgtatatcacaaacatgtttcttttcagtaaatgtatttgtatatcatttttaatagttgtttagcttaatgaaagagtattcaatgcgctgcatcatgattacttatcctgttcaaaattaaagttaactccaatatttactattaaaataatacttagttgtgctgctataaaaatatatttttaaattaaaaaattggccgggcatggtggctcacacctataatcccagcactttgggaggccaagaagggtggatcacttgaggtcaggagttcaagaccagcctggccaacgaacatggtgaaaccccgtctccactaaaaatacaaaacttagccgggcatggtggtgggcatctgtaatcccagctactcaggaggctgaagcagaagaataacttgaacccaggaggcggaggctgtagtgagctatccagcctgggcaacagagcgagactctgtctcaaaaaaatttttttaattaaaaaaataatacttagtagaacatatagggaaatatttgtacctaatcttcatattttcttaagcttaaaagtgtaattgttgatctaaaaggtatatacatttatgagtgttctgaaacatattgccacaatatcatgtcctaccagggtacataaacttgtcatttcctctcacctctcttcaaaacttggtattactagcctttttcatctttgctaatttgataggtgaaggagggatctctataaatgaagtactttgaatactagtgttgttaaatatccatgtttattagtcattggcattttgtaaattgcttttcttgaaagttttttgcctatttcttttaggtgggttcaccttttgttctttttgatttgtcaagattctgcattaaattgagaatgaaaacctttgttttatatactttagttttttcaatttgtaatttggcttttaattttctcactctttttaccattcagaagttaaagttttttattgtcaattgtgaaaatcttttccttcatgattggtatctgtcattctttcaaaaaatattcttatcagtcatgtttcaaaaaaatatttccaggctgggcccaatggctcacgcctataatcccaacactttgggaggccaaagcggggggatcacttgaggacatgagttcaagaccagcctggccaacatagcaaagctccatctctactaaaaatacaaaacgttagctgggtgtggtggcacaggcctgtaatcccagctactcagggggctgaggcacaagaatcacttgaacccaagaagcagaggttgcagtgagccaagatcacaccactgcactccagcctgggtgacagagggagactgtctgaaaaaaagaaaaaaaaaaattcctcttccttttgccggctactatgccaaacactgagaataaacagtaggcaacaacattagcttttattgaatacttacttggctcttgttctaagttccatatatgtcaccactcatttacaggtaaggaaactgagaaagatgttaagtaattttctccaggacagagatccaataagtaggggagccgagatgcaaatctgacagtctttcactccatacccacacatttaactcttctcttctccactgcctcccaacacaacagagagacaagatcaaatggtgcatgttctcaaggagcttgtatattaaagaaaaattacaaatgggatgaatattacattgtgaaggttaatattcagtaaggtgtcaacttgattggattgaaggatccaaagtattgttcccggttgtttctgtgagggtgttgtcaaaggagattaacatttatttagtggactgggaaaggcagatccaccctcaatgtgggtgggcaccatacaatcagctgccagcatggctagaataaagcaggcagaaggaggttagtagaagctgacttgctgagccttctgccctcatctttctcccatgctggatgcttcctgcactcaaatgtcagactccaggttctttggcttttggactcttggacttactccagttgttttccaggggctctcaggccttcatccagagactcaaagctggcctgtcggtttccctacttttgaggtgttgggactcggactgagccaatattagattccttgctcctcaacttgcagacggcctgttgtaggacttcaattgtgatggtgtgaatcaattctccttaataaactccctttcatatatatatatatatatatatatatatatatatatatatatatatatatatatatatatatcctattagttctatccctctagagaaccatgactaatacagattctgatactgaggtaatggaatattgctataagatacctgagaatgtggaagtgactttggaactgtgtaatgtgcagagtttggaacagttgggaggactcagaagaagaccagaagatgtgggaaagtttggaactgcctagagacttgttgaatggctttgaccaaactgctgatagtgacttggacagtgaagtccaggctgaggaggtccgagatggagatgaacaacttgttgggaactgaaataaaggtcactcttgctatgctttagcaaagagactggtggcattttgcccctgccctacagatttatggaactttgaaattgagagagatgactgaggacatctggtagaagaaacgtttgttgttgttgttgttgttataccttaagttctagggtacatatgcacaacgtgcaggtttgatacataggtatacatgtgccatgttggtttgctgcacccatcaactcatcatttacattaggtatttctcctaatgctctccctcccccagccctccaccccccaacaagccccagtgtgtgatgttcccagccctgtgtccaagtgatctcattgttcaattcccatctataagtgagaacatgtggtgtttggttttctgtccttgtgatagttttgctgagaatgatggtttccagcttcatttatctccctgcaaaggacatgaactcatccttttttatggctgcatagtattccatggtgtatatgtgccacattttcttaatccagtctatcattgttggacatttgggttggttccaagtgtttgctattgttaatagtgccgcaataaacatacatgtgcatgtgtctttatagtagcatgatttataatcctttgggtatatacccagtaatgggattgctgggtcaaatggtaattctagttctagatcctcgaggaatcaccacaatgtctttcacaatggttgaactagtttacactcccaccaacagtgtaaaagcgttcctatttctccatatcctctccagcacctgttgtttcctgactttttaatgaatgccattctaactggggtgagatggtatctcattgtggttttgatttgcatttctctgatgaccagtgatggtgagctttttttcttgtgtctgttagctgcatagatgtcttctttggagaagtgtctattcatatctttgcccactttttgatggggttgtttttttcttgtaaatttgtttgaattctttctttgtcaaatgggtagattgcaatttatctcccattctgtatgttgcctggttcactctgatggcagtttcttttgccgtgcagaagctctttagtttaattagatcccatttgtcaattttggctttcgttgccattgcttttggtgttttagtcatgaagtccttgctcatgcctatggcctgaatggtattgcctaggttttcttctagggtttttatggttttaggtctaacatttaagtctttaatccaccttgaattaatttttgtataagatgtaaggaagggatccagtttcagctttctacatatagctagccagttttcccagcgtcatttattaaataggcagtcctttccccatttcttgtttttgtcaggtttgtcaaagatcagatggctgtagatgtgtggtcttatttctgaggcctctgttctgttccattggtctatatatctgttttggcaccagtaccatgctgttttggttactgtagccttgtagtatagtttgaagtcaggtagtgtgatgcctccagatttgttctttttgcttaggattgtcttggcaatgcaggctcttttttggttccatatgaactttaaagtagttttttccaattctgtgaagaaatttattagtagcttgatggggatggtattgaatctataaattactttgtgccgtatgtccattttcatgatattgattcttcctatccatgagcgtggaatattcttccatttgtttgtgtcctcttttaattcgttgagcagtggtttgtagttctccttgaagaggtccttcacaacccttgtaagtcagattcctaggtattttattctctttgtagcaattgtgaatgggagttcactcatgatttggctctctgtctattaatggtgtataggaatgcttgtgatttttgcacattaattttgtatcctgagagtttgctgaagttgcttatcagcttaaggagattttgggctgagatgatggggttttctaaatatacaatcatgtcatctgcaaacagggacaatttgacttcatcttttcctaactgaataccatttatttctttctcctgcctgattccactggtcagaacttccaacaccatgttgaataagagtggtgagagagggcatccttgtcttgtgccggttttcaaaaggaatgcttccagtttttgcccattcagtatgatattggctgtgggtttgtcataaatagctcttattattttgagatacgtcccatcagtatctagtttattgagagttgttagcatgaaggagtgttgaattttgtcaaaggtcttttctgcatctcttgagataatcatgtggtttttgtctttggttctgtttatgtaatggattacgtttattgatttgcatatgttgaaccagccttgcatcccagggatgaagcccacttgatcgtggtggataagctttttgatgtgctgctggatttggtttgccaatattttattgaggatttttgcatcgatgttcatcaaggatattggtctaaaattctctttttttgttgtgtctctgccaggctttggtaccaggatgatgttggcctcataaaatgagttagggaggattccctattgttctttttttttggatgaaaaaagaactgtttaatttttttgatgttttcaatgttgatatgttttccaagaattagagaaatatctctggatggttatctaaaatttataatttttctacagatatggtatgtaggagagtgtcatagtttttctattattatactttaagttctagggtacatgtgcacaatgtgctggtttgttacatatgtatacatgtgtcatgttggtgtgctgcacccattaactagtcatttacattagatatatctcctaatgctatcccccctccccccactccatgacaggccccagtgtgtgatgttccccaccctgtgtccaagtgttctcattgttcaattcccacctatgagtgagaacatgtggtgtttagttttctgtccttgtgatagttttctcagaatgatggtttctagcttcatccatgtccttacaaaggacatgaactcatcctttttatggctgcatagtattccatggtgtatatgtgccgcattttcttaatccagtctatcattgatggacatttaggttggttccaagtctttgctattgtgaatagtgccgcaataaacatacgtgtgcatgtgtctttatagcagcacgattcacaatcctttgggtatatgcccagtaatgggatggctgggtgaaatggtatttctagttctagatctttgaggaattgccacactgtcttctacaatgattgaactagtttacactcccaccaacagtgtaaaagccttcctatttctccatatcctctccagcacatgttgtttcctgactttttaatgatcgccattctaattggtgtgagatggtatctcattgtggttttgatttgcatttctctgatggccagtgatgatgagcatttttccagtgtctgttggcttcatagatgtcttcttttgagaagtgtctgttcataccctttgcccactttttgatggggtagtttgattttttcatataaatttgtttaagttctttgtagattctggatattagccctttgtcagatgggtagattgtaaaaattttctcccattctgtaggttgtctgttcactctgatggtagtttcttttgctatgcagaagctcttgaatttaattggatctcatttgtcaattttggcttttgttgccattgctattggtgttttagtcatgaattccttgcccatgcctatgtcctgaatggtattgtctaggtattcttctaggatttttatggttttaggtctaacatttaagtctttaatccatcttgaattaatttttatataagttgtaaggaagggatctagtttcagctttccacatatggctagccagttctcccagcaccatttattaaatagggaatcctttccccatttcttgtttatgtcaggtttgtcaaagatcagatggttgtagatgtgtggtattatttctgagggctctattctgttccattggtctgtatctctgttttggcaccagtaccatgctgttttggttactgtagccttgtagtgtagtttgaagtcaggtagtgtgatgcctccagatttgttctttttgcttaggattgacttggcaatgcaggttcttttttggttccatatgaactttaaagttgttttttccaattctgtgaagaaagtcatttgtagcttgatggggatggcattgaatctataaattatctttggctgtatggccattttcacgatattgattcttcctatccatgagcatggaatgttcttccatttgtttgtgtcctcttttattttgttgagcagcgatttgtagttctccttgaagaggcccttcacgtcccttgtaagttggattcctaggtattttattctctttgaagcaattgtgaatggaagttcactcatgatttggctctctgtttgtctgttattggtgtataggaatgcttgtgatttttgcacattgattttgtatccagagactttgctgaagttgcttatcagcttaaggagattttgagctgagatgatggggttttgtgaatatacagtcatgtcatcttcagacagggacaatttgacttcctcttttcctaactgaataccctttatttcattctcttgcctgatttccctggccagaacttccaagactattttgaataggagtggtgagagagagaatcgttgtcttgtgccaggtttcaaagggaatgcttccagttattgtccattcagtatgatattggctgtgtgtttgtcataaatagctctcattattttgagatacgtcccatcagtacctcgtttattgagagttcttagcatgaagggctgttgaattttgtcaaaggtcttttctgcatctattaagataatcatgtggtttttgtctttggttctgtttataggatgtattacgtttattgatttgcgtatgttgaaccagtcttgcatcctagggatgccaacttgatcatggtggataagctttttgatgtgctgctggattcagtttgttagtatcttattgaggatatttgcatcaatgttcatcagggatattggtctaaaattctcttttttgttgttggtgtgtctctgtcaggctttggtatcaggatgatgttggcctcattaaatgaattagggaggattctatctttttctattgattggaaaagtttcagaaagactggtaccagctcctctttgtacctctggtagaactcagctgtgaatccatctggtcctggacttttttttggttggtaggctattaattattgcctcaagttcagagcctgttattggtctattcagatattcaacttcttcctggtttagtcttgcaagggtgtatgtgtcccagaatttatccatttcttctagatgttcaagtttatttgtgtataggtgtttatagtattctctgatggtagtttttacttccctgggctcagtggtgatatcccctttatcatttttattgcatctatttgattcctctctctttccttctttattagtcttgctagcagtctatcaattttgttgatcttttcaaaaaaccagctcctggattcattgcttttttgaagggattttgtgtctctgtctccttcagctctgctctgatcttattttttccttctgccagcttttgaatgtgtttgctcttgcttctctagttcttttaattgtcatgttagggggtcaattttagatctttcctgctttctcttctgggcatttagtgctatcaatttccccctacacactgctttaaatgtgtcccagagattctggtacattgtgtctttgttttcattggtttcaaagaacatctttatttctgccttcattttgttatttacccagtagtcattcaggagcaaattgttcagtttccatgtagttgttcagttttgagtgagcttcttaatcctaagttcgaatttgattgcactgtggtctgagagacagtttgttgtgatttctgttcttttacatttggtgaggagtgctttacttccaattatgtggtcaaatttagaataagtgatatgtggtgctgagaataatgtatactctgttgatttgaggtggagatttctgtggatgtctattgggtctgtttgttgcagagctgagttcaggtcctggatatctttgttaaccttctgccttgttgatctttctaatattgacagttcggtgttaaagtctcccattattattgtgtgggagtctaagtctctttgtaggtctctaaggacttgctttatgaatctgggtgctcttgtattgggtgcatatatatttaggatagttagctcttcttgttgcattgatccctttaccattatgtaatggcctttgtctccattgatctttgttggtttaaagtctgttttatcagagacaaggattgcaacccctgcctttttttgttttccattttcttggtagatcttcctccatccctttatgttgaacctatgtgtgaatttgcgcatgagatgggtctcctgaatacagcacactgatgggtcttgactctttatccaatttgccagtctgtgtcctttaattggggcatttagcccatttatgtttacagttaatattgtaatgtgtgaatttgatcctgtcattatgatattcgctgttatttgcccgttaattgatgcagtttcttcctagcattgatgttctctataacttggcatgtttttgcactggctggtaccgggtgtttctttccatgtttagtgcttccttcaggagctcttgtaaggcaggcctggtggtgacaaaatctctcagcatttgcttgtcagtaaagaattttattttctccttcacttatgaagcttagtttggctggatatgaaactctggattgaaaattattttctttaagaatgttgaatattggcccccactctcttctggattgtagggtttctgccaagagatcagctgttagtctgatgggcttccctttgtggctaacctgacctttctctctggctgcccttaacactttttcctacacttcaaccttggtgaatctgacaattatgtgtcttggaatcgctcttctcagagagtatctttgtgttgttctctgtatttcctgaagttgaatgttggcctgccttgctaggttggggaagttctcctggataatatcctgcagactgttttccaacttggttccattctccttatcactttccggtacaccaatcaaatatagatttggtcttttcacatggtcccatatttcttggaggctttcttcatttctttttactcttgtttctctaaccttgtcttctcactttatttcatttatttgatcttcaatcactgataccctttcttccacttgattgaatcggctattgaagcttgtgcatgtgtcacaaagttctcgtgccatggttttcagctccattgggtcacttaaggtcttctctacactgtttattcttgtaagccattcgtctaatcttttttcaaggtttttagcttccttgcaatgggttccaacatcctcctttagctcggagaagtttgttattaccaaccttctgaagcctacttctgtcaactcgtcaaagtcattctacgtccagctttgttccattgctgacaaggagctgtgatcctttggaggagaaggggtgctctgatttttagaattttcagcttttctgctctggtttatccccatccttttggttttatctacctttggtctttgatattgttgatctacagatggggttttggttagatgatcttttgttaatgttgacactattcctttctgttttttagttttccttctaacagtcaggaccctcagctgcagatctgttggagtttgctggagttccactccagacactgtttgcctgggtatcaccagtggaggctgcagaacagcaaatattgcagaacagcaaatattgctgcctgatccttcctctggaagctttgtccaagaggggcagccgcctatatgaggtgtctgtcagcccctactgggaggtgtgtcccagttaggctacacaggggtcagggacccacttgaggaggcagtctgtccattctcagaactcaaacgccatgctgggaaaaccactgctctcttcagagctgtcagacagggacgtttaagtctgcagaagttgctgccttttgttcagctatccctgcccacagacgtggagtctagaggcaatgggccttgttgagctgcggtgggctccaccgagttcaagcttccctggccactttgtttacctacttaagcctcagcaatgatggacgcccctcccccagccaggctgccacctcacagatggatttcagactgttgtgctagcagtgagcaaggctccatgggtgtgggacccactgagccaggcacaggagagaatcaccttgtctgctagttgctaagaccttgggaaaagtgcagtatttgggcgggagtgccctgtttttccaggtagtctgtcacagcttcccttggctaggaaagggaaatcccccaaccccttgtgcttcccgggtgaggcgacaccccaccctgcttcagctcaccctctgtgggcctgcacccactctccaaccagtcccaatgagatgaaccaggtacctcagttggaagtgcagaaatcacctgtcttctgtgtcgatcatgctgggagctgcagaccggaactgttcctattttgccatcttggaatccatccaggacatctggtagaagaaatttgtaagcagcaaagtgttcaatttatgacctgagtgctcttaaaagtgttcagttttatgtgttcacaaaaatatggtttggaattagaacttatgtttaaaagggagcagagcatgaaagtttggaagatttgcagcctgatgatgtgatagaaaagaaaacccattttctggggagaaattcaagctgactgcagaaatttgcagaagtaacaaggagccaaatgttaattgacaagataatggggaaattgtctccagggcatgtcagagttcttcacgacagcccctcccatcacagggttggaggcctaggagggaaaaaatggttttgtgggccaggcccagaactttgctgctctgtgcagtcttgggacttggtgccctgtgtcccagccatggctaaaaggagccaatgtgcagctcaggctattgcttcagagttcaatccccaagccttggcagtttccatgtagtgttgggttgatatgctagttggccatttgtatttctttttggaaaaaatgtctattcaagtctatcttagtccattcctgctgctataacaaaataccttaggctggtaatttataaacaacagaaatttatttcttgcattctggagtgtgagaagtccaagatttaggctacgacagactcagtgactggtgaggtcactatattcactatatatagcaccttctctgtgtcctcaaatgttcaaaagggaaaacaaactcccttaagcctcttttataaaggccctagtcccatttctgagagctatgacttcatgaactaatcatctccaaaatgccccacctcttaatattatcacattgaatattaggctccagcatatgaatattgggagaacatttggaccatagcaaagtcaactgaccatttctcatttaggttgttttgttattgagttgttgttctgtatatattttagatattaaccccttatcaggtatttggtttgctgggaggtttttgattcctgattcagttactagttataggtttattaagattttttattttgtgacttagtcttggtaacttgcatgttacaaggaatctgttcatttctcctaggttatccaacttgtcagtatataatcattcatagtagactcttagaatcctttttatttctgtaatatctgttgcagtgtcttctcttttgttcctaaaagaagttgagtcttctttttttttcttaaatattctagctaatgatttgtcaattttgttgaactttgaaacaactactagtttcattggattttttctattctctagccttttttttttttttttttttttgagatggagttttgctcttattgcccaggctgtagtgcaatggcgtgatctccgctcgctgcaacctccacctcccagttcaagtgactctcctgcctcagcctccagagtagctgggattacaggcatgaaccaccatgcccggctaattttgtattttttagtagagacacgtttctccatgttgctgaggctggtctcgaactcccgacttcaggtgatccacctgcctcggcctcccaaagtgctgggattacagtcgtgagccactgctcccggccttctgctctagactttattatttccttcctgttgctaacattgggttgagttcttctttttccagtttcttgaggtgtaaagctaagttgctgattttagatctttcttcttttttaaggtaggtagttagatatataaactgtcctcttcatattcattttgctgcatcccacaagctttggaatgttgtgtttccatttttatttgtctcaagacattttctaattttccttgtgacttattctttgactatgtattaatcagagttctcaagagggtcagatccaataggaaatatagatatagatacagatatggatgatatagatatatatatagataatagatatagatataaatatatacacatgcatctaaaagagaatatatttacatatatatgaaatataatttattaaggagatttggctcacataattacaaaggcaaagtcccacaataggccatctataagctggaaaatgagagaagcctacagcatggctcccaaggaagccagtgacatggctcagtcccagtctgaaagtctcaaaaccagggaggctgacagtgcagccactagtctgaggaccaaggcctgagagctcccaaaaggctgctgatgcaagtcccagggtccaaaggccaaagaacctagagtttgatgtgcaagggcaagaggaaaaaaaggcatactgctctggaagagagagaaagtgcataaaaaagaaatccaagcaagctgaatgttcccattcttctgcctttttgttctagtcacacttgcaaccaattgcatgatgcctacccacagtgaggatgggtttttctctctcagtccactaactcatccatcattctcctgtggcagcaccctcacagatatacacacacacagtgcttcatcaggcatctaagcatccctcaatcaaattgtcaattaatattaaccacacaggtcaattggttaagagagtatatttttgtaatttccacatatttattacttttcctttttccttctgctatgaatttgtaatttcatttaatgtggtcagaaaagatatttggtatgagttcagttttcttaaatttttaaaaacttgtttgtggactagcatgtcatctatcctggaatcgtcttggtatgtacttgagaagaaagtgtattttgctattattgggtgaagtgttctgtatatgtcagacaggtccaattggtctataatgttgttcaagttctgtgttttccagttgatcttctgtctggttattgtatccataattgaaagtggaatattgaagttttctgttattatgatgttgctatctatgttacccctcaattctgtctatgttagcttcatatatttagatgctgtactgttagttacatatacatttataattgctatatcttcttggtcaattggcccttttattattatgtaatatccttgtctgttgtgctattatttgaattaaactctattttgtctaagtatggccatccttgttctcttttggttaccaaatgcattgaatatctttttccatcctttcactttcaacctttgtgtgtgtttagatctaacataagtctcttgcatatagtatatatttacatttttttaatccattcagccaattctctgtcttttgattggaaaattagcctatttgcatttaaagtagttactgatagggaggggcttactattgtcattttgttcattgttttatacatgtcttgcaggtatttttttccacttttcctctctttctgcctccctttatgtttcactgattcctttttttggtagggacgtgctttggttcctttctcatttttatttgtgtaacttctgtaggtcttttctttgtggttactgtagaattacatgaaaacatcttatagttataataatctattttaaattgacaacaacttaactttaatcacatacaaaaactctacttctttacacctccttctcactttgttatcaatgtcacactatatattttatattgtttattcacataatttaatacagtaatattatgctttcaacttttaaattctatgcatcaattaaaagtgaattacaggctgggtgtggtgtctcccacctgtagacccagcactttgacaggccaaaatgggaggatcgcttgagcctaggagtttgagaccagcaaggccttatgtctgctaaaaatttaaaaatattatctgagtgtggtggtgcatgtctgtagtcccagccactcgggaggctgaggtgggaggattgctttagcccaggactacaaggctgcagtgagccatgatcaaaccactgcactccagcctgggcaacagagcaagacttcgtctcaaaaaaaaaaaaaagtaaaggaaaaaaagtgttttgcttaccaccattagagtattaaaagattctatgttcactcatatatttacctttaccaaagaagtttatattttgtatgcttttgtatttctatccaatgccttttcatttccacttggaggactccctttaacattttttgtaaggtaggtctagtggtgatcaactccctcaccttttacttctctggggaactcttcgtttgtccttcatttttgaagtagagttttactggctatacagttcttgttgacagttttttttttctttcagcccttttaatatatcatcccattctcttctggtctgtagagtttttgctgataattccattgataaccatatggcatctcccttgtatgtgacaagttgctttggtcctgttcctttcaaaattctctctttgtctttgacttttgacagtttgattgtaatgtgtctcattgtaggtcttttgcaaattatccaacttggagttctttgagcctcttggatttgtatgtccatttccttctttaagtttgagaagtttttggtcattatttttttaactggctctctgcccctttatttttctctcctccgggcactttcataatgcatacattggtctgcttgatggcatcctgtaagtctcttaggctgtcttcactcttcactccttttcccttttgctcttctgactccataatttcaaatgactagtcttccgtttcactgattctttcttctgcttgatgttattgaaactgcctttgcaaaaattataactgaagaaattatgacagcaaaagacatcagacttaatcaactccatcttgcttctagcatttaaactgtccttgttcattcctggcagtaggatgaactaattttgggaaggtattcagttcatggtttgactctgaaacaaagttgataatagccatttcccaaaaagatccccttcttgcctggaaccagtctgcctttgcaggataaacaaattagctataacatcagaaattacagttgaggggttatgcagcctctggctccaagagtctgaacctctccaaattgctcctggggataacatcactattgtaaaacctaaaatcagtgcttgagatattttgcggaccctgcactggatgaatcagctgacaccacccagactggtaatatggctcaactagttctgccaccccacccacaaacagaagacagcaagaaaacatcatttcaaccctgtatgatttcatctccaacctgatgaataggcagtccccactttccaagcccctacctgccaaattatctttaaaagttctgatccccgaatgctcagggagactgatttgagtaataataaaactctgatctcccgcacagctggctctgcctgaattactctttctccattgcagttcccctgtcttgataaatcagctctgtctaagcagggcacgaggtgaaaccactgggcagttacacagtctattggtgatttccaatagtgaatttttcaattgagctattgtattccttagctccagagtttctgtatggttccttttttttttttttagtttctatctccattaatattttcattttcttcatgaattatttcctgctttcacttagttgtctatttctgttgtcactgggcttcattaagagagttaatttggattctttgtcaggtaactcatttatctatttctttagggttggtttctgtagatttattttgctcctttaatttagtcatcaggtttctctgtttcttcttatgtcttgttattttttatttttttatttatttttgccaagatttgggcgtttgaaaaaactgccacttctcccagtttttatcagctggcttcatacggaagaccttcatacctgaatcagcatggctataggttccagcagcctctcaaactttttctgggaatgcatcttgtttgggtttatacattgcaacatcccaagtagaggtttgccagtttctttttctggagctgttgctccctctggtatctgtctgtggtactgcaggttccctggtgctgcatcatctctgacctctcctttattcccagtggctcccatgaatccaaagtatgccagttgggcgtcaagttagagagagagggagagcttcaggtaacctcataaaactattccgttccagtcttctctttctctgctaacggagaagctgcaagttgagtgcttcccagccaaaccaacctgttcgagcttggggaaggggtatcatgagtataatgcaacagcttttcttatttgttcaatgccactattcttggttttgcacttgtctgtgctactacaatttcttaatggtttatggaactccataaaggcttttagaccatatattgtttttcagttgctatctttatggagaatcaaggtttggagccattccaccatctggctggcatcactctgtttatataattttttatttttattatattttattttcttgagacaggatcttgctctgtcagccaggctagagtgcagcctcgaactcctgagctcaagggacctcctccctcaggctactgagtacttggactataggtacacaccacataccgggctaatttcctattttcttgtgaagatggggtttcactctgttgcccaaattggtctcaaatcttgggctcaagcaatctttctgccttggcctcccaaagtgctaggattaaaggtgtgagcccaccatgcgctgcctgttatatttagtagaaaatatatctaaaaatatacttacgtactatattgaatccactacccagagcttaactgaactatttttgtgactcattctggttttttttattttttgctttttacttattacaatgaactacaagtatggatatattaatattaattaatataaaatatactggaatcttttgtattttttttccttttttcttcaccaaaagcagaaacttaaatatactgaaatcttaaatgacccttgaatgtttctaggactgaccctggaacaaaattttttatgttgttattacattgttcttttcatgttaaaatcatttgtttctttttcatatagtacatcaaagaagaattgttaatatagcccttaccagccatatgctaagtgccacaagtgtttcggtctctctccattcttgtacctcacttggtcttttttttcttttcgaggtgtagcctccatctttcacccaggctggagtgtggtggcacgatctcagctcactgcaacctctgcctcccaggttcaagtgattctcctccctcagcctcctgagtacctgggaccacagttgtgtgccaccatgcccacaaaatttttgtatttttagtagagatggggcttcattatgttggccaggctggtcttgaactcctgacctcaagtaattcaccctcctcggcctcccaaagcgctaggattacagacatgaaccactgtgcccggactacctcactctgtcttttaaattggctatgtaaggggagcatcttgtgcttaagtctttgttttctggcctatttatataatggacatttctgagttgtgtgtatatattaaattatttgagagtatatatttaatgtactaaatagatctacgtgttttcatacatgtcactataaaaagaccatttgcatatatttgttctataaaatgcttacttttcttcatgaaccacctagatttgcttttctgatgtgtagtgtatgtgaaaatatttctttgtgaatttttttttattgtgtgcccctacaggtggtatgcttaataacgccatagcctctataaggaacatatgtattagtcggctggcaggaattgttttgggattttttgttcgatattttccaagtgaagaccagttaaatacaaaatctatcttatagaagtatagtattagacttttttttcaaaatattaaactttggtaagatccatgaaatttaatacttaactctatttttctaaaactagcctccaatgcctactctgtatttaaaactgagcacagtggtgattgatacaggtcaatggctttgattaaagtctctgcttcctgatttggcaaataaggaatgtcaaaaaatatacttaattcagagtatccctctcaattatactttccctttctctactaaattgcctattgaggtttgataatttcccccaaattttcccttaaacattttagggggagataggttcccatttatttctgcatattttctgactgaaattcactcctgctatcctttgacaaaggcaacactcaaacttagccatttcctgccttaaaggaaaacatgccattacttttgtatttctgtaatttccatccaaatttagctgtaacatattgaccaaagagatattcaaatattttttaagaattcattggatatgttatatgaaactggagattttatgggtctcttttcttcttcacttaaagtaatattttaactattttactgatactagtatcagagatgtggcagaagatgaaacgttactaattggaaattttgttacttggtagtaagtctgctaaaatgtatggtgagaaagaaaatcaaaattttagacatgtaatataacatttaaagacataatatcaaagggtcaaacatatataatagataatgtctgtctgggcgacagagcaacactcaatctcaaaaaaaaaataaataaataaacaaaaacaaacaaagaaactcaatgtaacctttttctatttttatttttattttcattttgagaccaggtctcactctgtcacccaaactggagtgcagtggcatgatcacggctcactgcagcctcaaccacctgggctcaaacaatcctctcacatcaacctcctgagtagctaggatcacagtcacctgccaccacacccaactgctttttttcagttttttttttttttttttgagacagtcttactctgttgcccaggctggagtgcagtggcatgatctcagctcaatgcaacctccacctcccaggttcaagcgattctcctgcctcagcctcctcagtagctgggattacaggtgcacaccaccacacccagctaatttttgtatttttggtagatatggggtctcaccatgttggccaggctagtctcaaactcctgacctcaagtgatctgcccgcctcagcctcccaaagtgctgggattacaggcatgagccactgtgcctggccttttctttctgatttttttgtaaagaggaggtcttgctatgttgcccaggctgatcttgaactcctaggttcaagtgatcttcctgcctcagcctcctaaagttctgggattacaggcataacccactgggcacagccaacgtaaccttttgaaatctcagttttaaaagcaattattttgaaatcaaaaagtattctttcaataagtactttctaagtttatgaaaatatgttttttattttcctaaaatatataataagaatatatctgaaaattggagtttttatattttgctgaatataacaaagctaaatgttatgattttaaaaagtagagacacaggccaggcatggtggctcatgcctgtaatcctcgcacttcgggaggctgaggcaggcagatcacttgacctcaggagttcaagaccagcctgggcaacatggtaaaacccctgtctctacaaaaaaaatacaaaaaaattagtcaggtgtggtggcacgcacctgtagtcacagctacttggggactgaggcaggagaatagcttgaactcgggaggttgaggctgcagtgagctgaggtcacgccacttcactccagcttgggtgacaaagtgagaccctgtcgcaaaaaaaagtaaagtaaaatagagacacattgattttttaaaaaatacttttcctaccttgccactcactccatcacacaaatgtgcatatatttttttaattacacatttatttgtatactatttggttaatggctaaatccctgcccccgcccccttgatagactacgtaaggacagggacagtgtctagtcgttgcagttgtttttcattatttctccctggcacttaacacagtgcctgacatgcaggaggcaaatacgtattgcatgcctgcaaggatgaatgaacggaaagggaaaccttgtaattttgccctgttattcaaggagattctcctcctactaaaatatattgctacttcttgttagactgtttaacttggcagcataatataccttaatttcctgtggctcttttcttagttgttattccaaaacagaagctcctaaattttcatgcaaaaaacctctattatcatgttagaaaagcaggctcatagggccagactacctgttttgaataccatgttacttgcctataacctcaggaaaattattttctagtctctcagtccttcagtgttctcgtcttgcaatgaagtctatgactgtatctgtttcttagcagtattgtcaggattcaaggagataatccacgtaaagtgccttagcactctctctggcatatggtggtgctcagttaacaaacaatgttgttattttatcttaccttcaagtaatataaataataactttttatttttaatgtctactgtagggaataataaatctacaaaaggagtatctgttctctctccttccaacaatactcttgcaattttgtttcattatttcataattttcataaagcagggaaaaaagaaaagcaggtatgaggaaagagaccactcactcgagccctgcagtattattctgcttctgcctattcctgtcggctggctccaggctggcttctacacaaagaatatcaagctggtcccaggaactggcaagacataaaaaattaattatttatacaagtagagtcacaacagcaataatagataacaataatgtcacaagtaaatacgatcaacaaatatttaaatttcaattttaaattattttcacctttatcctcttccgccattctctgctgctaaaataaaattggctaaggttcagctttctcttgttccttagtttcgagttactgataaaagttagacaggaaaaatagaagctattaggagagtaaataaataatttagtttacaaatgtaagatcagcttggcaactggatttttttaaagaaatagtattaaatctcagtcactaggaggaaatcatttatcatctaataaaagtcctcacataataaggttgtcataagaattaaatgaattgataaatggaaagctttaagaatgatacctgacatatgatgaatgccatataactataaaaatattatttctagtttcaccattatcgtcatcatctcttaaaagtcagtgggtttggcttttgtttttgttttttctgttggcagttcttttatgttcaaatcctcttctaaactgtgagattctttcaacgtggttttctgcatgattattttttttctccctagcatcctccagcacactggatcatgttcagtacattaaaagttatgatataaaaataataccattttaaattattgatttaggatatagaaattgatcttaaattgaggggttctcttgccataatgttccatatcagaggtaatgtttctactattatgttgttacttcacaactccatagaaaatatgttatatgttggtatttaattcccccaaattttaaggcaatttcaggcctagttattaaacacaaggaaagatagttacaagaaatttgctttatgttattaaaaataatatggtagaaggtaactagggaaaaatcttgtgacccagtagtcattctaaaaaaaaacttcaaaggaactcattctctgacctggcaggggatgaggagtgaaggagaaagaaacttactactatctgaatacctactgtgtgccaggtattcttcacattctcatatttaattttcacaaccgtccagtaagataagtattttgttcttcgttttacacgtaagtaagtagaagtttagagagtgtgagtcatttgtacaaggtcactagcctggttgcagcaaaaatagaattcaaacccagtttgctagattccaaacctgctgtcagttctgctataacccagtgccccctgaataaggagaacaatgagaagaagggcaacacatcctagagaaccataagaaaacttaatattttatttggtcttcttgtagtcaaaaactactggtacacgataaaggcaactaagcaaaactggttttgttagaactcctggtgttatgagggcaacactcaaaagagatatttgaatagaggaacactgagaggacaagagtgcaaaatcagcccaaaaatgtttgcatgctgatttgtcactattgtactcttcctccacatatatttgctaggaagaacatggaactgatgagtaacttatgataattactgagtacttttttttttctaatagtctagtactagattttgtttattttaacagggccatttacattatatattaactcagtaatatttttctttatgccccatttttatccctaaatgtaggctgtgctaggtcctctggctctagaaacagcaagagtctccgcaccccacttggaaccatatgcgaaggatgtgatgacagtagcatttttagccatctcgatcacagctccaaatggagctctacttatgggcattctggggcctaaaatgcttacacaccattatgatccaagcaaaataaaactgcaattgtcaacattagaacatcattaaaaagtttacctgtcatcatctgcctgcttcttttaatgaattatttcacatgactgaagaattttaaagtagaaatatgtaggaactgcacagaaaatccaggatttagtaaacatgtgatttcagtacagggcttttcttggactttttactccaaagttaatttaataaaaataatattaaatggaatgctctcttggtatttacatactgtaagaacaaattaaatctgtaaataccctaggaaagtttaagtaatccctcaggctgaatttgatatcataatacaaactgagcttaatataaaattaaacaaacttaatggcagaaagaaaaactttgaatattgaacttggtaagatagcctaagtttccaaataggaggagtagaactccccatgatatccagtaattccgttaaaaagatcactacaaaaaaaaaaggagtaaaacacatcaactttaaatgggttaactgaatagattttaaattctggttttggtgactacctgaataaataatatgttaagtaatagaaccaagttagtctttccttatttctgccatgcccttaaaatgaaagtctggtttagcagtttttagatgaaacactatctatatatttatttatagaaataaaattaaatcacaaatggaagtaaactatatttttttcaattagtgttttaaaatctaggcataaaaggcagcctccaaaaatgaaagatttggagactactgtcatgtggcagtttcttctccttagtaatatagaattatcttttaattctggctgattaaatctgccatgttaatgtagaacccatcacaagcaaagtgagttttaattaacttcaagactctttattttaaagttataagagttatataagcacttctaaaatggccttattgaaaggcattttagaaattgtttagacttctttggcaaaagctcaatgcaaggactgaatattactttcattcctctttttcctcttctccacaagcaagatattaaaatgccacagaatatgaaattcacacacaaatttgccaagtgaagcaattaaaatttaaggcaatcaaaactatgtgttattcctattaagactaagggcttttatagaatatatcaccgaaactgccaaaagttctaaaaccatctgggaaataactcttagaaaatacactctgggagaataactctgggaaaagataaaatagctactgttttagtgatattttctctttatagttttacaacaaagtacagactccattttcaaatattgtaattctagtactcaaattctaaaaatttaaactgtgccagtgttttgactactatttaaatcatgaggatatctcattgtcacttataaaaaaataaaaatataggcaggctgttgtggctcatgcctgtaatcccagcactttgggaggccaatgcgggcagaacacgaggtcaggagttcgagaccaacctgactaacatagtgaaaccccgtctctactaaaaatacaaaaatttgtcaggtgtggtggcacgcacctgtaatcccagctactcagaaggctgaggcaggagaatcgcttgaacccaggaggcagaggttgcagtgagctgagatcgcaccactgcactccagcctgggagacagagcaagactctgtctcaaaagaaaataataataaaatatatatatttacaagatagtaatttacattcacaagaggattagatttcaaagtagaaagtttattttaataaaagagagataagaaatgattttcaaaatgaggaattgtgtttttgattaggaggaaaattgttctacctattctttttattctttatttatagaactttctctaagtgtctgtgatatatgtttattatactgaaatagtcgccgttttaaggtagtgtggcagatgttgttatttatttgaaattttaagttttttatttataaaatgtttttataaaaatttattaatataatttaaaaattacaaccagttaaccatgtgtatgatattagtgtttatagtatttaaacaaataaggctgggcacagtggctcacaccatcccagcactttgggaggccaaggcgggtggatcaggaggtcaggagaaggagaccatcctggctaacatggtgaaaccctgtctctactaaaaatacaaaaaactagccagacatggtggcaggtgcctgtagtcccggctactcgggaggctgaggcaggagaatcacttgaacctgggaggcagaggttgcagtgagccaagatcatgccactgcactccagcctgggtgacagagcgagactccatcttaaaaaaataaaataaaataaaataaaataaaataaaataaaataaaataaaataaaataaaataaatacaagattgttgtttcttataaactttttttgtatctttgcctatttttttcactgtttaaggaatttttattaaagcaaaattttataatccaaattacctttccttgctcagttatcaattctgttacttaaaacagaagtgacattattagctattccacactaatgaattacaaaattaaaggaatgctttaaatttttatactttgctgaaaattatttatcacagagtctgaaaagcattacagtgtttttatattttattattttgggaggattttttcttttcaaatcaataagtaatctaggactatcattgcatttgttagatctgacattttcttggtatgtaaagttcaaagtttcctttttaaatttattttatagtttacaaattttttccatagtatttaaggtttttgatattgagatatttttcttcagtgatgctcaagtttctttctgtggtccctgatcagttttaaacaattggaacaccagtggcaccattaactgctttctgggcagcctctttagcttggtgctcttgtagtacagctatacctttgtcaaccttagtatagagaggctctggagattcaagcatatgaaggagttctaaattaccaatctccaacaacatgccaatgattttaccagcacgactagggcatggcttgaagaagaggaaacagccattcactcgtttccttttgcttttgaggaggagcagatgccatcatggaagtcaaaggttcttgaccttctacatgaacagcaggctgctgcatggtaacctggggctgtgcatgaaaatatcattgaggattgtgagcttccatagcatatttatactgtgaaatggtacaaacagcaggagtatctgtagtagcagtagcggcaactgcaggatgtgctcctattgtctgtgtcgatgtgttacaacagctgtgttgacatgactcgtggaagctgtgaagaagctggtctcttactactaaatgtagtgagctaggagtggcttgggcatatttttcaatggatgaggtctggcaccctgagcaatttagggaggatttgatcttagttgagcagtttggctaggagaatactttgcagcatggctctcagtctgtgggataactgccatgaagtcaattgaagaaggtgctggctgatagggactgattcccaggttgagcatagtttttacacttgccattctttgcacatagtgtactggttaatgagctgagcctggtgctcttcattgcttttcttcccatggagttaacactatatacaatggctcagtgcccacaattctaccattcatttctgaaagtgctttagttgcttcctctggagaggagaaacatacacaaatcaaaccctttgttgtgacaaccatccttcataacctttgcattggtgattgtaccaagtggagaaagttctttccagagacattcatcaataccatcatgattttttgcataaatgttaacactttgttatctggtgatcctatactgcttgatcttttcaaatttgcacacaagttccatctgccattctacttctttctgagcttgaccaacatcaatttgttttccattgagcttctttctgttcatctcatctgcgcatctttatgcctttcaaagctgacaaatccaaaacctttgggttttccactttcattaaccactactatcacacttaagacagatcccaacttgccaaagagatctttaaggcacctaccatccatgtcttctccaaaaatcttcctgtaaacattggtgaactctttaactctgagttctgcttctcattgtttacaagacttaatccaacaaagactttgctatcatttagaagcatccatttcatttttgaatagatctttcagctgcttctgtgtctcaaaatgtacagtgccatcacccttgaaaccgttttcaccacaaagcacctaatgtgaaagtgatggagacaggaggcagccaagggtcccctggtaaaaccccaccttcaagactaaaacagcctgaaggctgataaactggactgcaggtccgggttgaagccgccctttcctcactgattctgaataatgcccacctgcgcactgggattacggggtggagcctcgggaagtttgtgcagtgtgcagtggagaggagtctggcctgttcccatgtagtgacctaggatttaatctatgaggcgggaaacccgctagcaggactctttctctctttgctaagagttatttttcctttttcctttccatccaataaactccgttccccctcacccttcaagtgtttgcgtgccttttcctggtggtatgacaagaacctggttttttctgcaacaaaaagatgttaccaaaagcagatgtatcatggaatgctttataatcaatagatttgtccaatttttttatgaacatgttgcccactccatttttgcggagtgatggatcacaccgagactacttagtgtgtattggctagtcttttataacatcaaaattcatggggtcttaaggacattccacatcctgcgtttcccaaggagcgccggtgatctggttcctgtagcccgggatagagaggaccagccagcaggcctggtcacgtggggtgcgaggacaggggatggctgggacgctgggctcacctcttcacctgtctgccggtagggccacaggctgcgacctttccgtgaaaggagagtaagggctggggcggaagcctgggccagggcagagagacaaaatcacctggaatctaaaactactccacggccgaggaactgcggcctgcagcgggctgggacgagggtggcggtgtagggtccagcgtccaggcctcgggatcctgttccttcttgaagctgcttcggagctgcgagtgggcgggtgggtcgctctcggctgcctcacgggtaatcttatacaagaagaaaaggaaaatgtctctggcagtgaagacaaggatttttttgtacagtgttttgcaggggtgatgggtgttaaaatagaaacctttttttttttaagttttttcatgggtttttttcaggggaatgggttttccaagataataaatatgtgctgatcctggagaacacactccacactctcggcactaaccgcttgggagaagggacccattaatgtttaattgtaccttctcttgtggccccgttatttcccttttaattatgaaacattggagcctacagaaaggtagaaaaaatgggcacccacataaccaccacctaaatccaattaattgttaatattttgtcaagttttctttatgtaatttttcaatttgaattaaaagtaaattataggcatcatgctaatttgcctgtgtatacttgagcctgcatattcaaaaactaaagccattttcttgcataaccacaattcccttatcctttcacaccaagttatcagtaattccttacaattattcaactcccaaatattttcaaatataaacagtcatgccccatgtaacacatttcagtcaactagtcgaccatctacactgtggtggtctcataagattaaactggaacatatatagaaacttgataaacagtttatggcccttgatattggcattgcagctcaagtagaggaaatgactaatgctcagtagtggtgctggaacatttgattttccttataaaaaataaataagtgaaaatatatagggccggatgtagtggttcatgcctgtaatcccagtgctttgggaggccaaggtgggcagatcatctgaggtcaggagtttgagaccagcctggccaacatggtgaaaccccgtctctactgaaaatataattagccgggcgcagtggcaggtgcctgtaatcccagctactcaggaggccgaggcatgagaattgcttgaacctgggaggctgaggttgcagtgagctgagatcgcaccagcactccagcctgggtgacacagtgagactctgtctcaaaaatatacgtatatataccatctaggtttgcataattacaccctatgattcacattttcttaattgttttccaattatagcaatttttaaaagccatgatccaatcgagaactggacactacattttgtttttgtctcttattttgtaatccagtacatttctccatacttaatcccttgctaaatggcatagacttttttttttttgagacggagtcttgctttgtcaccgggctggagtgcagtggaatgatcttggctcactgcaacctctgcctcctgggttcaagagatactcttgcctcaccctcctgagtagctgggattacaggcccctgccaccacggccagataattttttgtatttttactagagacagggtttcaccatgttagccaggatggtcttgatctcctgacctcatgatccaccctcctcagcctcccaaagtgctgggattacaggtgcgagccaccgtgcccagccggtattgacattttaaaggaaccatgctagttgtcacgtagaatatctcacattctggaattgtgggactgttcatggtttcatttagtttgtttgtctatcccctcaattttctgaaatttgaagttaaatttaaagacttggttacattcaggttaaacttttttggccagaatcattcaaaggtgatgttgtatacttccaatagtggcacattacgaagtttatgtctggttgtcccactgccagtgatgttaattttcattcctaaattaaggtggtgattgccagatgtctatatcgttaatggtatattttcctctttaattagccagtgatgtctgagattataccttggtactacatgaatatttattcttcatcaaatttctcaaaattagtagactttgttttttagagcaattttaggtttacagaaaccaatgagcagaaagtacacagagttcccatgtaacactaccttcctatcccactctccacccaatccctacctctgtacacaatttcccctattattaacaccatgtattaatgtggtatattggttacaattgatacatattgatacattactataactgaagtccatagtttacattagcgttcactctttgtgttgtaaagttctgtgaattttgacaactgtataatgacagatatccaccagtatcatatagaatagtttcatcaccataaaaatcctctgtgttccacctatgtatccctctcttactttctgcaaattgctgaaaaccactgatgtttctacattatagtattgccttttccagattgtcatacacttagaaccatacaatatatagccttcttatgctggcttcttttacttagcaatatacatttaagtcttctccatgtcttttcttagcttaatatctgatttctttttagtgctgtataatattcccttgtctggatgtaccacagtttgcatagccattaacctactgaaggatatcttggttgcttccaagttttggcagttatgaatacaactgttataaacagccgtgcacaggtttttaaggttttaacaaactctccctggcagtttctgtttttcctcacttttcaagcccatggactatctcccagtgctgttcattttaatattctgcagagtacttaagcattacagaatatagaagctggaagatacttggcagtcatttagtccctcatgttctagatgagaaaactgaagcccagataccttattatttgtgcagtcccctaatctgagtgtcaaatccacctctcccagatgttttctgttcaaataaccctgtgaacttcagtgaccctcactgaccacatcatcattattcaccaatagttctccaacagatccgctctacattagctcatttcaaatgttcttttcctttcacgcacataccatacagtacttaaaattttgttgacaacaatcaatatgaattcaaactaatttcttgccccaaggatgtgacttctactacacagttccttttggcctgagggcaattcctagggcatgaacttagtcatgtgccctcaacagacagcactctaaggaagctggggaatgagggtctccattctgcagggaggcctggactacacaccacagaagacactactctgtccatccctcgtgtcatttggatccatgacttcatataacttctctccatctaggaatagctcctccaggattttggttggtttcttttgctggggaaatgtgaaagtaacattcatggagggaacaatagctccttggctcttcaacttgtcttttatcagtgataaaagtgatcatctgcctttcctacgatacaggtactatcaggtttacattcttaccctcagctagcacctccactggtctaggtcacttacctggagataggagaggagggtgtagtagccatggctactagacttgtccttttaaattgagcaatcaaaatttagtaagggactacttaaacatcccttggctgccaaacacattcctgtctgcttccgttgtgtaacagcattgaattgcagagataagaagcagaaatttcctaagtgaatccctgggggtgacggtaaatagtgctactctttcttcaatccatggtcctctttctattagcgacatgggaccatataatggttactgatctaggatatatgcttgtatcccatccctgcagcttcaaagggctactggagactgttccatcactccatcagtttgacagcttctagttgttgtgatttcgtgatttgtaataggatcactgaattgcattttcatgtgtccaccactgcaactacagtgctacaaagtgcattccctttatacagtgctataaagtacaatgcaaggatgtgtaggattccatactggaggattaaacattctgtcaacccttggatagtggtgctggttgaggccatgtaagtaggaaagataaatccatactcagaataagtatcagttccagccaagatgaatcattacccttcctgtgatggaaagaatccagtgcattcagcttgccaccaggtggcaacttggtgtccttgagggatgatgctatcttgaggcctcagtgttgctctgtcttgatgacaactttgacattcagaagcagcagtagctagataagacttagacagtggagacttctgctgtttgggcctctgcatagcctccatccttgtcactatatttattcaccagtactgagctggccaatggaagaggatggctaacatcatctggctgagtcgcttttctccttggttgttgatagatacctcttgtaggtgttaacatgtgaaacaaagatcttcatactttttgtacatccccataagtccacccatatgcccttttctcagatgtctttttctccagtcatccaaattttctccttccatccccctgacctgtagccaagccatttgaccatgagtcagtacattcttactatgagtctcttctctttccatgcaaagtgaatgacaaggtgcgtagtgcaaagttctgccaactgaaattttttaatttttttattttttgagacagagtcttgctctgtcaccaggctggagtacagtggcgtgatctcggctcactataagctctgcctcctgggttcatgccattctcctgcctcagcctcccgagtagctgggactacaggtgcccgccaccacgcccggctaattttttttgtatttttttagtagagacggggtttcaccatgttagccagaatggtctcgatctcctgacctcatgatccactgccttggcctcccaaagtgctgagattacaggtgtgagccactgtgcctggccaagaatttatttttgagttgaatttttaaatattaaaactttttaaatatacaaacaaaaattgtatatatttggagtgtacaacctgatgttttgaaatatggatacagtgtgaaatggctaactcaagctaattaatacatgtgttacctcacatacttatcatttcttttgtggtgagaacacttaaaatctactgtcctagcaattttcaagtatgcaatacattgttattaactgtagtcaccatgttgtacaataggtctcttgaacttgttcttcctgcttaatttttgtatcctttgaccaaaatctccccagttctaccctcctccccccgcccctaataaccattattctattttctgcttctatgtgtttgacttttttagattccacatataagtgagattacatggcatttatctctctctgcctggcttatttcacttaatataatgtcctccagtttcatccatgttattataaaggacaggatttccttctttaaggctgaacaatatttcattatgtatatatacaccacattttctttaatcattcatctgttaaaggatacttaggttgatttcatatcttgtctattgtgaataatgttgcaatgaacatgaggtacagatttttctttgacatactgaatcattttctttgggtatataaatagtactaggattgctggatcatatggtagttttatttttaactttctgagaaacctctatattacttttcataatggctgtactaatttacattcccaccaacagtatacaaaggctcccttttctccacatcctcgccaacacatgctatcttttgtttttttcatagtagccattctaaaagggacgtctcattgtggttttgatgtgcgtttccatgatgactggtgatgttggttattttttcatattcctgttggccatttgtatgtcttctttggaaaaatgtttattcaggtactttgcctccctttcattaatcaggttatatgttttcatgctgttgagttgtatgaatactttatatattctggatattaatcctttatcagatgtatggtttgcaaatattttctccctttttgtaggctatctctttactctattgattgctccctttgcttgcacagcttattagtttgatataatcccttttgtctatttttgcttttgttgcctgtgctttgggggtcatatccagaaaatcattgcccagaccagtctcatggagcttttcctgtatgttctcttctagtagttttatggtttcaggttttatatttaagtctttagtccatttgtgttatttttttgtatatggtgtgagataagggtctaatttcatttctctgcatgtggagttctcccaacaccatttattgaagattgtcctttccccattgtgtattcttggcatatttactgaaaatcaattggccataaacgtgaatgtattttgaggctctctattctattccattggtctaccagtctgtttgtatgccagtatcatgttatatttttgattactatatcatcatagtatattttgaaactggataatgtgatgcctcctactttgttcttttggctcacaatttgctatttggggttttttgtggtttcacatgaatttggggatttttttctgtttatgtaaaaaatatcattggaattttgatagagattacattgaatctgtagatcacttttggtactaagaacattttaacagtatgaattcttctaatccatgaagatgggatatgtttccatttatttgtgtcttcttcaatttctttcaccaatgttttatagttttcagtgtacaggtctttcacctccttggttaaattaattcctaagtatttgtgtagccattataaatgaaattgttttcttgatttctttttcagatagttcattgttagtgtatacagatgctagtcgtttttttatgttgattttgcatcctgcaactttactgaattaatttactagttccaacagtttttttttggtggactctttagggttttctacatttaagatcatggtgtctgcagagacaatttcacttcttcctttctgactttaatgcctttatttcttcttcttgactaattgctagaacttgaatagaagtggtgaaaatgggcatccatcttgtttctgatcttagagaaaaagctttcaactttttaccattgagtatgatgttagctgtgggcctatcacatatgcctttattgtgttatgtggacattgatacctaatttgttgaaagtttttattacagaaagatgttgaattttgtcaaatgctttctctgcatccatggagatattcatatagttgtcgtccttcattctgttaatgtgtatatcacatttattgattcgtatatgctgaaccgtccttgggaggatttaatctactgctatctttccatagctgaagtaggctgctatcattttttacttacatccgcatgctgagttgatcttccaatgaacaagcttagcttttttcctcctttatcaatattggaactcccacataggcagagttgccagctgagggagagaatctagtgtcacaatttggataatgtggggacctggatcaccttatcatactgcttacttgtgtcctctagtctttctcatgcccaatccttgatgtgatatggtttggctctgtgtccccacaaaatctcatctcaaattataatccccacatgtagagagagggacctggtgggaggtgactggatcatgggggcagtttccctcatgctgttctcatgatattgagtgagttctcatgagagcggatggtttaaaagtgtttggcacatccccccttgctctctgtctctcctgctgccttgtgaagaaggtgcctgcttcacctttgcctttagtcataagtgtaagtttcctgagacctctccagccatacggaactgtgagtcaataaacctcttttgtttattaattacccagtcttgggtagttctttatagcaatgtgaaaatggactaattcaatgtgctacttctattttattatgatttgttgctgggccagcctgtccttatgatctggtagatctaacaaaaccaaactcacagtgggaacttttagctacatggtcacttaatatttgttgtcagatagtccatctctacctaggtgcagtagcatgctaggagctattaaagtacacaattatgctatatatttatacaatatacaattatttgcagatagcatgaccatgctagtgaaccccacaagactatgtgtgaatcatctattagggtttgctataaactctacgtggtgctttttccaactgcatatatttctaataccatagagcctactagattgtatggctcaaacagtagggctgcttgccctggatcctggacctgctgcagaggccttttctgccgtaagcttttgtcaaaagtggaagccttctgtgtcactcagcaaatgtgtcagaacagtattccttagtatggggggggaacaatgggccccctaaaatcttctgtgactgatgtcacaggtccttaaatcttcagatgattttctctctcagggatgcttgtgtctctctaggccatccaacatgttatttcttacccagtctattttaactggtaaataaaatggaaaaatgtaacatgctacagaatgtccagacagctcaggtctctggactacattaggacagagagtcaaagaactaatatacatcttggacaagtctctaaatgcatgctgttgtccttcccatgaatgtgaattgcttctggtaaatttcactgtaagtactgcttcagttattttacatatatattgatcggtaatcttttcattttaattcaattttaagcatgttctaatttttattataatttcttcttgcttccatgaatcatttggaagctatttgtagtttctaaaattcatggattacttttggataagtttttgttattgatttctaatagtgctattacacatttgttataccaatgtaaacatttgatactatctttaggcctaatatctggtcaatttttgtaaatactccaagtgtgcttgaaaagaatcaaaattctttaactgttgattagccttactaattttatgtttatttattcaattactaaaaatgaaatgttaaaatatctcactgtgtagatttttttattgctctttccaattctaattttggctttatttattttgagactacattattaggtatccacaattttataaaaattaagaaaaaattagaaaagtttagaaaaaaaatagaaaaatatagaaaaagatgtgaaagaagcacacatgggctttatctggatgatctcttgtcaggtttgtatcctggggaaggccttcacagcaagagatggaccagaggattgagacaagggggccaccactcagaaagggaggagggcaaaggaactcctgagggaggaaaggatcagagaggaggctttcatgtctcagtgatatcactcagcagcatggcatggagtctgtagttcacagagttccaaagagcagaagcagtttggggtctttacagcctagagtttatctgtggcaagcagattttggatgtagtttcccagggcatgtaaatcaggcaggctctaaatgcctacaaatatgcatgtctgggctatgtttaacacaattggatgtttaaaaatttgagtttggtgccagttggtttttgagctaatgggtttcagcttgctgtgaagaaataacctaggcgccaatacacagaggccatccttgtctcatttacattatatgcagtgactctatccttttttgctcataattgttttattcatttcttttagatttgtttactttactgagattatttggtaggtaagatttcagtttattgtagtttgctaattcattattcaaagtgttctaataaaaattttgctccatccttaatccccatttaaacaaagctgctgtgggtaaggtcatcaatggccttcgtgtcatcaaatccattttgttaacaaaattttaatgtttaaaattttcttatgtgtacacgtttaatttatgtaatttcaaaacggggtatcacacatggaatttggtagttttctttcctttttttattcacttactctgtttcttaatgctttactgtaacccacagcgcaatgtccccaatatttattatgtataactgatattcacatacaacatatttcgtcattaagtgttatctttttccacataggtgttcctgtctttagtcttctattttctctctctcccgcttctctcccacccttcctctctccatttacgtacgtatttaaatcattttaaaaatcattttatgtatcacttcaaagccttcagtgtaaattgagggtccaattttgttttctttgaattgtttattttcatatattaatttttcatctacatgtagattctcaattttttaccactcttgcttattcttaattaatacaattgtttttcttaattgatcaattccaatagttctatagtaggtgctgatatctggtgagaaaagttcctctcaatagtcttttttttggtacaattttctgactattcttctacatgaactttaagataatttaatccaattttaaaatgcttttgtgattctaatgttaatttaattgaatttatatataattttaggagatttatgcttttacaagagttttgttgtttgtttttttgagacagggtctcactgtgtcaaccaggcaggagtgcagttgtgggatctcagctcactgaagccccaacctcccacctcagcctcccaagtacctggttctataagcatgcgccaagcccaaatagttttttgttttgttttgttttgtttagagatagggtttcacaatttgccaaagctggtcttgaactcctgggctcaagcagtcctcctgcctcagcctcccaaagtgctgggattacaggtatgagccactgcgcctagcctcatgtgtttcttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatagtctcgatctcctgacctcgtgatccgcccgtctcggcctcccacagtgctgggattacaggcgtgagccaccgtgcccggccatgtgtttcttattcaacagcttttggtaacatttttatagtttttttcttatagatcttctttcttggtaaatttattttacctttattatttttgttattgtgaatatttttaccattagcatttcaaggtgcttattgctaatatattttgtattatgatcttatttccaaatgccttaccaatattcctctttaaaatatttgaaagttctgtttttcctaatctctatgatttcctaggcatataatcatatccacaaaaagctttctatatatttatactgattatttcatttaaaaatcttgttacattcatggatcctccaagataatctttaataacaaatactgacagcagctattcctgctggttccttgttttatttgaaatgttcctttatgatttaaaatacttgttttgtaggcatttcataaatagcggttatgtttagacactttccttcaatttctattttactcaagaatcttcattaggagtggatgtttaatcttaacaatagccctctcagcatctactgatataatcacattttcctcttctttgatgtcaattatgtaattgtgttaatatacttaactgatattgaaatacccgtgaattcctgaaatacaatgctctttgcatactgtattactcttttttgttgttgcaattattgataaaagtgctgggtttttatttagaatattcattcatatgtataagtcagattggtctatagttttggtttttttgttttttttttttttgttttgagatggagacttgctctgtcacccaggctggagtgcagtggcgtgatcttggctcactgcaacctctgcctcctgggttcaagctgggattacagacatgcaccaccaagccgggctaatttttgtatttttagtagagacggggtttcgccatattgtccaggctggtcttgaactcctgaccttaagtgatccacgtgccttggcttcccgaagtgctgggattacaggtgtaagccatggcatctggcctatagttttgtcttatgtttatcaggttttcatattaatgctgcactgcctatgtgaaatgaattggtttttcttttttaaaaatatttgggatactttaaataacattggaattatccttcttgcaaccctagtacttttttaaattatggatttaaaaaatcactttacattctttctttgtaactggtctattaacattttaaatttcttcttggattagttttggtcatttatatttttccagaaaattacccattttctctagattttccaatgtgtggccatatagttgcatgcagcatttcaaagtgaatctttcttttttcttttcttttttttttttttttttttttgagatggagtcttgctctgtggcccgggctggaatgcaatggcatgaccttggcacactgcaacctctgcctcctggattcaagcaattcttccacctcagcctcccgagtagctgggattacagacatccgccatcatgcccagttaatttttgtatttttgtagagacgagttttcacaatgttggccagtccattccattccattccattcattccattccattccagtccatttcattccattccattccattccattccatgacagtccattccattagagtccagtccaatcaattccattctattccattcgagtccattccattccattttattcgattccattctattccattactttcgaatccattccattccattccattcgagtccattccatttcattccattccatttcattccattcgagtccattccatttcattccattccattccattccatttcattccattcgtgtccattacattacattacattacattacattacattacattacattacattcgggtccaatcgattctgtgccattcttgtcccttccattcgattagagtcccctccattcctttgcattccattcgagtccatttcattgcattccatttcattcgagtccattccttttcactcaattccactcgagtcaattccaatccactccattccattcgagtacattccattccattcgagtccattccattctattccattcaaatccattccattccattccattccttttgattcgagtccattccatttcattcaagtccattctgttccattccactccattcgagtgcattccattcatttccattccattccattccttttgggtccgttaaattcaactgcattccattccattccgttccattccattccattccattcgggtccatttcattccattccattccattcgtgtgcattccattccattagagtccattccattccattaattttgattccattccattaattttgattccattccattccattccattctattccattagtttccattccattctattccattagagttcattccattccataccattccattccattccactcctttccattccatccaattccatgccttgccattcctttcgattccattccatttgggtccattcaattccattccatttgggtccattccattccattccactccattcgggtcctttccattcctttccattccattcaagtccctttctttccattccattccattccattctggttttttccattccatgccattcaagtccattccattccattccattcaaatccattccattctactagagtcaattcctttcgagtgaattccattccattccattcgagtccattccattccattacattaaattagtgtttattccatcccatcccattcgagttcattcaaatccattccaatccattcgagtccattccattgctttccaatccattcgaatccattgcattctattaaattcaagcccattccattctgttcaattccattcgagtccagtccattccattctgttccattgcattccattctattcgagtctgttccattccattccattccattccattctattccattcgagtccattccactgcattccattcaggtccattccattcccttcctctagagtccattccattaaatcccattctattccattcaagactcttccattccattccattccattcgtttccattctattccatttgagtccattccattccattccttttgagtccattccattcaattccattctctttcaatccaatcaagtccagtccattccattccattcctttccattccattcgattccattccattcgggtcagttccattcctttcccctcctttcgggacattccattccattctattccattcgagtccgttccttttcattgcattcaattcccttcaagtccattccaatgcattccaatccattcaagtccattccattgcattccattccgttcgagtccactccattgcactcaagtcatttccattccattacatgccattcgaatctattccattccattccattccattcgagtccattccattgcattccattccaatcgagtccaatctactccattctattccattcgagtccattccattccattccatgagattccattccattagagtccaatccattaaattccattctattccattcgagtaaattccattccattccattcctttcgagtccattccattccattccattcaagtccattccattccattccattgcatttgagcccattccattccattccattccattccattccatttcattcatgtccattccattccatttcattccattccattccattccattcgggtccatttcattccatgccatttgtgtcccttccattccatttgagtccatcccattccattctattccatttaatttgaggccatttaattgtattccatttcattcgagtatgttccattccactccattccacacgagttgattccattccactccataccattcaagtccatcccaatccattccagtccattccattcgagtccattccatttcattgcattccattccattccattgcattccttttgaatcatttcaattcaactgcgttccatgcgattccattccattccattcaattacattcttttcgggtctattccattcgagtccattccattcgagtccattccattcctttccattcgactccattccatttcattctttaccatttcagtcctttgcattccattccatttgagtccattccattgctttccattccttttgagtccatttctttccattgcattccattccagtcgtgataattccatcccattccattcgagtctattccattccattccattcaagtccattccattccactcgagtcaattccattcgagtcaattccattccattacattcgagttcattccattccattccattccattagagtttattccatcccattcctttcgagtccattcaaatcaattccattccattcgagtccattccattgcattccattccattcgagtccatttcattctatttcattagtgtccattccatccataatattccattcgtgtccagtccattccattggagtccattccattccattccactctcgtcatttccattccattccattatattcaagtccattgcattcctttccattccatgccattccactcaagtggagtccattccattccattcgagtccattccatttcattcgtatccattccgttctattccattccattcgagtccatttcatttcattgcattccattccattccattcctttcgaatcaattcaactgcattccatgcgagtccattccattccattccattccattccattcagttagattcctttcgagtccattccattcgagtccattccattcatttccattcgactccattccattccattatttaccatttcagtcctttgcattccattccatttgagtccattccattgctttccattccatttgagtccatttctttccattctattgcattccagtcgtgataattccaacccttttcattcatttgtattccattccattccattcaagtccattccattccactcgagtcaattccattcaagtcaattccattccattacattcgagttcattccattccattccattagagtttattccatcccattcctttcgagtccattccattccattccattccaatccattcgagtccattccattgcattccattccattcgagtccattccattctaattcattcgtgtctattccatccattatattccattcgtgtcccgtccattccattcgagtccattccattccattccactcgagtcatttccattccattcaagtccattccattccattccactcaagtggattccattccattccattccatttgagtccattccatttcattcgagtccattccgttccattccattggtgtccattccattccattccattctaatccattccattcctttcgggtacattcaattcgactgcattccattcaagtccattccattccatttcattccattccattccattcgggtccattccattacattcatgtccattccattccattcgagtccattccattccattaattttgattccattctattccattccattctattccattagagtccattccattccataccattccattccactccataccattccattgcattccattccactccattccattccattccattccattccattccattccattaaacgccttgccattccattcaattcctttcctttcgggtcctttcaattccattcaattcgtgaccattccattccattccactccattctggtcgattcctttcctttccatttctttcgagtctatttctttccattccattccatttcattcgtcttaattccattccattccattcagcttaattccattccattccattcgagtccattccattccattccattagaatttattctatcccatcccattcgagtccattcaaatccattccattgcatttgagtccattccatttcaatccattcgagtccattccattgctttccattccattcgaatccattccattctattacattcaatcattccattccgttccattccattcgtgtccagtccattccataccattccattcgagttcattcctttccattccattccatttgcgtatattcgaatccattccattcgagtccattccattccattccattcgagtacattccgttccattccagtccattcaaatccattccattccattccattccattcttttagagtccattccattaaatcccattctattccattcaagtctgttccgttccattccattcgagtccattccattccattccattcgagtacattccgttccattccagtccattcaaatccattccattccattcttttagagtccattccattaaatcccattctattccattcaagtctgttccgttccattccattcgagtccattccattccattccattcgagtacattccgttccattccagtccattcaaatccattccattccattcttttagagtccattccattaaatcccattctattccattcaagtctgttccattccattccattccattgcattcatgtccattcttttccatccccttacattctagtcaattccattccacctcattacatttcagtccattccattccatgccattccatttgagtccattccattcgattccattccgttccattccatttgtatccattccattccattctttcccatttcagtcctttgcattccattccagttgagtacattccattcctttccattccattcgagtccatttctttccattacattcatgataattccattccaatccattagagtccattccattccattccaatccattagagtccattccattccgctcaagtcaattccgttcgagtcgattctattcctttacattcgagttcattccattccattccattccattagagtttattccatcccattccattcaagtccattcaaatccattccattccattctagtccattccattccaaatcattcgagtccattccattgcattccattccattccagtccattccattctatttcattcgagtcctttcaattccattccattccattcgtgtccagtatattccattcgattccattccattacattccattccagtcaattccattccattccattctaattgagtacattccattccactcgagtccattccattcaattccattcgagtccattccattccattccattctattccattcgagtccatttcattccatttgactccattacattccatttcatttgaatccattccattccattccattctattccattaaagtcctttccattccactccattccattatatttgtgtccattccattccattcaagtccattccattccattctttccattcgcgtccattcctttccattccattagagtccattccattaatgcccaaaccaatgaattccattctattccattcgagtccattcaattccattccattcccctcgagtcgtttccattccattccattccacctgagtcggttcctttcctttccattccatttgagtccgtgccatttcattcgagtccattccattccattccattccattccattcgagtcccttccattgcattccattttagttcattccattcctttcaggtccattcaattcaactgcattccattcaggtccattcaattccattccattccattccattccattccattacgttccattccattccattcatgtcgattccattccattcgtgttcgttccattccattaattttgattgcattccattccattccattctattccattagagtccattccatttcataccattccattccatgcctttccattccattcgattccattccattgggttccattcaattccattccattcgggtccattccattccatttcactccatcctggtccattccattcctttccattccattcaagtccatttcttttcattcaattccattcgggttaattcaattccattccattcgcgtccattccattccatttcactccattctggtccattccattcctttacattccattcaagtccatttctttgcattctattccatttgggttaattcaattccattccattcgagtccaatccttaccattaaactccattccattccacttgagtcagtttcattcgagtgaattccatttcattccatttgagtccattccattccaatccattccattagagtttttcatcccatccctttcgagtccattgaaatccgttccattccattcgagtccattccattccaatccattcgagtccattccattacattacattacattacaatccattccactctattacattcaagtccattccattacgctccattccattcacatccagtccattccgttcgagtcaattccactccattccattccatttgagtacattcaattcgattccattcctctcaagtccattccattccattctattctattccattccattccattccattcgagtccattccattccattccatttgagtccattccacttcattccattccattccattccattcgagtctattccattccaatccatttcttttggttccattcctttcaattccattcgagtcaattccattccattccattcgattccattccactgcattccattttagtccattccattgcattccattacattcgagtccattctattctattcaattcgtgtccattctttgctttccattagattccattcgattacagtccattctgttaaattccattccattctatccgagtccattccattccattcaagtccattccattccattgccgtcaagtccgttccattccattcaattttattccattcaagtccactccatttcattccattccattcaagtccattccatgccattccattccatgcgcgtccactccgttccactgcattcaagtccattccattccattccattttaatcaagtccactaaattccattctattccattcgagtcccttccattgcattccattcgagtccattcccttccattccattacattagagtcctttccattaaatcccactctattccattcaagtctattccattccattcgtatccattctattccattggagtccattccataccattccattccattccattcctttccattccattcgattccattcaatttgagtccattccattccaatgctttcgagtccatttctttccattccactccattcaggtccattcaattccattctattccattcgagtccattcctttccattgcattcctttccaatcgggtccattccattccattcctttcaactccattccattccattccaatccattcgagcccattccattccattccattccattccattctcattcaatccattccattccattccatttgggcccattttattccattccattcgaggacataccatttcattccattctgttccattcaagtccatttcattccatactattccattccattccagtccatttcattccattccattcctttccattccattcagtccattccattcgaatgcagtggtgtccattcctttccattctattgcattcgagtccattccattccttcccattaaattcgagtccattcctttctatgcctttccttttgggtacgttccattccattctaatgcattccattccattccatttgggtacattccattcaattccattggagtctgttccattcaattccattccattcgggtccataccattccattccattccattcgagtccattccacttccttcgagtccattccattccattcaatgccattcgagtccattcctttccattccattccattcgagaccatttcataccaatccattcctttccattacattcggtttcattccattccattctattcgagtacattccattgcattccatttcaatcaggtccattccattccattccattgcactcgagtcgattctgttctattccattccattccattccattccaatcctttccattccattcctatcgagtccattgcatttaactgcattccattcgagtccattcctttccattccattccattcgagtccattccgttccattcgggtgcattccattccattccattccattcagtccattccattcctttccattccattccactcgagttcattgcattccattccattacattcgagtccattccattccattccattccattctagttcaatccattcgattccattccattcgggtccatttgattccattccattcaagtacattccatttcattccattcttttccattccattccattccattcatttcaattccattgtattcctttccattccattccattccattccattccactccattcggctccattccattcaattccattgcattccattcgggtccattccattccattccattccataccattccattacttttgggtccattccattcgagtccatttgattgcattccatttcattcgagtccacttcattcgaatccattcctttcgagtccatttgattgcattccatttcattcgagtccacttcattccatttgaatccattccattgcattccattccattcgagtccattccactttattccattcgagtccattccattccattccattcctttccattctagttcaatacattcgattccattccattctggtccattttaatcctttccattccagtacattctatttcattccattcttttccattccattccattccgttccattctattccattccattccattgcattccatttgggtccattccattccattccactccattcctttccactccatctggctccattccattccattccactgcattccattcgggtccattccattccattcaagtccataccattccatttcttttgggtccattccattccattccattccagtccattcgattgcattccatttcattcaagtccacttcattcgattccattccattcgagtgcattctattccattcgagtccattccattccatgtgagtccattccattgcattccattccattcgagtccattccactttattccatttgagtccattccattccattccattccaatccaatccattccattctgctccattccattccataccattccattgctttcggttccattccattccattccataccattccatttctttcgggtccattccattccattctattgtcatccattcctttccgttccattccatttgaggccattccattccatcccattacatccaagtccattccattccatgccattactttcaagtccattccataccattcaattcaggtacataccgttccattccatgagagtccattccattcccttccactccattccataccattccattccattccattccatttgggtccattcaattccattcctttcgagtccattttattccattccattccgttccattccattggaatccattccattccattccattccataccattccattccatatgagtccattcaattccattcctttcgagtccattgcattccattcgagtacattcctttccattccattccattcgaggccattccattctattcccttccattacattcgagtccattccactggagtccattccattccattcgagtccattccattctattcccttccattacattcgggtccattccactggagtccattccattccattcgagtccattccattctattcccttccattacattcgggtccattccactggagttcattccattccattagagtctattcctttccattccattcaattccattccattcaggtccattcctttccattccattcgagtacattccacttcattccatgctattccattcaagtccattccattccacactattccattccattccattccattccattcgggtccattccattccggtcccttccattccattccattccattctggtccattccattcgggtccattccattccattccattggagtccattccattccattcgggtccattccattccatcccattcgagtccattccattccatcccattacttttgagtccattccattccatcccattacattagagtccattccattccatcccattacattagagtccattccattccactctattccattccattcgtatacattccattccattccattccattggattccattccattcaattccattccattcgagaccataacattccattcgattccattcgagtccatttcattccattccatacgactccattccattccattccatacgactccattccattccattccgttccattcgagtccattcctttcccttccattccattcgagtccattccattcctttccattacttttgggtccattccattcccttcctttagagcccgttcgtttgcattccatttcattcgagtccagtccattccattcctttcgagtccattccattccatttgagtccattccattccattccattcgagtccattccatttcattccattccatttcagtccattccactttattctattcgcgtccattccattccatgccatttcattccattccatttcagtccattccactttattctattcgcgtccattccattccatgccatttcattcatgtccattccattacattcgactccgtttcattctattccattcaagtgaattccagtccattgcattgcatttgagtccattccaatccgtaccattcgagtaaattccattcctttcaattccactcgagtccattccattccattctattccactcgagtccattccattccattctattccactggagtccattcctttccattcttgtccattccattccatttcatttgagtccaataaatttcattccattcgaatccattgaagtccattccattccattcattccattccattccattcattccattccattccattcattccattccattccattccactccatttcacaccattccattccagtccattcttgtccattccattccattagtttcgagtccatttcattcctttctattccattcgagtccattccattcctttccattagagtccattccattatagtataatcctctaaattccattctattgttttcaactctgttccgttccactccattccatttctgtccattccattccattccatttgagtccattccatttaattccctttgattccaatccattccattccattctattccacacaattcctttctattccattccattccattgcattcctacccattcctttccattccattccattcggttccattctattccattccattgcattcgagtccattcctttcttttccattccattactttaaattccattcgagtccattccattccattccaatccattcgaatccattccattccattccatttgagtttaatccattccattccattccatttgggtcctttccaatccattccattcgagtatattccatttaattacattgtgtcccattcaaatctattccatttcatatcattccattccattccagtccatttcattgatttccattccattccatcccattccattccattccattggagtccattcgtttccattccattgcattcaaatccattccattccatcacattaaattcgagtccattccattccatgccattatattcaagtacgttccataccattccattgcattccattccattccattccaattgggcacattccattaaatttcattagagtccattccattcaactccattccattcaaatccttaccattccattccattcgagtcaattccattcaatttccttcgagatcattccattgtattcaatgccatttgagtccattcctttccatttcattcctttcaagtccattccatgccaatccattacattccattacatttgggttcattccattccattctattcgagtccattccattgcattctatttctttcgagtaaactccattccattcaattgcactccagtcgattccattctattccattcttttcctttccattccattcctttccattccattcctttcgagtccattccatttaactgcattccattcgattccattcctttccattccattctattcaattccatttcatttgagtccattctattctattccattccattagagtccattcgagttcaatccattcgattccattccattcgtgtccattttattcaattccattcgagtatattccatttcattccattctattccattcaagtccattctattccagtccattccattccattccattccattccattctattccattctataccattccattccattcgggtccgttccataacattccattgtagtccattcctttccattccattccattcgagtccattctgttccatcccattacatccgagtccattccattccatgccattacattcatttacattccataacattgtattccatttcattcgggtacatatcattccattccattggagtccattccatcccattccattcgagtccattcctttccattccattccattcgagtccattccattctattcccctccattacatttgggtcctttccattccattccattcgagtccattccattccattcaagtccattcctttccattcctttccattccattcgggtccatttcattcaaatccattccttttgagtccattctattccattccattccattcgagttcaatccattcttttccattccattcggatccattccagtccattccaatcgagtacattccatttcattccattctattccattcaattgcattttgttccacaccattccattccatttcggtccattccattccattccattccattcctttcgggtccattccatttcattcaattccattccattccattgcattcgggtccattccattccattccattggagtccattccattccatctcattccattctattcgaatccattccattccatcccattacattcgagtccattccatttgatgtcattccattcgagtccattcgattccattccattccattccattccattccattccattgatgtacattcccttccattgatgtacattcccttccattgaattggagcccattccattcaattccattccattcgaatacataacattccattccattccatttgagtccattccattgcattccatttcattcgagtccactccattaaattccattcccttcaagtccattccatgccattccatgctattcgactccattcctttccattccattccattcgagttcattccattccaatccattacattccactacattcggttccattccattctattcgagtccattccattgcattccattacattcaagtccactccatttcaattcattccactcacatcgattgaattcctttccattccattccattccatgcctttccattacatcccattccatgcctttccattccattctattccattcctttccaatccattcctttgtttccattccattcaactgcattcaattcgagtccattcctttccatcccactccattcaattccattcgaatgcattccattccattcgagtccattccattccattccattgaagttcagtccattcgattccattgcatttgggtccattccattccattccattcgagtacattccatttcattccattctattccattcaagtccattccattccataacattccattccattcctttcgattcaattcggttccattccattccgtttcattccattccattccattcgggtcaattccattccgttccattgtagtccagtcctttccattccattccactcgagtctattccattctatcccgttacttccgagtacattccatcccatgccgttaaattcgagtcaattgcattccattgttttccattccaatccattccattccattccatttgggtatatcccattccattccattggagtccaatccattccattgcattccattctattccataaaactcccttccattccattccagtccattcaattccactgcctttgagtccattccattccactccattccattcgaatccattcctttccattccatcccattcaagtccattccattccattcccttctataacattccggtcctttccattccactccactcgagtatattccattgcatttcctttcattcgagtccatgccattccattccattccagtcgagtcgattccattccattccattcgattccattccattccattcgagtccattccattccattagattccattccactccattcatttcaattccattgctttcgagtccatagcattcaactgcattccattcgagtctattcctttccattacgttccattccattttattccattcgagtccattccattccattccattcgagtccaattcattccattacattcgagtacattctattgtgttacattccattcctttgcagtcctttgaattccattccattccatttgaatccattgcattccattccattcgagtccattccattctcttccagtcgagtccattccatttcaatccattagattccattccattaaatttcgttccattccattcgagtctattccattacatttcattcaattcgagtccattccatttgagtccattccattccattccttttgagtccattccattcctttccattcgaatccattccattccattcccttcgagtccattccattcctttccattcgagtccattccattgcattccattccattcgagtctattccactttattccattcgagtccattccattccattcgcgtccattccattacattcgactccattccattctattccattcaagtgaattccaatccattccattgtattcgagtccattccattcaattccactgagtgaattccattccattccattccactcgaatccattcctttccattgcattcatctcaagtccatttcacttcattccatttgagtccattccattccattccattccattcgagtccattccattccattccatttgtgtccattccattccgtttctttcgagtccattccattccattccattcattccattccattccagtccatttcattccattctattccattccattccattccattccattatattccattcgaatccattgcattcctttccattagaatccattcccttagagtccaatctggtaaattccattctattgcattcaactccgttccattccactgcattccatttgagtccattatattctattcgagtccattccattcaattccattcaataccaatccattccattccattctattgcattaaactcctttccataacattccattccattgcattctagtccattccattgaaatccattccattccattcgtgtccagtccattccatttgagtccattccattcaattcgagtccaatcctttccattccactccattcaattccattcaattccattccaatccattccaatgcattcgagtccatgccattccattccattccattcgacttcaatccattccattcacttccattacattccattccattcgagtacattccctttcattccattctattccattcaagtccattccattccatacaattccattccattcttgtccatttcattccattatattccattccatccattcgactccattccattcggtccattccattctattccattggagtccattcctttccattccattccattccagtccattccattccatcccattacattcgagtccattccattccatgccgttacaatctattccattccattccattccaatccattccatttgggtacttccattccattccattggagtccattccattcaattctattccatttgattccttaccagtccattccattccattcaagtccattccattccattcccttcgagtacattccattccattccattccatgccattcgagtccattcctttccatttcatttcatttgagtccattccattcctttccattccattacattcgggttcattccattcctttcaagtccattcctttgcatttcatttcattcaagtccaatccattccattccatttcactagggtcgattccattccattgcattccattcgagtccattccattctattccattccgttccactccattacattccataacattccattcctttcctttcgagtccattccaatcaattgcattccattcgagtccattcttttcattccattccattcaattccattcgagtccattcttttccattccgttccattcaattccattcgagtccattccatttcattccattccatttgagtccattccattccattccattcgtgttcattccattccattccattccattccattcgaatacattccatttcattctattctattccattcaagtccattccattccattcaagtccatttcattcaataccattccattccattcgagtccataccattccattccattcaattccgttccattgctttctggtccattccattcctttccattggagtaaattcctttgcattccattccatttgaatacattccattccatcccattacatttgagtccgttccattccatgccattccattccatgcctttccattggagtccataccattccaatccattccattcggttacattccattccattccgttggagtccattccattccattcgagtccattccattccattcccttctagtccattccattccattccagtccattcctttccattccatttcattcgagtccattctattccattcccttccattacatttgggtccattccttttcattccattcgattccatttctttgcgttccctttcattcgagtccactcttttccattccattccaccttagtcgattccactccattcccttccagtccattccattcaagtccattccattccattcccttcgagtccattccattccactccactctaggccagtccgttcctttccattcaatccattcaagtctaatccattccattccattcgagtacattccattgcattctctttaattcgagtccactccatttcattccattccacttgagtcaattctattccattccatttgagtcccttccattccattcgaatccattccattccattccattcctttccattccattccttttgagtccattccattcaactgccttctattcaactctattctgttccattccattccattacattccattgcattcgagtccatttgttccatttcattcgagtccatttcattccattaccttccatttcattcgtgtcaattcctttccgttaccttccattccattcgagtctattccattccgttacattccattcctttcgagtccactgaattccactccattccattctaatccattgcattccattccattagagtccattccattctattgcattagtgtccattgcattcaattccactggagttcattcctttccattccattccattcgaatccattccattccagcccattacattcgagtccattccattccatgccattacattcgattccgttccattccattccattccaatctattccattcgggtacttccattctattccattggaatccaagtcacttaattccattccattcgagtccttaccattccattccattccattcgagaccattccattccatgcccttcgagtcctttccattccattccatgtcattcgagtccattcctttccattctatttcattccagttcattccattactttccattccattacattctggtccactccattccataccattcgaatccattccattgtattccatttcattcgagtccactccattccattccattccactagagtgcattccattccattgcattccatttgactccattccattccattcgagtccattccattccattccataccattccattcctttccattccattcctttcgagtccattccagtcaactgcattccattcaagttcattcctttccattccattacattgcattccattcggctccattccattccaatctattccattcgagtccattccactccattccattccattccattcgatttgattccattccattcgggtccattccattaaattccattccattaaattccattccattcgagtccactccattccattccgttcgaatccattccattccattcgagtccattccaccccattccattgcattcgattccattgcattccacactattccattcgggtccttcccattcaattccattcgagtcaattccattccattccattccagtccattccatctcattccaatccattctttttgagtctgttcaattccattccattcccttcgagtccattccattccattccattagagtccattgcattgcattccattccattcgggtccattccactctactcagttggagtgtattccattccattccattcgagtccattccaatccaatccattcctttcaagtccattccattccattctatttgagtccattccattccattccattgcattccattccattcgaataaatgccattcccttctgttccattctataccattccattccatttgagtcaattccatgccattccattccattccattccattcttttccattccattccattccactccattcaatgtgagtccattccattgctctccattccattcaagtctgctccattctattccattcgtgtgcattctattccattccattcgagtccattccattctattccattcgagtatattccattccattcctttccactcgagtctattccatgtaattctgttcgagtccgctccattccattggagtcctttcccttccattgcattcattctagtccattccattccatgctactccttttgactccattcctttccattccatttgagagcattcctttccaacccattcctttcaggtctgttccattccattccattcgaatacactccatacctttcctttccattcgagtctattccatttcttgccattccattcctttccattccattccattcgagtccattctattcaattccatttgagtcaattccattcaattccattcgagtccattccattacattcctttccattcaattccagtccactttatttcattcgagtgcactccattccattccattagagtaaattccattaaattccctagtataccatttgagtccattccattccattcgagtccattccattccattcaggtccattccattccattcgtgtccattccattccattcaattcgagtccattctattccattccattcgggtccattccactccattccattcgagtcctttccattccattccatttcattcctttcagttccattccattccattccattcgagtccattccattccattacattacattcctttcagttccattccattccattccattcgagtccattccattccattacattacattacattacgttcgtctccattccattccattccattctactcactttgtttcaattccattccattagtttctagtccattccagtccatccgagtccattccattccattcgagaccataccattccattccattaaattcctttctagtccattcgattccattccattccattttagtctattccattccattctattccattccatgccattccattccattcatgtgcattccattccattcaattcaattcgactccatttcattccgttacattccaatccattctattctattccataacattacattccgttcaattcaagtccattcaattccatttcattccattcgagtccactccattccattcacttcgaatccatttcattccatttgattatattccattcatgtccattccactgcatttcattctgttccattccagtccattccattccattccattccagtccagtccattcgagtccattcctttccctccgttcgagtccattccattgctttcgtgttcatctcattcgattccattccattccactccattcctttcaattccattcccttctattcctttcaaatccattccattccattacattctagtccactccattccattccattctattccatttgagtccattccattccattcgagtaaattacattccattcgattccattccatttcattccattccagtccattccattcaattctgttcaatttgattccattacattccattccattcgattccattacattcctttccattcgagtccattccattctattctcttccatttgagtccattccattccattccattccattccaacccatgtcatttgagtccactccattctattccgtttgaatccaatccatccaattccattccattcttgcaaatgccactgcattccattccattcgagtccattccattccattgcattccatttgggtccattccattcaattccatttgagtcaactccattccattgcattcgagtccattgcattgcattcccaaccattcgaatccattccattccattgcattcgagtccattgcattgcattcccaaccattcgaatccattccattcccttccattcgagtccagtccattgcattccattccattctttttgagtccattcaatttcaatccattcccttcgagtccattccattccacccaattcgagtccattccataacattccattcgagtccattccacaatattacatttgagtccattccattccattccattagagtgaattccattaaaatccattgtattccattcgagtgcattttacattccattctattagagtccattctgttaaattccattccattcctttcgagtccattccattccattccattccattccattgcattccattccattcctgtccattccattaaattccattctagtcccttccattcaaatccattccattccagttcgttacattctgttgccttcgagtcctttccattccattccattccattccgttccttttgggtacattccattcaattccaatcgagtccattccatgtcattccattctcttcgagtccattccactccgttccattctattcaattcaagtccattccattccatttccttccattccattcaattccattccattccattagggtccattcctttccattccattcaattccattccaatgcattcgagtccattccattcgagtccattccattacacatcatttcatttgattccattccattccattcgagtccactcctttccattcaattctagtacattctagcacattccattccatttgagtccattctattccatttcattccatgcgattccattgcattgcattccattccagtcctttccattccattctattccatttgtgcccattctattccattccattcgagtccattccattccaaaacatttcattagagtgcatttcattccattccagttctttccattccattctattccatttgtgtccattctattccattccactcgagtccattccattccaaaacatttcattcgagtacattccattccattccgttcgaaaccattccatttcattcgattccattcaagtccattcaactccattccattctattccactccattccattacattcgagtccattccattccattccaatccattcgagtccctaccattccattcgattgcattccaatccattcaagtaaattctgctccattccattctgatcgagaccattccattccattcgagtccattccattccattcgagtccattccattgctttccatgccattccattccattgaattcatttccattccattccattccattcaggtccattccattgaattccattcgagtcctttccattccatttgagtaaattccattccatttcattcgagtccatttcattccattcctttcctttcgagtccattgcattccattcaattccattccattccattccattccattccattctattccattctggtaaattccattccattccactcgattccgttacattgcattccattcattcgagtccattccattccattccattcaactcgagtcaaatccatttcattccattccattcgagttcattccattcaattcgaatccattctattgcattccattccatttgattctattccattctatacctttcgagtcctttcccttccattccattaggtccattgcattaaattccactctattccaatcgagtacgttccattccattccatttcattcgtgtccattccattgcattcgagtccattccattccattccattctagtcgatttcattctactcatttccattcgagtccatccctttccattccattcgagtccatgtactttcattccattccattcgaatccattccattgcattccattccattcgagtccattaaattccattccattcgagtccattcaattctataccaatggagatcattctttccaatccattcgtgtcctttccaatccattgcattccatttgagtccattccattccattccattgtattccattaaattccattcaattcgacaccattccattgcattcctttccattcgtgtccactcctttccattccattcctttccattcaagtccattgcattccattccattccactcaagtcctttgcattcagttgcattcgagtccattccattccattccattcgagtccattccattccattcgagtccattcctttccatccaagtccattccattccattcaagtacattcaaatccattcctttccattcaagtacatacaattccattcctttccatttgactcctttcctttcaaatccaattgagtccattcctttccattcaagtccattccattccattcaagtccattctcctccattccattctactagagtccattccattccattccaatccattccattccatcccattcgtgtccattccattccatttcattccattccattccattccattcaaatccattccattcgtgtccattccattccattcttttccattccattccattcctttccattccatttgagtccattcctttccattccattccacttgagtcctttctattccattccatttcattccactctagtccatgtcattccattccattccacttgagtcctttctattccattccatttcattccactctagtccattccattccattccatttcgttccattccattccattccattccattcgagtccattgctttccattctattccattactttccattcgaatccattccattccattccactctagtccatagtattccagtccattcgagtccattccattccattctggtccattccattcaattccattcgagttaattccaatcctttggagtccattccattgcatttcattgcattcctttcgataccattcaattccattccattccattcgagtccattccataccattacattcgagaacattcctttgcattccactccattagagtccattgaattctattccatttgaatccattccattccattcctttagattccattccattagtgtccattccattaaattccattccatcctattcgagtccattccattccatttctgttcattccattccattaccttcaagtccattccattaaattccattctctaccattcaagtccattccagtccattacattccattcaggtccattccattccattgcaatctattctatttgattccagtccattccatttgagaaaattccattccattccattccatttgagtcccttccattccattccattcgagtccatgccattccattccattccattcgagtccattccattccattccatccattccattcgtatccattccattccattccattccatccgggtccattcagttccattgcattttggtccattccattccattcgagtccattacattccattcaattcgagtggattcccttccattccattccattcgagtcccttccattccattcaagtccattcctttccattcaattccatttgactccattccattccaatccattcgagtccattcctttacatttgtgtccattcctttccatttgattccattccactccattccattctaatagattccattctatttcattctaatccattcctttccattcaattccattccattccattccattccattcgagtccattcctttccattccattccacttgagtcctttgtattccattccattacattccattcgaatccatgccattccattccattccattccattccattctatcccattccattccattcgagtccattccgttccattcccttccattacattcctttggaatccattccattgcattccattcaagtcaaatccgtagcattccattccattcgagtccattccattccaatccattccattccggtccattccattcaattccattctagtcaacaccatgccaatcctttggagtccattccgttgcatttcattccattcctttcgagaccattcaattccattccattccattcgagtccattcaattccattacatttgaaaccattctttgcattccactccattagggtttgttgaattcttttccatttgaatccattccattccattccattccattccattccattccattattgtccgttccattaaattccattccattctatttgggtccattcctatccatttgtgttcatttcattccattccattccattaaattcgagtccattccattccattcaagtcgtttccattcctttcgagtccattccattccattccactccattcgagtccattccatttcaatccattccactcatctccattgcattccattgcattctctttttgtagaatttgtaagtggagatttgaagagctttgagacttatggcagaatagtgaatatcttcgtgtaaaaaccagacagaatcattctcagaaactgctttgtgctgtgtgtgttcaactcacagagtttaacctttcttttgatatagccactttgagccaccgtttgtaaagtctgcaagtgtatatttggacctctttgaggccttcgttggaaacgggatttcttcatgtaaaactagacagaagaattctgagaaacttctttgtgatgtgtgcattgaactcacagtgttgaacattcctttcgatagaacagttttgacacattctttttgtagaatttccaggtgcgtatttagagtgctttgaagcctatggtagaaaacgaaatatcttcatataaaaactagacagaatcattctcagaaaccgctttgcgatgtgtgcatccaactcacaaagtttaacctttcttttgatagagcagtttagaaacactctttttgtagaatttgcaagtggatatttaaagcactttgaggcctatggtagaaaaggaaatatcttcatataaaaactagacggattcattctcagaaactactttgtgatgtggacgttcaactcacagaatttaacctttcttttgatagaacagttatgaagcactctgtttctaaagtctgcaagtggatatttggacctctttgaggccttcgttggaaacgggaatttttcatataaaacaagacagaagtattctgagaaacttctttgggatgtgtgcattcaactcacagagttgaaccttactttcgaaaaagcagttttgaaacaccctttttgtagaacttccaagtgtatacttagagtgctttgaagcctatggtagaaaacgaaatatcttcgtataaaaactagacagaatcactctcagaaaccacgttgtgatgtgtgcgttcaactcacagagtttaacctttcttttgatagagcagttatgaaacactttttttgtagaatttgcaagggtgtatatagagggctttgtggcctatggtagaaaaggaaatatcttaccataaaaactagacagaagcgttctcagaaacgaatttgtgatgtttgcattcaactcacagagtttaacctttcttttgacagagcagatatgaaacactctttttgtagaatttgcaagtgtgtatttagagggctttgggtcacccaggctggagtgcaggggcgcaattttggctcactgcaagatccgcctcctgggttcacacattcccctgcctcagcctcccaagtagctgggactacaggcgtccgccatgacgcctggttaattttttgtattttttagtagagatgggctttcaccatgttagccaagatggtctcgatctcctgaccttgtgatccacccgccttggcctcccaaagtgctggcattacaggcgtgagacacctcgcctggcccaactttactctttattctcaaacttacaaccatcagatactcatgtacacagaataagaaaaatcaactttttttccttgaaggcaatgtttcgtcttgtattttataatatctgttccacattgctgtgacaatgctgttgaagtgcaccttccttccttcaccaaaagatcacctgtgtgaatttgaatagatggtcactggaggggaccagcgtggcacactgggttgaattgtctctttgcttttcaggcaaagtggctttgaaaagactgaaaataaagtgactgctgattaagcagatggcttgccatgtaaataggacaattgtttgaaaatcacatcgcatgaactacaactattaaagtgtgaaatgcatgacgcaaatattgcacaaaaaaataaaatgaaaatgatgaatacagtcaaaaaagacagccaaactccattttagcaataaagtaaaatataatctactgtcaggggaaggtaacttgaagtacttgagatgttctttaatttaaaaatccaaaaatatttttagctttagttactataaaaaatgtttaagcattttccatttgaaataaaatttcaatttcatgctttgtcagtttagtttccctaaataaatagaaaagagtaaaatatcacatacaaaaaaaatcaacttctttggtaataaatcagttcaactgtcagaccaaaacataattacattttacccaatgtcgtgctgaccaatttgatcaaatgccacttccttatcactaagagagatgcaaagatgtagactttatgttgagtgagacaggtaaggattactaggagctagatagttgttttactaatcaaggtcgattttcattactattttgtctctatgttaattaatggtcttgattcaagaaaatttttttaaaaactcatcttctcagtcaggcaaaatattaacaaaaaggcatagaaatgaaggcatttaacacagtcatagtttacattttaaaattaaaatacttctagaaataacaaaaaaagaaaaaagacagatgtaaaaaaaaatgaacttaatttttggtgcaaagcactcattactaagcctaacacaaatattttggtaaaggctttctaacactgacattcttctcatgacttaaaagcgccactaattttacttttgacatatatttagttttaatattaaaagctaaaaggagcctattattttatttataatttgtggtctgcatgtacatcatcatccactgagtcgactaaagtttctgaaagtttcagaaacagtaacataagaatactttttcctgccatgcacggtggctcacgcctgtaatcccagcactttgggaggctgaggttgggggatcaccttaagtcaggcattcgagactagcctaataaacctggtgaaaccccatctctactaaaaatataaaattaacggcatggtggcacatgcctgtaatcccagctacccctttaatgaccacatgtgaagtttcttttgaactaattttaactacctatttttattgcttttttttggtcctattagaaaaacattaaagttcctgttactacaaacacaatctattcaaatctaagcatactgcttatcttaaaagatctgtaggcttggaattatggaaatcctattctccatttaaaatactgcttttcagtaagccaaagggggcaattgtggctcataatcatgttattaaatattaataccatcatctagatggaacttttagttatctgcatgttcaaattgttttcacttataataagtcagaaactataaaattttataaactataaaaataaactaaaaatatatttatcaatgcattttttttcagttttaaaatacttagcctcaggattatttctagttgacataacactagatttcagatgatgtggatgtagaaactagaaacatcctagttgactcatcttcactttctgccttcatttagcacacaaacatagcagcaccaacaaaggccagcaatgctaccccttttgaaaaacacaccagtgcccttctagggagaatatatgtgtgaaaagattcatctgaaagtcatgccatcttctttttgatttacagacttatatatgacaaataatacaaataaaaatttaacagtgccatataatcagaaaattattctaaaaattccttctgacacattattctttttcaccaaaatggctgtgatgaaatgattgcctttgcaggactgttgtcttaaataaccaatactcccgtttcattgttcttgaactttaaccataacgctttcatgctttttctagaaattttatttcctaattatgtcacttaggtataattaccatagcttcatattttcaaaagtggttctaaaaaaacttaaaccactgaccatctttttttcccaaaggagtagagtaataaataaacactatcacctagtgcactgtaaatagatgaaaaataaagatgtagagctggggtgtccaatcttttggcttccctgggacacactagaagagttgtcttgagccatacataaaatacaccaatgatgatttaaaaaatcacaaaaaactcataatgcttttagaaagtttctgatttgtttagggctgcactgaaagccatattgggccacatggagcgtaggccatgagttggacaagcttgatgtacagtcatttattttagctgcacactcaaaactaaggccgagagctttcagagaaaatagcttataggatgtcaggagacctgttatagaaacattcacccctatgtctaaaggggacaaaattctatgtcttccacccttaattccaaccattaaccaaaactggagaaatctaacatggcattatatcacaaagtattttattatttgtattttggattcaaggatacacgtgcagatttgtaacataggtatactgcatgacgttgaggtttaggcaattaataatcccattgcccaagtagtgtacattatacatgacaagtactttttaacccttgtaccccttctccctccattttcgaatccttagtgtttatttttctcatctttgcttccatgtgtacccaatgtttagcttccacttataagtgagaaaatgtagtatttggttttctgttctgtgttaatttgcttaggatcatgaccttgagctgcatccatgttgctgcaaagagtattacatgattcttcttcagtggctgcatagtattggatggtgtgtaattacctaatttttaaaatccatcttaagatttatgagcacatggtttcattccatgtctttactattgtgactagtgctgcaataaacatacgagtgcaggtgtatttttggtagaataatttatttgtattgtattgaggtatatgcccagtactgaagctgctgggtcaaatggtaactttagttttagtcctttgagaaatccccaaaatgcattctacaggaggtgaactaacttgcattcccactaagagtatatcagggttctcttttctacataattttaacttttttttttttactttttaataatagccatttagactggggtgagatggtatcacattgtggtttggatttacatctctctaatcattagaaatgttgatcaatttttcatatgtttgttggctgctttttttgtctttcttttaaaagtatatgttcacatttttgtcaacattttttcttaaattccttataaaatgtatatattagttatttattgtatgcagtttacacgtattttagcccatactgtacgttgtctgtttattttgttaatagtttctcttgctgtacaggtcacaatttttaatttttatttttgttgctttcacttttgaggatgtagtcattaattctttacagagaccaacgccaaggagagaattttctaggtgttcttctaggacttttataggttgaacacttacagataagtctttaatgtatcttgatttaattttctgtatcatgagaagtaggtgttgcgatttcctcttctgcatatgactaaccagtttttccagcacctttttttgggtagggagttctttccatttgtttttgttgatgctgtcaaaaatcaattaattttaagagttcagcttcatttcagtgctctcttctgttccgtaagggtgtgtgtgtgtgtgtgtgtgtgtgtgtgtgtgtgtgtgtgtgtgtgtatctgcatccatattatattggttaccgtagcttgtggtaaagtttgaagtttggtaacataatgtcaccaggtttattctttttgtttagtatagccttggctatttgagcttttttgttttcatataaattttagaatagttttttgactaattttatttaaaaatggcattggtagagtgatagaaatagaaataaactgttgattgttttgggcagtatgaactttttaataattctaatccattagcatgaaatactattccacttacttgcactgtgtctgatttctttcagtagtggtttgtagttcttctagtagagatatttaacctcctttgtttaatggatcactattttattttttgtttctggctattgtaaactagattgtgttcttaattttgctctgtttaagtgttactggtgtatagaaatgttcctcatttttgaatgttgttttgctttttgttgttgttgccctgagattttgcagaagtcttttattaggcttaagagtcttttggaggagtctttgaagtaggtagacagttatatcatcagtaaagacagataagttgacttcctcttttcttatttgagtgtttttctttctttatcttgcctgattgttctggctaaaaccttcagaactatgttgaataggagtggtgaaagtgcacattcttttcttatttcaatttttaggaaagatgcattaatctttcacctgttcagtatgatgttggctgaggatttgtcttatatggctgttattattttgaggtatgttccttcaatgcctagttttttgagaatttttttcataaatagatattacattttattaattgctatttccacatctattgagataatgtggttttgttttttaattatttttatatgttgaatcgcatttatagattgcacgttaaaacattcctgcattcacagaataatgtccacatagttgcagtgaaataactttgatttcctgactcagtttgcaagcatttcatgaataatttttgggtctgtattcatcagggacattggcctgtaattttttttgttgtgtctttactaggttaatatatcaagatgacagtgatattatatgatagaattaattaggatggagtcccactttgattttttggaataatttctgtagaattacagccaactcatttttgtatatgtgataaaatcatgctatgaatgcatctggtttagtactttttataattggtagattttttttatcaccaattcaatttacttacacatttttggtttcttgaagacttctgtttattcctgattcaatcttgggaggttgtatgtttctaagagtttattcatttcctctagattttctagttggtgtgcacacagatatttatagtagtctgcaagcatcttttgtatttttgtgggattggctgtcacaactgtaacattcaaatagatgcataatgaaagtgtaacaaaattcaatatctcctcataataaatctcttgaactagttataaaataaatgcaattcaaggtaatgtcattaacaacaatgcacacctaacaacatactaaataaggaaaaactgtaagccttttctctaagagctagaacaagacaaggatgtccaatttctccaatctttttttttttttttttttttgagatggagtcttgctctgttgcctaggctggagtgcagtggtgcaatcttggctcactgcaagctctgcctcccagtttcacaccattcttctgcctcagcctcctgagtagctgggactacaggtgcgtgccaccacgcctgcctaatttttgtatttttagtagagacggggtttcaccttgttagccagaatggtcttgatctcctgacctcgtgatccccccacctccgcctcccacagtgctgggattacaggtgtgagccgccacgcctggcccaatttcttcgatcttactgaacataatacaaaatgaccaagacagaaaaaatattcaataaaatcaaagcaatcttaaataaaatgaagaagataaattatagtttccttgcagatgatataatcttaagtatagaaaaacctaggacctcacaaaaaattattagaatatacaaatttattaaacttgcaggatccaaaatcaacataaaaaaattccgtaatatttctatatactaacaataaagtatctgaaaataaaaccaaaaaacaatcctatctacaataattgcagcagtaactatacttagaaatgaatgtaaccaaaaaggtgaacgatcggtacattataatctaaaaaaaaaagaatttagaaaataaataatattcaaacaaaaagatatttctaattcataaatgggcacgattaatattgttaaataactgcattacacaaactgatatacagatataataaaacttctattaaaatccagttaaattctccatagaagtgtttttaaaaaatctaaaatgtatattgccccacaaaagaccttgaatagctaagaaaatcaagcaaaaaatgaaaaataaaaggctgaaggaatcactctgacttttaaatgtccaacaaagctacagtaatcaaaacagagtgttacttgcataaaaatggacacataggccaatagagcaaaagagaaagaccagaaataaattcatgtatttacagacaactgattgtaaataaagatgacaatttaaaaaaaaagtcttttataaacgatgttgagaaaatatatatccacatgcaaaataataaaatcagaccttcatctcacaccatatataaaaattaactcaaattagatacttaaatgtgagacctgaaaatctaaaactaagatgaggaaatatagaatgaatgccccataacattggtctgggcagtgactcttgggtttaacctcaaaattttagggggaaatagacaaaccagatttcttaaaattaagaagctgctgcacaccaacagatacaatcagcagaatgacataactgaaaaatggaagaaaatatttgcaaattatacatgtgaaaagcagttaatatcaaaaatacataagaaactcaaaggactataaaacaaaaaacaaataaccattaaaaataagcaaaagatctatataaataattttcaaagaaagacatacttatagcttggcagatagatgaatatggctcagtcaattatcatcaaggaaaggcaaaccaaaacaactctaagatataaactcactcctgttagaatgtttaaaaaaaattgttggtaaacttgaaaaaagagaaagaggaaagctttcacactgtttgtgtcaatgtaaataaaaacagccattatgaaaaatagaaattttgcaaaacaattaaaatctaacatgtaattgaactactggatatctatcacaaaacaaatgaaactagattgatgaacagacatctgcaattctgtttgttgcagcacactttacagaagccaaaatatagaatcaacgtatgtgtccatcgtccaatgaggaaatacacacactatggtgtatatatacaatggaatactatattttaaacaaaaaatcttatttttaatcacaaagataagcctaaaggacactatagttgttgaaataaggcacagaaaggttaatatctcatgatttcactcacatgtggattctacaaaacatatattgattacataattacagttggataagaaaaataagttcaagagattataatgcatgtattgtgtttctgaaaaaatgctaagacagtaaatgttgtcttcgcaccaaaaagtaactatgtgaggcaaagcacttgacaattacctaaaattaggcattgacaatgtatatttacttcaaaatactattttacaaaataaatacatattttatcagtgaatttaaaaatatatttataaaaactattaaaaatgacaaaggttcaaattctgactctgtgtttttgtcataaacctgtctgaatagtatgaaagatacatagtttttgtgctgttttttcacctagtcagtcatgaccatatgaactctaatatttaccaccatgtttttgggacccagcacagaatatgggagaagccaacgtaccttaggccttttactttgagcttgggacacctggagtttctggtgctggtggtaatgatagggaagacacaaaaagggcaggtgttgctgtggttcacatgattaaaccactctgaagagagtaaataagtttgcatcccagatcactgaagaaattttttaactcaaaagatgacatgatccttaaaatttttccagataaaatgaccaaggagttgactagttaggtgacaaagaatgaaacctctaaattgtaaactgcacccaataaaaaagtacattatacaagtgtgagaaattcctcaagattttaatgttaatatgaaaaagattacttcacatgtgaaatccacaggtgtcattctattatttttgaatatttaacattcacaccaaaataaaagattctgaatgaaaacttaagttgagctgtaagtatgtaataaaaaatttaacattctccacttaccattaactcttctaaaagtttaatttctaagacatatcttctaactaattttatattttccacacattgtgttaattttgtttttttttgagatgaagtctcgctctgtcatcaggctggaatgcagtggtgcgatctcagctcactgcaacctctgcctcctgggttcaagcgattctcctgcctcagcctcctgaatggctaggtcaacaggtgcatgccaccatgcccagctaatttttgtatttttagtagagatggggtttcaccatattggccaggaaggtctcaatctcttgacttagtgattctcccacctcagcctcccaaagtgctgggattacaggcgtgagccaccacacacagactgtgttaaaatttaataaaagtttggttttacaaagacaagaaattctgactgatttattcctctcacctgtgaacaccggatgccttttatctcaattaacggatctgaaagttacattgacaaacttctcatcagaacctacaaagtactgtgtgaaatgacatggcacaaaacaaacagcaataaaaatgtagccataacacaaagaagaaaaagaagggctgtgatgcatacacagttgggataaacataagtagacacaaaaacaaaactaaagataatcagaaaataagaagaatgtctctttaaattcagaaagagtcagttttgcagcataagaacaacgtcctctccacatacagaatcgattttatttcttcaccacgcatatttctttatctttacttggagctacaaactaactccagcagaaatatttatggccaataatggtgcctctattacagcaagcattgtgtttgctacatttacatatcaaaatatctttgtgacttatgaagcctccccagtatttacttaaacaaattggctgaatgaataaattcacctatgtcaattataaagagtaaaaggaacaataaggaaacttagcttacacaggtttctccaattaaaataacaaaatgggatgttctaactaaatgaaatataagttggtcagatgcagtggctcacgcctgtaatcccagcaccttgggaggatgaggtgtgtggaccacgaggtcaggagttcaaggccactctggccagtatagtgaaacacagtctctactaaaaatacaaaaacattagctgggcatggtggcacatgcctgtagtcccagctacttaggaggctgaggctagagaattgcttgaacccagcaggtggagggtgtagtgagctgagatcccaccattgcactctagcctgggtgacagagcaagacaccatctcaaaaaaaaaaaaaagaaaaaagaaagcaacaaaagaaatataagttaatacactcattgtgaaataacattgaaaaattattttgcatgcattactaaattttataaaaattcttagaatatctgagcaactcacataatgaatacttaataaattataaacacaaaaaatatgaaaaaaaaaatcagtctaccatgagtaccaggcaaatgaaagaaagaatttgcatggaaagattcggaaacacagtccataagacttcacagtaattaattaaataaaatgcagagaatacagatattattcaaaatcactgaggtttctggttttctagtaaatgatttgtccactttattaaagtgatattttgttccaatattgcttgtcttctgaaaataggtactctcacacacaattacttgccccacaattttcttacacctaatgtttatcttaagagtaatatatttgtatatttagcatcatgtaagtaaaaactaacagtctgcatgagtttacaggcagagagtccacttgttcaaaatatatatgacaaatttttaaaaatattcattcaggacttagaaatgtgagatttattatactactatgtaattattatcaagacgataaaaaacctctgtagcaagtaataatttacttgtacatttttagataactaaaaatgtttaaatggattgtctgtaatacaaaaaaaatgcattaggtaatgaatacctcatttactctgatgtgattacaaattgtatgcctgtatgaaaatattctatatatgccataaataggtaaacaatattatgttcctacaaaaatttaaaaagttaaacaaatgtacattttacccattgaaacaatactgttaaacttttcagtttaatgccacaggcaaaagagattgctagagaggtcattctactatgttaccatcttttatctacatctttaatacagtgggatacgttaaagttggtgacataacactttactaaatgcacgtcttaaaaagtttaaaaccatttcgtttaatttaaaagttaagttatcacagtcttataaaagaattttaaaattccctacattttattacataaaagtacaattggtaaaacaatttactactaaaactcaaagttttcctctcactataatgcagaatattactctaaacacataactcatgcatcacatgaacaatgttaaaagtcagccataaagagcctctccaatcagattttcattatcatcttacattttaatatccttactcttccatggaaaaattaatgaatgatgcctacctaataagaaaggaatctctcagatttctgatgcaacagaaattgatgacatgcttttacacaaacaacaggaaaaaaggaacagcatgaagcaattttacagttgaattacctacttgcttttcaaaaaacttacacttttttcaaggaaaaacgtataccttgaatgtaattttaactctccaaaaaataaccttccactcctcttaaacttatatacaaataaattatccaacagttttagctttggattactttctttacagaacattctgatttagtgtaacgtcttaagtgccagtgccttagttctccctaccgtgaattttctaaagtttacaaagacttaattttgactaaatatttttacatatgtattccatctgcaaaaatattttttattataaactgtgtggtgttttgtaagctgtagtttctgaacaaatgtttttccacacttattacatttgtacggtttccttcaacataaattctctgatgccaaacaagtttgagtaattcctttagagttttcttctagtgtaaaatctgtacattatatagggcaagtaaaggtattacaaccctctttatatttgtaatgtttgtctccagaatactcttttttattttaagggtttatattttccaaggtctttgaacagtaattacatttataataattttattaagtatgaacttcctgatgttgactatgatgtgagcagatagaaatggcttttccacactctgtataatttttcaagtataaacgcttttatgtgccataaagtatgagcatgttagaagttttgacacattctttgtttgtagagattttctccactatcaattattttacctacagtaagatgtgacaaccatttaaagggcttgccacattgttcagttttctgaggtttctcactgatatttctccaaggcttaggaaagtttgaggtgtattcataagctttgccaaacttccttaggttcataggcataatctttagtatgaattatggctggatatatttgagcaatacttaaaagattttgccacagtcttccaatttgtatgatttttttccagtatgaattctcataagtttagtaaggcttaaggactggttaaaggctttcccacattctttacatttgtgggatttctcttcagtatgaactctcttatgttgagtaaacttgaggaacaagaaaaagttttgccacattcttgacatttgtagggtatctctccaatatgaactctcttatgtttagtaaagcttaaagaccagtaaaaggttttgcaacattcttcacatttctggattcctctccagtatgaattctcttatgtatagtaaggcctgaagactgcttaaaaagctttgccgcatgcttcacatttgtagggtttctctccagtatgatttctcttatgttcattcggttttgaggagtgtttaaagactctgatacattcttcacatttacagggtttctcttcagtatgaattctctgatgtatagtaagttcagaggaccacttaaaagctttgccacattcttcacatttgtatggtttctcttcagtatgaactatcttatgcttagtaaggcttgaggaacagtaaaagcctttgccacattcttcacatttgtaagattcctctccactatgagttatcttatgttcattcaggtttgaggattgtttaaagcctttgccacattcttcacatttgtaggattcctctccactatgagttatcttacgttcattcaggtttgaggattgtttaaagactgccacattcttcatatctgtagggtttctctccactatgaattatcttatgtacattaaggtctaaagacttcttaaaagctttgccacattcttgacatttgtagtgtttctcttcagtatgaactatgttatgttgaataaggtgtgaggaacagtaaaaggctttgccacatttttcacaattgtagggtttctctccagtatgaattctcttatgtatagtaaggtttgaagacgcttaaaagctttgacgtattcttgacatttgtagtgcttctctccagtatgaactatcttacgtttagtaaagcttaaggaccagtaaaaggctttatcacattcttcacatttgtagggtttctcttcattatgaattctcttttgtatagtaaggcccaaagactgcttacaagctttgccacattcttcacatttgcagggtttctctcccgtatgaattctcttgtgtatagtaaggtttgaagaccacttaaaagctttgccacattcttgacatttgtagggtttctctcccctatcaattatgtttagtaaagcttaacaaccaataaaaggctttaccacattcttcgaatttgtaagggttctctccagtatgaattctcttatgtagagtaaggcctgaaggttgcttaaaagctttgctacattcttcgcatttgtaggatttctctccagtatgagttctcatatgttcattcagttttgaggattgtttaaaggctttgccacattcttcacatttctagggtttctctccactatgaattctctgatgtatagtaaggtctgaaaaccacttaaaaattttgccacaatctttatatttgtagggtttgtctccagtatgaactatgttatgttgagtaaggcctgaggaacagtaaaaagctttgccacattcttcatatttatagggtttctctcaagtatgaattcttttatgttctttcagttttgaggatattctaaaggctttgccacattcatcacatttgtagggtttctctcccatatgaataatcttacgcatagtcaggtttgaagactacttcaaagctttgccacagtcttcacatttgtagggtttgtcttcagtatgaactatgttatgttgagtaacggttgaggaataggaaaaggctttgccacattcttcacatttgtaggttgtatctccagtataaattttcttatgtttattcagttttgaagattgtttaaaggctttgtcacattcttcacacttgtagggtctctctttagtatgaattctctcatgtatagtaagacctgaagactgcttaaaatctttgccacattcttcatgttggtagggtttctcttcagtatgaattatctcatgttgtcttaggtgtgagaacctgtgaaagaattggccacattctttacatttgaaaggtttctctccagtatgtcttctcctaagtctatttgaatttgaaaatttcctaaagactttcacacatgtattacattgaagtattttgctctgagtaaccgacaaacattggttaagtccattataacctccttcctgcaacttagatgcattcaaacttttacagccttttcttatttgtaaattctcatgtctagatttctcatatcttctcagtatcactttttgaaatgaattttttatgttctgatctagccaaaggtcttgggtgaaatgagaacacagctgaaagaaataaaaataaattatctcagtaggcccatgtgaatatacaaatctattgtttacaaatctaatacataaaattatacaaagtacattagcaacatggcataacaaaaataccacaggtcctaattcttttatagagttataacaaaactctactgaccaaaatgtccttatggaaaatctagaaatgagttaagtgtgttcagtgtaccaggtgagcaaaatgccacaagccatactgaatggatagaaaagtttgttacatttgcccaacacctttcctcctccataatgcagcatggcacttttagaagtaaactgcaatgtctggcatcttcctcaatatagaaaaaaaaaaaaactggctcatgtatttttacttctggcttctggacacttttacagagacttgtttctgtctccaatgacaaaatgtgctgaaagaaattatggtatactttgaaataacagcttgagtctgctgagaccaaaggtaaatgttacagcaaccaactacagtaccacagacatgaaatatgtataggaagtaattacagactgtttaagaaacacaggcaaacccctttaactgagtaatcaacacaaaattccacacatgacaaatcataacatatttgataggctcccagaatctctagttgagacacttggtttcagactatgttaggacaacaccgcattataaagattgtgacacatagctgtttgttaatgtccaaatctcaaccaaagagtacaatacatacaaaatattacagtgacatggcctaagtaaaaaaaaaaacttaaaactgtcagaaaacaaccatgaaaataaagatgtacacattagttttaaaaatttaacctaaatgggaacacaggtaactaaataaaatcagaaaaaaacagactatcaaggaaaagatgaaaaatataatagaaattatggaagtagaaaatacagatagaaataatgactgaggccaggtgtggtggctcatgtctgtagtcccagcactttgggagtttgaggcaggcagatcacttgaacctagggagttcaagtttaaacagggaaacatggcaatacttctcctctataaaaattaaaattagtcaggtgtattggcacacacctgtggtaccagtaaacaggaggctgaggtaggaggatcacgtaagcctagggaatccaaggctgcagtaagctgcaatcatgccactgtactcaaacctgggtgacagagcaagacactgtctcaaaaagttaagaatacctgagaaattctcaaaagtaagaaaataaggttgtaaaaatgaagaagctcaacatactaaaactaggaaacacacagatccataacaagacatgcaaagcaaagttcccaaaatcacagacaaaaagagaatctcgaatgctggaaaatacataattatggttctatgatataaccagtgactctttcaacaaaaaccttgcaggctagaaggaaattatgtgctatagtcaaagccaagtgaaaaatagcttctgtgtaagaataatataaccagaaaaactgtgctacaaaatgaagaaaaagtaaagacctctgaagataaccaaatgtggaaaaattatatcaacactacatacgccctacaaaaaatgctgagaagagtcctactactaaaattatatgatgctaaaaaacaaaactatcatataaaaatagatagctttctgggaaaaatataaagatatgcaaatattatacaaaaaaatcctgtagcattatcataataccaaaaaatgttttatttaattattctctaaaatttaaagataaaagctaaaaataataatgaacatctggtataaatatataacataaatagatatgtttagtgacatcaataactaagttgaggacagatgtaataagaaataatttgtgcatgaacccgaatttaaatttcaccacttcaaaatatattgttgaaattttaagagatttttatataatcctgaaggcacccacaaagaaaatgtctgtatagatacaaaaaaggaagtaagaaagaagtgacagcctatccatacaaaaatcaaaaagacacaaaggaagatagaatgagaaacagacatgcaagaatcattaaacaataaaataacaataatctttgtcttcagaaaataaatattttaaaaacagactttccaatcaatacacatatattgaatagagggattatataaaattttatgtaccaagatccaacttgcctttcttcaagagtcacttgagatctagtagtgaaatcggcctgaaagtggcaagtggaagaagacatttcaggcaaacattaaccaaatgtgaggagaagacatcaaaattgtattatacaaaatacatcgtaagtaaacaactctcttattttataaaatatactttatgtcaaaattcacaagagaaaaaaggtcattaaacaataataaagacatcatttattgaaaacgtatgacaaatatgtgcatacatatatttatatgtttgtgtgtgtatgtgtatttctcacattaggtttccaaaaatacaaatcaaaaattgacagaattaaagcaacaaatagagagaaatataattataataagatattttaatacttcaatttctgcaatgaacaataaaacaaaacaatattaataatagaaaagagggccaggtacggtggctcatgcctgtaatcccagcactttgggaggccgaggcaggccatcatggggtcaggagatcaagaccatcctggctaacacaatgaaacccagtctctactaaaaatacaaaaaattagcagggcgtggtggtaggtgcctgtaatctcaggtactcaggaggctgaggcaggagaatggcatgaacccaggaggcggagcttgcagtgagacgagatcgcaccactgcactccagcctgggcgagagcgagactctgtccccaaaaaaaaaaaaaaaaaaaaaaaaggaaaagagaaactgaaagcagtacagatggggacaagtggctcatgcttgtaattctaacactttgggaggccagggaggacagatcacctgaggtaaggagtttaagaccagcctggccaacatggcgaaaccccatccctactaaaaccccatctctactaaaaatagccatgtacagtagcaggcgcctgtaattccagctactcaggaggctaaggcaggagaattgcttgaaccagggaggcggggtttgcaatgagtcgagattgcggcactgcagtccagcctcggtgacagaccaagactctatctcaaaaagaaaaaaaataccaagaaagcagtataaaacaatattatgcctaacaaagaacaccccttaataatagcagggtacaaccattctcaatagctcacatacattctctttgaaaaactgcctgttagtccattataaaaaaaaaacttactaaatctttaaaaattgaaattgatagattactttttatgaccaaaatggaatgagagtagaaatcaacaaaaacaaaactaaaaaatttataaatacatgaaaattaaacaacacactcttcagcatgctcaaagggtaaaataattaatattcagcatgatcaaagggtaaaataattaatattgtgaagatgcccatactgctcagtgtaatctacagatttaatgcaatccctttcaaatatctaattttattttagcagaaatagaaaaagcaaccccaaaattacatgaaattttaagaaacaatgaaacacccaataatcttcaaagagaggaacaacgttggaggcatcacaactccctgatttcaaaacacattatacagacttaaaacaatttggtttggttataaaaagtgaactagaccaaataaacagaatgtagtataaactctcacacatatactcataggaagagttatttgcacatccataattttttttttttagatggaatctcactctgttgcccaggctggagtgcagtggcacaatctaggctcactgcaacctccacctcccaggttcatgccattctcctgcctcagcctcccaagaagctgcgactgtaggcgcccaccaccacgcccggctaatttttttgtatttttagtggagacggggtttcactgtgttagccaggatggtctcgatctcctgacttcatgatccgcccaccttggcctcccaaagtgctggtattacaggcgtgagccaccgcacccggctgcacatccataatttttacagcattgttattgacaggcaataggtgaaagcaatgcaaatttttctccccagattactggataaatataatttgaaacataaaaataatggaatattactcagtgtttaaaaacaggaaatacaggccgggcacactgcctcacacctgtaatcccagcagtttgggaggccaaggtgggttaatcaactgaatttgggagtttgagaccagcctgaacaacatagaaaaaccctgcctctactaaaatacaaaaattagccaggcatggtggtgcatgtctgtaaccccagcctcctctcaggaggctgaggaaggagaatggcttggaatttgggaggcggagattgcggtgagctgagatcactgcactgcactccagcctgggcaacaagggcgaaactccatctaaaaaaagaaaggaaatattctaacaaccataataaactttcattaaattatgcaaaatagcatatgtcagccacaaaaaaatgctgtatgaatccacttacatgagatatttaaagcagttagactcaaaaacaggaaaatagaattgtttgtaaagggccagaaaatgggagaaatgagtagttgtttaatgtgtattcagttttagttttgcaagacaaaaacattctagagatatgttgtataataatgtcaatataattaatataaactacatatttttaaattaagattctaaattttatgttcttgataattaaaaataaacagtaataatacctaaaaatgggacaaaattgacagtttttaaaattaccttcaaatcaaaaaagtatttctcccacacaaaaatagattcccaaatagatattagaagtaggagaatttttatgactactcagataaaacgaccattgatcactcacaaacatacaagtcataagcaatatagaaataatatgcgtatacacaaacacagaaattattatattgggaatagacatatgactgattcatatttaactttggctccacgctgtcttaaagtgcacagagttgaatattgacattcacaattaccatacaaagtaaaaactaaaaacacaattaactgatgtgaggtggcatactctaaaatatgaaacaaaaaaaaataaaattggctgggcatggtagctcatgcctgtaatcccagcactttgggagactgaggcgggtggatcacgaggtcaggagatcgagaccatcctgcctaacagggtgaaaccccgtctctactaaaaaatacaaaaaaattggctgggcgtagtggtgggcgcctgtagtcccagctactcgggaggctgaggcaggagaatggcgtgaacctgggaggtggagcttgcagtgagccgagatcacaccactgcactccagcctgggtgacagagcaagtctccatctcaaaaaataaaataaaataaaataaaataaagtaaaatgaaataaaataaaactgcaaaacaaaatgaaaacatggaatgttaaacatactgaacaccattaagtagattactacatttggaaaagaaatcttagaagacaaatgtagggaaaaagtattagaggggttatatgaagataaaagaggatgaaaactttccaaatttttatgtgataaaagaaaaactaataccaatcaatactgtttgctttgaaattatttggaattactctggaattaaaaataaggaaacaataaagaacttacaaaataaacaaaaggtgaaggtatttatcaccactagcatggtcccacaagaaatgctacatggtagccaggcaccagtggctcatgtctgtaatcccagagtcttgggaggccaaggcaggcagattagttgaggctaagagttcaagatgagcctgaggaacatagtgagatgctgtttattttttttaatgccaaaaagagtccatatgttgaaaaatataatgatgctgaacagccttaaaaaactacatgaaactataaagctttctgttaaatgtaaatatataaacacatatacaattgtttaccaccataatcatgaagcaaaatctcttaaaattctgctataaaatttgaacaaaaaatctgcataaatctgttaatagatacacaatataaaataatatttgtaataataaaaaactacaggatgtaagcccgggcgcaatggctcatgactgtaatcccagcactttgagaggccgagatgggtggatcacaaagtcaggagttcaagaccagcttggctaagatggtgaaaccccgtctctactaaaaatataaaaacttagccagtcatggtggtgggtgcctgtaatctcagctactcgggaggctgaggagcattgcttgaacctgggaggtggaggttgcagtgagccaagatcacaccactgcactccagcctgggtgacagagcaagactccatctcaaaaacaaaacaaaacaaacaaaaaaaaaaccactacaggatgtaaagaggtatagtttttgtattcaactgaagttatgacatattaatattgttataactttaaaatgttttacataatctccaattaccaagataattacaagtttatagaaagtatgcaatacaaaatgagaaaggaaacaaagcataacactacaaaatcaaaaaaacaaaaattaagacagtaaaataggaaatgatggaaaacatctctacaagaaacacagaaaataacaacaatcaaaatggtaatagtaacttcatttctctaaggaatcattttaaatataaattgattaaactaataataagaaattaaatggctgaatggaataagaacaaacaaaatcatacaatatgcaacaaattacacaatattcttgtttgaacttggtgtactctgttaggacacataataagccttattaagtttaagaagactaatcaggtgtggtggctcatgcctgcagccccagcactttgggaggccaggactggaagattgcttgagaccaggatttcaggagagtcactttaactttgagtcaaacaggttgaaagaaacagaatgaaaaaacatattccatgcaaacagtatccacagttaagtgaggtggtcataattatattagacaaaatacactgtaaatcaaaaactagcatgaggtaataaagattgttactatataatgataacattggtcatttaccaggaatctataactattatatctatttaaaagatcagggttccaaaatatataaagctaatattgacagaagtgaagcaaaaaatacatagcaacataataattacagacattaagaccccactttaataatgagtgaaagtttagataaaacatcaataagagaacaaaacctggatgacattataaattgtattaattcattttgtattgcaataaatacctaagactgtgtaatttataaagaaaaaagatttattttcttcatagttatgcacaatgtacaataagtatggtgtcagcatctgcatctggtgagggtctaagtaagcttacaatcatggtaaaggcaaagagaaaccagacatattgcatggggagagagggagcaagcatgaaaagaaagtgccaggttctttaaacacgcagctctcacatgaattaatagagtgagaactcattgatcaccaaggggatggtgtgaagtcatttacaagagatttgcccccatgacccaaacacatcacgcaaagatccatatgctacattgggaatcccatttcaacacgagatttgaagggtacaaacatccaaatcatatcatagaccaactacacattaaaaatatgtacaggaccctccagtaaaaaggaacagattacacaatattctttacacaatattcttgtttgaacttggtgcattctgttaggacacataacaaatcttattaagtttaagaagactggccaggtgtggtggctcatgcctgtagcccccagcactttgggaggccaaggcgggaagaccgcttgagaccaggatttcaaaaccagcctgggcaatatagtgagaacccacatttctacaaaaaatcaaaaaactagccaggcgtgacagtacacgtatgtagtctcaactacttgggatgctgaggtgggaggattatttgagccttggaggttgaggctgcagtgagccaagattgtaccactgcgctccagcctgagtggcacagtgagaatctgtctctcaacaacaatacgaataaataaataaatttaagatgaccaaaattatacagttatgttttctgactaaaataaaatgaaactagacatcaaaatcaagagataaactggcaaattcaaaaatatatggaaataaaacacactctgtaatatattcttgctcaaggtccagataatttaatcaaatgtgaaaacaactcacggtggtgaagaaattccaatggtacattgttgaccagaaatattgtttaaaaatttttaaattgattatgagctaaaactagccaaacacccatgagaaagaacaaagaggcattatatttcctgatttcaaaatatattaaaaagctacaataaacaaaagcaatgtggtactaacagagacaaacagatgatggaacaaaatagctcagaaatgaacccttctttatataatcaaataatcttccacaaagttgccatgactacacaatagagaaaagaaaatctcttcaacaaatgatgttgaaaactgagtatctacactcaaaaaaataaagttggattattttcttgcacattttaaataaaataatgaaactaaaaaacatataactaatacaactcttagaagaaaaaaatagggaaaatacagaacactggttttggcacctttttgtagatatgacatcatacttatgaaaaacataaaaacccccataatttaactacactaaacttcaaattttctgcataccaaagaaaatatttagcagaatgacaatgccaccgaagaaatgggtgaaaatattcgcaaattacatgtgatgagttaatattcagaattataaacaactaaaactaaacaacaaacattgaataaattgatttagaaatggacaaagaattgaatggatgtttaatcaaaaatatatatataagtagaaaaaagcacttaaaataatgcaaaaaaagtaccaattgtagagaaatacaaaacaaaatttcaatccaaaacaaaaccacctcatacccattagaatggccatgataaatttttaaaatgccaaatctgttgaggatgtaaagaaattaaaactcatgtgaattgttggtggggaaaaaaggatgcaatcatcatattatgaatgtttcttaaaaattaaattacataattcaggaattccacttataaacctatattgaaacataaatcatattatttgactggaatataaaatatatttttatatattaatatatttataaatggaatccaagaattccacttataaatctatattcaaacataaatataaacgtatattccaaatataaatctatattcaaagaacctggaagatatatttgaatatatatttgaaatattggtataatatattataccaatatttatatatttaatatatataacatttacatattaaatatataaatactggtaaaatatatttattataccaatatattatatataaatatatacatatatatttatagatgtactatatatatataaagatattataccaatatttacaaaagccaaaaggcagaagtaacccagatatcccatgactgataaacaaattaaaaatgtaacatatacacatacagtggaatattattcagccttaaaatagtaaatcttgtcacattcttacataaacgttgataatattatgtcaactgaaataagatagtaacaaactgacagatactatatgattccatgatgtgagtcatcgtaagtggtcaaataaaaacagaaaggagaatggtgttactcaaggtctaaagagagggtaaaatgggcagttgttacttaatgggtattaagttttaattttagaagacgtaaaaattctagaggtctttatataacaatgtaaatacttttaatgactaaaatgtacaccttttttaaggcaggttctactctgtcccgcaggctggaatgaagtcacataatcatagctcactgcagcctcaacctcccatgcacaagtgattctcctgccacggcctcacaaggagctaggaccacaggtggacaaacctggctaattttaaaatttttgtagggatgggctctctatatgctgaccaggctggtctcaagttcctgggcttaagcaatacttctgcctcactttcccaaaatgctggcattataggcatcagcctccaccacactcagtactgaaatatagacttaaaaagctttaagatggtaaattttatgttatgtgttttcacaattttttttgaaaacaaataaaagtgatatacgtctttctatgaatcacaaaatatataaatatataaatataaatcacctccaaatcacaaaagtgtttctctcacacaaaggaaatatatatatcattaaacacctggtgaatataccactatttctatgactactcaccttcacataataagacaactattgaaaatcagccaagaaggctgggcatggtggctcactcctgtaattccagaactttgggaggtcaaggcaggcagatcacctaaggtcagaagttagagatcagcctggccaatatggtgaaacccagtctctactaaaaatacaaaaaaattagccaggcatggtggcaggcacctatagtcccagctacttgggaggccgaggcaggagaattgcttgaaccagggaggcggaggttgcaatgagcaaagattgtgccactgcactccagctgggcctctactgtggcctgcagaccttggcctctactgtggcccctgaaggagttcagtgactcagtttcagctgtctttgccacagttcacagcaattcctgccaacacaggaacccacacagtgatgtggaaaaaaacttccaaatactcagtggtggccacacttaccacatcccgatataagttccaccatatgcagacccaactgcagaaatctgtcctagtttctgccctataaataaaagtcctgaaggaaatccagcctgcccagacattagatgggaatcacaacaaccaaagcccctggtaaaaagccacttgaaggtggagtccactgcatacccagcagccttgtgacacagttacaaactcttccctattacaagctcatagggcatcccattaccctggggacccaacaaaagaagatctgtacctcctgaaaccagtttataaaaaattaaagagctgtttgcttcttcaaatttatagacaccagggtaaggctacatggttccattgccaatgtttctattttaacatagcagtgaaagtactttgcagaagaattagtcaagaaaatgaccgtaaaaatgacattcaaattgaggaaaaaaaaattaaaatgttgctgtttgtaggtgacatgatcttatatatagaaaaccataaacagtatatcaaaaactaacaaatgccctcagaaaattagcaatatataacattaacatataattatcagttatgattccatatgctaacaacaaaccatctgataaaaaaggaagaaaacaatctcatttccaatagaattaaaataataaatttctgaaaaataaatttaacaaagaaggcaaaagatctttacactgaaacatatattgatgaaagaaattgaagaagtcacaaataaatgcaaaaagatttcatgtttatgaactgcaagaataaatattataaagtgccatatgattcaaagtgatctacggtttcaatgaactccctattaaaaatccagtgacatttttcatggtaatggaaattacaattctaaaatttacatgaaactacaataggctttgaaaaaccaaagcaatctagaggaaaaaggacaaagcaaccaaacttcatactttatgatttcaaactatattttaagattgtagtaaaaaaaaacaagaggatacatgcaaaatatggacacaagaaaccaatggaacagaacagagcccagaaataaacccgggcatataaattgtactaatctttgacaagtgcatcaaaaatacacaatgaacaaagtatagtctttttaatatttggttctgaaaaaactggataccaccaggcaaaagaataaaattagcttatttttcttacaccatgctaaaagttaaattacagagttaaatatgaatccttaaaaaacctgaaaaacaaatacatggaaaacccacatgatatggtcttaacaataatttattagacataataccaaaagtacagcaacaaaagcaaacataaacaagctggactgcatcaaactaaaaaccttctgcacagaaaagggaacaataaaattaaaaaatttgtagaatgggaaaaaatatttgcaaaccatacatctgatgaaagattgatatacaaaatatataagaaatacaagcagattaaaagcaaaaacaacagtaacccagttcaaaataggcacaaaactaaactgatatttgtccaatgaagacatacaaatggccaacagataaaccataaagtactcaatatcaccaaatatcaggcaattgcaaatcaaaaccatgatgagtatcatttcaaacatgtcagaatggataatgtaaaaagaagaaacataacaagtgttgacaacactttgaagaaaaaaaattctgtacattcttggagagttaaaaattgatggagtcattacaaaaaccaagaggttatttgaaatacagaactactacacaatctagcaatcccacttctgtgtatataacaaaaggaaatgaaataagtaacttgaagacatatctgtaccaccatatttgttgcagcattattcacatttgccaagatgtaaaaaacctaaatgtttgtggatgctgaataaagaaaagctggtataaataaacaatagaatattatttagcctgaaaaataacaaaatcttgccattgcaacaacatgggtagaactggaagacattatgccaagggaaataagccagacacagaaagagaaatactgctcattctcacttatatggggaatctaagaaagctgaactcacagaagcagagactacaatggtagttgtcagggactagatatgggagaaaatgaaaagatgttgaaaagacacaaattttctgttatgagtaagtttttcgaatgtaatgtatagcttcatgatacagttaacactaattttttgtaagcttaaaatttggtgtcagcagattttagatgttttcattacaaaaaaggtacctatgtgaggacaggtgatagaaatggtcataaacataattgtgctaatcattttacaatctacacatgcagtaagtcactacattgtacacaataaatatataattatacaatttttacttgtaaaaaaatccacaatacacacctacatatatatacacacatataaattacagttctggtaaactttatcctaaacaagataaaattacaaaatagtaattaaaaaaacaaggaaagaagtgggagcttaacatatgctcagtaatgttctaagttccctgacatagtgaattgaagaaatgtaggaaatatatacattatattacagttgagaaattaagacagagttgaaattaccaacctcagttagtactaaaacaataaaaatttcaattcaaataacattagatattcttaaagatacttaatattctgattaaattaccgagtatgaatttctgtagaaacacatttgaaacctccataaaataagaaactataaagcagaaaacatacaacatatgtttgttgtatttctgggatttctgaaccaaatctcaatatcactacttttacatatttcagacacaatgcagaaagagaacttaaaaatggttaaacacagagtttctaaaaaatatgcagctatatgtatatccccaaaagcaataaaagtagtcagattgtgcactcctttataagccataaagagaactttggctctcactgcaaatctgaagaaaaattattgaagaaaaagtagagtcgttagagagcatgggacagaagatgcccctatgtgagaacaagtgaaaaaacccaggcttctcagaaacgatttccactgaagcacagcttcccaaatcacatgtaaaagtctgggttcctccttggcctttggatctctcatctatgtcatcctcttcttcattcgctttcacctacctggatgcttcatactccatggctttttcctttgctccagacaggtgaccaggtctggcttagagaagacaatacgtgttttattttaaaaagcagcaagagcatgacttttcctgggattcgccatttaccaacctaatactgtgctaagtagagaaaagaggacataatagaagattctagaaaattaattccaaaataatttttactgacagaacctttagcatattcagaaagtacattaaatatgtgggtcctcagtttcactccccagtattactgaatcaaaaattggtggtggcaattgaattttaaggtctggacaacattattttatgccactaaatttctgaaattaccacttatctagagtgaataatatagataagctcaggaaaggggaaaattcaggtcaaaatgaaacatcttgaagaatttattttccacaccaaaaaatcctcaagattgtcttgaaagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcagtatcgtgaaaatggtcatactgcccaaggtaatttatagattcaatgccatctccatcaagctaccaaagactttcttcacagaattggaaaaaaactactttaaagttcatatggaaccaaaaaacagcctgcatcaccaagtcaatcataagccaaaagaacaaagctggaggcatcacgctacctgacttcaaattacactacaaggctacagtaaccaaaacagcatggtattggtaccaaaacagagatatagatcaatggaacggaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatccctcccttacatcttctacaaaaattaattcaagatggattaaagacttaaatgttagacataaaaccataaaaaccctagaagaaaacctaggcattatcattcaggacataggcatgggcaaggacttcctgtctaaaacaccaaaagcaatggcaacaaaagccaaaattgacaaatgggatctaattaaactcaagagcttctgcacatcaaaagaaaataccatcagagtgaacaggcaacctacaaaatgggagaaaattttcgcaacctactcatctgacaaagggctaatatccagaatttacaatgaactcaaacaaatttacaagaaaaaaacaaacaacaccatcaaaaagtgggcgaaggacataaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtggaactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgtggcactattcacaatagcaaacacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcacaaggacaaaaaaccaaacaccatatgttctcactcataggtgggaattgaacaatgagaacacatggacacaagaaggggaacatcacactctggggactgttgcggggtagggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataagattgtcttgaaaacagggatctgaaattcactcatgcaaagcagaaattaccaaaacacatcctacaaaggaagaaaatgaaacatttagggtaaattaggaattctatattgaagttatcctcaaccaagaagaccgggtttctgtggttctctaacatcacatcgttatacaaattctgctgagcagcatccaggtattgatactcctccggacagaattctatgtggctacatccctgaatatcagcagtccctgaaaacacacacacacacttcaagtggccatgggcagaattcttaaattgtctcaagattaaatgagtgaagagaactgattctgacttatactactgaaattgtcctataaaataattcccaacgaagaaatattctgtgttgtattctctatctctgagaaaagagagcataagattcacaacaccagtgtagtgtattgatgatattttttgaatgataaaagtacaaaattaacaacaggaacatagacatgtacatttttgagtgctcaatttaatcatacagtataagttgtatatttctcagattaaaaagtcaggcttagttataaagtacctctcaaattttaatgtgtacaacaataaactggagatctttttatgcagattttgtttcaagaaacctgaggtaaaacttgagtttctgaatttctaacaagctcacaagtaacaccaatctttctggcccaagataaatcttttgtcaaacattcattaagtggcagagcctgggtttttatgaccagtaaacaaagatgagagacttcactttttaaagaaagatatatgcaaagagaatctaagaagaaaagagagtttccagattacatgtgatgctttatgcacatcagctggtaaatgtccccaaggtactcaataataaagagaaaaatatctctacagtggaaaaaaattctcagagaactatttaactaagcgaatcaaattaacaccattgtaacagaacaaattttcatcatgcgctgatgctcacagaaggacacaatatcactgctgtgatactggcccccgccaaagaagcaaattataattcaaatttaatcataaagaaacaagttttatgcaaaatgcaagctacagtaatcgctcatgttgtgtaatctctaatagagtatttaggcagactttccttagcattctagaaagcgagtatctcctcattatttttttcaaaactttctgaattattctgggtaataaatgccatcctgttcaaatgtgcatattttaatcctgttccgcatggagttgatggagcacacagacagaacttcaacattacatattcccctttttcatgaatatctaagaaccccacctcttccccagtaggaatcttgggtatccatacctttccatgtgcaccagcaccagcaacaaagggtatttttctttttttttttttttcctttggagatggagtctctctctgttgcccaggctggagtgcagtggcacgatgtcggctcactgcaacctctgcaacctccacctcctgggttcaagtgattctcttgccccagcctcccgagtagctgggattacaggcacctgccactacacccagctgttttttgtatttttagtagtgacagggtttcaccatgttggccaggctggtctcgaactcctgacctcaggtcatccacccacatcggtctcccaaagtgctgggataataggcatgaaccaccgtgcccagcaaaagggaatatttttaatattacgagtcgtaaattaatgatgagaattcttcatggcggagaagaagccaagatgaagagaatgtcgagaaggctctagtatatagaaaaaaaatattttttcagagttccttgactatcatgagaagaaaaaatgtttaaataaacatatagggagaaacagcataaagtcaagaagtacaggtttgtaagttctaaacatacggcattccaggaggcaaagtgaacacagcgcctgatctgagacacagtcacctgagaaagagccatttttctcttcatcatcctcctctaggatttcttctcaggtgatattctctggacaagtcacacctgcatcttgggaatatgcctttaaaggaatcagcacaatcccttcacctgctaccaccacaaacacaggcagaaagatccaggcatgcagaaaatgtccacccatttatgttgtttataacaggtgagattcaaggacagtgaactcctccacgaagatcaaaatttatctttctcttttcctgccctcaggtgccctcccctgccacagacactgcaatttctgctacagcaatgggaatatgggccacactaacttgtccctaccaaatccaaccatagcaggccctgtgacctccctttggaataaagtttgaactcaactctcatgaatgtattttgaattcctcatatttggccctggcctcaacctggagtcacgtgaggcacttaattatatcaacaaggatgcttccacccagaacaatatacagagcctgcggtaagggcacaagtgaaaatatttctgcaacctggccatggaatcttaattagaagcctgggccaagaaccacttagctaagtattgcctctcaagcttcaatgtgcatataaatcatttggtaaccctggccccacactatgtaatgtgattctgcaggttttaagagggtccatgaaagtgcattttaaacacatctcctgtcaatgccgatgtagcttccccagacccatcattagtagcatttagctagaaaaagcaggcatggaacagactcttacactcatcacttatcacaacacaaatacttctcatcaaataaacaatcaatctctatcctgaaagaccacattctttgctagctctttaaagtttacagagacaggagaaggcagcaatgtctgcgtgtctgcattgaaaaacaacatgcacacatatacttatgcaatgcttattaaacaggtactatgtgctcaggagtctgttacagagcactctgctgggaacatcacattatgtgatttaatcttcgtaacaacttgagagttgggtactaagtgttcaataattctcagaatttagatgaaggggccagcattgttttcttctcctgtttatcttttttgaaatggagtttcgctcttgttgcccaggctggaagtgcaatggcacgatctcagctcaccacaacctccacctcccgggttcaagcgattctcctgcctcagcctcccgagtagttgggattacaggcatgcaccatgacactgagctaagtttgtatttttagtagagacggggtttctccatgttggtcaggctggtctcgaactcccgacctcaagtgatctgcccacctcggcctcccaaagtactaggattacaggcatgagccacagagcccggcctctcactgatttttttaaaaatgtatagcataagagataaatatagacagatgggagggatacagaaaggaaagggttaagtgtagttcagagggattttttattgtgtttctatttactttcttgtgactagtggagtaactactggaatggaatgtctctacaagcactggttttaattaaaaagaaagaagttaagacctcaaaatatatagtttattgctctaatttatctgcttttgggttgaatactgtgagcgtaagttctggaaaggcagcaggagccaactcccaaatctctggtctcctctaatgagttctgtgaggacagactccagggtgggaccagacctgaaggaggctcagaaaagggtgaatctggacagagctggggtggagaaacggtcctatgttgaattatgatctctatgctgctggagtacttcttgttctgtctttcctaagcctgtccaagagaaacttaagagtttgtataattttaatccatttagccactactctattttataacatataataacaatttaaccaaaatttttagggctttctaagataattttattagaaaatacgtattcttagcaaggtaaaagcaataaaaatacaaatagctctcctgtttgagatcttcaggtggtgacatcagaagtcacaacaacataagagccatcgccaaagtccccttaacaccccactttattgtactgactatatgatgcttaattaaaccatttatccagttgctctacactgaaagtttttgaatgacagggaccatgactgcttcatctatttttctaaagaccatatgaaatggaggcaatttgtttatcagtctgagtctccagaactcctgaattttttgccaaggaaactggagaaactctcatctgggtaccaaccacggagaatctttctacaaaagaaggaacagacactgaatgactcatttcccttcctctaacatggaagcagaattagacactcctgccagcctgacccaagtctgcacaggacatcctgaaatgtcttaaagattcccgggtgactgtgagaggattcctagtgaccatggactgatgaccctatgttgatccaggcaggaaagactcaagctgattctaaatagaaaatggaactgccctggtagagctccagaacctggatctacgtgtgatatcacctgttctgattagctagctcttaggtaatactcaagaatactctattccagtgtcacattttacaaataggtaaacttatgtcattgctctgggtattttgtggctttgatctctccttgctgacatgcatgtttacacttacagattgtgcaaccagattctatttacaccagcagcctctcacttaaccatagcaggtcactggaaaagatctggaaagctcaaagggatacactctgaaagaagggctttaagatttctatgctgacatctcacagatcagaaaatgtctcctatgggttttctgtacattctcaaaccaaaatctggctctctcctgtgaatcccaggcagagctcagctcttacgtgcagattacaggtaagatcaacctgactcttcattctttggtgttacagcaaggagagttaaaaaaaaaaaaaaaagtttccatcataaagtctgctctagcacatgatatgtcagcctaaaaagaaaaggctaaggcaacactcatttaagtagagagtttatttgggccaagcctgaggattgaaacctgggagcatagattcaagttgccttgaatgtacactttaattagcagcagttacaagtgcatttacaaaggcaaaagagagggacggggagtggactgaaacaaagttatttgtcagaaattcttcttgttctacagaaataacattgatgactaattggctatataatttaagctataaggtattgcttataacatctagtgtggcattattaggttaatttatatctacttgtagcaatagcaaacagtttcaagaggtaaaaacgtagctcaaaggaggcagaagaacataattatgttctcatttttatgtctctccgggcctgataaaactaaaaggacttgcactcctcagatcaaagttattctttttcctctaatctcaagaccgagattcagaatttggtactgtagatttaggtcctggatgggtggagaaatggcaggtgttaactgcacatttatgggaattttgggaggaggagaaagaggaacgctgagatactcacgtttactcaatgcacacgtcaccctaattgttcttctgggcctaacagtctccaattcagtttcaggtctgaagacactatggtcactgaaagaggtgaaatggctgattactgtcctgtgaattttgtcaaccacttgtagaaaggcttgacctctctacaagtggttgtagaggactatagatgtgaaataggcagagacacaattctgcttgcatactctgggggcagtgtgcactttgaagcaaaactgactgggttgactggaagcctgagagggaaagccttctccaaagtgaagattggtgggcaccttatacgtatatacaatgtctggtaattgtggacagtgtttgacaaatataattaaaaggaaaagacagaaaataaaaagaaagaataaaaaagaaaaagaaaacctttgccaaatcaaaagcaaaagcaaaataatggttctcaggtcctagacaaagacaatctggtagggaatgagacagaaaaagcatttatttctatgtaaaataattaagcctcttattcctaaattgtattttcttgtacaacagccagaactataggcatggttttgaacttttggacatctgaattttagtatgcactggatttaggcacctaaggggtggttctgaacacaccgtgtgcacatgaaagaaagactgtggggcaaaaagtagaagagagaggccgggagtagcggctcacacctgtaatcccagcactttgggaggctgagtcgggtgcatcgcctgacatggggagttggagaccagcctgaacaatatggagaaaccccgtctctactaaaaatacaaaattagcctcattacacattactgaggcaggagaatcacttgaacctgggaggcggaggttgcggtgagctgagattgcaccattgcactccagcctgagcaacaagagtgaaattccgtctagaaaaaaaaaagtagacgagagaaaggagcttccaaaaatttatgagtcggggaagaataaaagatagctggaaggactggtttgaattaaagatgtggcccaggagggactgtactatgaattttttgtgttcatgcaggcaggtgagattatgaacaggtagtccagaatcctaggttgatggagagaatgggttgctgctgcagattcagtgtctgagggcagaaataagctaggagtcctataggtacttgtgtaggtttctggcaagaaactctagcagcaaaggcactgtgatggaattcctgaggttggtgcctagtcctgggaggcgcatggccacattaatacctcctagtgggtatgttcatgagtaggtaaaaaccaagtgatggcagctgtaggggaagaaggtttgttctgagaactccttttctctaagtttccattcccctctcaccctgggagaactggaatcacaggagaatgtgcagtgtgactgctcatgtgcaggagaacacacagggtctgatccctagcccctgtgatgtctttcttctgacatcacatggctcaggcccggtgacgtctttcttctgacacctaatttgtagaatttcctgaatatccagcaattctccaacatcaaccagttgtttaacattttatctcacactactcaaaatcagtgcagatcccacaagtccagagtttagtcccacaatactgtccttactgcagatgcccgtcacaagtcccaggtgctcatctgtacttctgagtgactgtctagagcagctactttaaatggttcaaattattgaacccctcctggaattgaataatgtgattaaactactcacagaactcggcaaaacactatacttgtgtttaccagtttgttctataagatacaatgcaggaacagtcaaatggaagaggtgtatagaaaaaaggaaagtggtgtgaaaagatgggggcacacagaaaattttggtaaataactgtgattaataaaaatttctcatctattgtgttctccaggagcagcttaatgaaaataaacaactttcccattgtgacttagatgatgcttgcttttttcacctatcacatagccagacacagactctacaaattttcatcattttcccataaagaatcagctgaacaattgtctttagtgatcataacaacatactttttaatccaactttgcttaagtttctctccttccccagactcctgaactttgacccaatctcagtctgagcaaacatacaacctcatgttatgtccctgctaaaaagatactgacttcagggtaaaatattctctgatctagagtctgattttgccacccttcatcctgccctcccctcccatctcctttctaatcttgtttgcttctccctaggaaagacagcccttgtatgcctaacctttgaggtcctcaaagatcttatagtctgtactaccccctcttgtaatactcctttggaaattcaaaactttttacttaaatctgactttttttatttgacagagtctagaaacaaccccaggtcaataaaaatttcatcctcagaaagaccctcccaatgcccttccatcccaaccccagctgcatctgcctatggatccccagctcgcctgggctctgtagcttctctcagtagaaaggattcttccatggctggggtgagcgggctgggacacctgcaggaaaggctcctcaggaagaaataactggaccttcaataacctttttttgcagtctcaatattggccttagcttggagtcactgggctcaggcttcaattcccagtcagagttattcacttggctttttaatactaagtgtttgaaaaattcagcaaaattgctcaaacacagagtttatataagggaagaaaattttaggccgggcatggtggctcatgcctgtaatcccagcactttgggtggccaaggcgggtggatcacgaggtcaggagttccagaccagcctgaccaacatggtgaaaccccgtctctaataaaaatacaaaaattaaccagacatggtggtgcacacctgtaatcccagctactcaggaggctgaggcaggagaattgcttgagcccaggaggcggagtttgcagtgagcctagatcatgccactgcactccagcctggaagacagagcgagactccatctcaaaaaaaaaagaaaaaaaaaaaaaagaagaaaattttaaagtgcttacttacattccatgacttaacaaaaaaagcaaaactatccctttcagacaataaacatgtcattaaattattttataacaaatcatttagtaaacaattagtcacttgggaacactgctaggaggtggcaagtcccatctcataaaatttagcatttatactcaaaaatcaagataacaggatatagagcagagatagccactgtcacaattcaccctacaaaaatcggaactgttttgatgaatctacacatttcaccaactgatctatcatattttcttgtagaaatatattcattatctatagccataatggaataaacattttttcctattctttttcccagtagcactcccaaagctaagccctgggattttgtttgaatcttccctctcttaaaaaaaaaaaacacttgacaacctttctacactcactctggggaacaaaaaggcaaataagaatttttaacaaatggaatgtatgactaaatatttaattttttcctgaaacctacctttttcatgtcctttgtatattttcttaacctttcaagctctactgataaaatgtaatttacagttaaaaaactaataagtgaacaaatatcttcgaggtgaaaaacctagaaattcaaatgctcattggaatacagatgtgtttgattcatgtgtcaagtcaggccatccaacaaatgagagatcctcccaccctcatcctgatcgcttaagtgctcaatgaccatgctccaggagaaactatgctatgccccagtgagggcctcaagtgcattttactttgcaggttcttgcaccatctcactgggttgggtagtttttgttttttggactattttctttccttcacaaatctgaaagaatcaagggcaaaaattatttctctcttttaacctcagtaccagcatctgattagctgaccagcaatatgtctccaagaaatggaagctgggttggatgaaggcaaacttaatgtctcaaggggttagctttttagaggaagggtacaccaggagatgtctctctgacccagggcatccacctgctcccttgagaggctacattctttaactcaggttgtcttctggaaggaaaatgactcagaagctgatattcatgggacactctagcagacatggccaaggtgagtattttgggttatccctagacagtatgaaacccaggaccaagataaaactggatcatatctgaggacacatcaccttgtaaaaattccaaaggcaaccccaactcaaagacattctgggccaggcatggtggctcacgcctataatcccagcactttgggaggctgaggtgggtggatcacttaaggtaaggagttcgagaacagcctgaccaatatggtgaaacctggtctctactaaaaatacaaaaattagccgggcatggtagcacaggcctgtaatcccagctgctccggaggctgaggcaagaaaatcatttgaacctgggaggtgaggatgcagtgggccaagatcacaccactgcactccagcctgggcgacagagtgagactctgtcgcaaaagaaaaaaaaagacattctgataagatatctgtgcctagggaagataaaaggaggcacgaaggttttttttgtatttttttttgtatacttttaagttctagggtacatgtgcacaacgtgcaggtttgttacatatgtatacatgtgccatgttggtgtgctgcacccattaactcgtcatttacattaggtatatctcctaatgctattcctctcccctccccccaactcaggacaggcccgggtgtgtgatgttccccttcctgtgtccaagtgttctcattgttcaattcccacctatgagtagagaacataagaggcacaaaggtcttttacaattaagtatcagaagacaactgtgcttttttctcacgtgaaatggttacgaacagaaaacaaatctttctaaaagtgttatccaatgctttgtgaaaaaatgattaattaaaatactgtgtctgaaatgtacagtaaagtagaaataacggtaatgttgtgaaccatggaggggaagttagcatttgagaatgtcagaaagaactggaaagttagtattttactacaagagagggttaggctggaggaacggtgacggggaggtagacttgagaccctgcttgagccatatttggaaaatgcaagggaaaactagtccccagtggagtgtgaagataattagatagcaggcaattagaccaaggtggctctggtgccctgagttcctaagtttaaaaaaatttaactcaaaggcacttctagtaaatttctgccttgcggtaaacaaaattcaggcttaagcaaccacaaacctccaataaacctctgattacataaccaaaactttcccacctgcatcgtacaaataaggcgactacattactgtatccaaccaattattgaattcgatttgcttcctcactgcctctcgtaaaagcgtttccttcgggcgggcgcagtggctcactcctgcaatcccagcactttgggaggccgaggcgggtgggtcacctgaggtcaggagttcgagaccagcctggctaacctggtgaaaccctccattaaaaatacaaaaaaattagccgggcatggtggcgggcgcctgtaatcccagctactcgggaggctgaggcaggagaatcacatgaacccgggaagcggaggttgcagtgagccgagattgcgccattgcactccagcctgggagacagagcgagactctgtctccaaaaaaaaaaaaaccgcatttccttcaagccctcacaatggacaactaaaaacaatagttgggtgctctacgattcttgaatcgctctttgccgaaatttttaaatatttttgcagtgaccccctcactttttttttttttttttttttttttttttttttttttgtgagacggagtctcgctctgtcctccaggctggagtgcagtggcgtgatctaggctcactgcaagctccgcctcccgggttcacgccattctcctgcctcagcccacaccccccccacccggagtagctgaggctgcaggcgcccgccaccacgctcgttttttgtttgtttgtttctttgtattttcagtacagacggggtttcaccatgttagccacgatggtctcgagctcctgacctcgagatccgcccgcctgggcctcccaaagtgctgggattacaggcatgagctaccgcgcccggcccccaccctccccgttacatttttaacaggagaaaagagggaccggggaccccacaaatacacctctttgcatccacaaatcctgctcaccgagtcgagattctcccgtgatgacgctccaatcatccccgcacacgctggggaagacgcgtggctgtgggagccgagtggcacagggagggctccagactggggagccggtgtcgccacacaggcaggggactggagcccggggtcccagcttccagtccagccgacatttgtggccgagctgggccaggagggactcgggtccacaaacctagaagacgactgcagggaggcccagtcacgctaccgccgcttcggcagcggagcctagcctgccccccatctcttgggatgtcgagccggcactcaccatttctctgcttccaggaaatcctggcgtcttagctacgggtctgccagtccctgcaggtcgcacagccacagcagctgggcctgtaggagcagagtacgggggagcagttggggggcagttctctgtgaactgaagactagatctgcagccccagctgcggcaggagacaaatgcccccgccaacacccggaagccgcccttgtcctctccagctgcagcctgattgcccggttttcggccccgtgccccttattggataaagcttcaggccccgtccccagtccgtgagtgacagaagatgtgaccaaacactggactcaatgaggacggagtgacaacctaggctgcagcctttcctggcaggcctttatccctgctctgagcagggcctaccctacagggtatttgcatttaaccttgtgtataaggtcatatccatttataaataatatgttttatgttattcacaagtggaaagagtataatgagaattattttagaattttggatttcatgatcttcctggccctagtcttttgagcaagcagcctgagattacaaggaggaggtattcctctggagtaaaacgtgagccatgtgtgaattttaaattttctagtagccatatttttaaaaagtagaaagaaataggtaaaactgactgtaacaatttatttaacccaatatgttcaaaatattatcattttaatatgtaatcaataagcatgaagaatatatatatatatggtacaaaatatttgaaactcactccatattttacctttctagcactctcagtttagaccagtgagtttccaggcactaagtacccacaaatggcaagcagctgccacataggagtgcagctctgatttcagtggggtgaagggccagtaaaacatcccttttctgtcagaggtgaaaaaacagcctctcctcaccaacttctctcctcagatccaagggtataggagacagtgcccatacagggagaagagggtggaaaaaataaaatgttcacaggtagaccattgctgccaacctgctgcctgcctgccttctttccagaaatcagacagtaaacaaaggatgatagggccacaggagaggggaaccccatgtttttagatctggctcacagacttgacctccaatgtttagatatggagaaaatgaattaatggcaaacgtaatttgctatttggccatggccctaataatcaggctgtggttttctcttttctcctgtagtgtggggatcgtgtaagtataagtaccaatcacatgtgtacatgtctacatgcatttttgcattactcaacattatcttacaagatatccaactttaaataagggacaagaaaatcgatacctatgagatgctcactgttttcaagtaatagtaatcaatctgtttttgaatcctaccaggctgtctacactgggtgcatggattagttagttattgatgcataaaaaccacaaaaaacttagtagctcatgattgacatgctcagccatttaggcttggctcactgagccattcttctggtctgagatgaactccatcaggcatgtatggtaagctgctggttgagtaggcagcttgcttccaggggtaagctgactgtcaacaggggcatctcgcttctcctccccataatatctcagccttcagctgggtaacaggggcttgttctcatggagatggcagcattccaaaacaaaaacagaaggattcaagatcgtttgagcctaggctcaaaactagcacactgtcatgttcacaggtttctattgccctaagcagataagtccagccagatccaaagtttggaaaacagatcctgtcacttgatgctaatagctgtaaaagcaccttgctatgggcataaatacagaagggatgaagaattgctgccatttttgctgtcagtatcaccctgcctttccttgcatattaggtttatagaattcttttacatcaaaaaacttgtccgaagacccacagctactaagtggctggactgggactctggataaactctacctgactccaaagcccatgtgcctccacagactgcaccactcaactagctttcctcgaccttggaaatactgaagtgtgacacttccgtaatagaggtcagactccttttatattcatgctaagtagtactgtttaccactgggaataatcccctcaaaaaactgcagaagtattttagaaggacatgaaatagtctggggaaatgactgagggagaagttaaggaaatcaaagcccaacaacctcttacttatttttcatcataggagaaatttgaaaactgttaaaagaaaaaaaccttagacaaattaaatttagtagagtgtaattgagcaaagaatactttgtaaatttggcagcctccagatacagagtaggctcagagagactcaagcacagtcacataatggaagaagattaatggtcagaaagacacagtgacatacagaaaacagaagtgaagtacagaaacaaccagattattacagcctgggatttgccttatttgaacatggtttgaatagttgaccccctttgattggccaaaacagtgactgacccaagagtgggttacagtctgtttacacattcaattaggttttagtttaccatgtacagagaaaattttgaccaaaattaaacatgtaggaaggcagatttaggctaaactcaatttaacaattcctcccttttggtcattctctcaaatttgaaagatagagcaaaattttagatattagtattaccctgccccagtgataaatgcacttctttggtctcaaatcctactgtgaaatagcagaactgtgggttttgtaaagtggaaacaatgactttgggttattattttttaagagttggagtagaggagaactccttgtgttgaaaccttctgtttacagaagaaaaacgaaacctggtatgttttagaattaatccttgttttaagtttcagttcaattatgttgcgtttagcatgagtgactccatttcagcttggcttggtatgttggggctcagcgcatgagcttagttcaaaacaatggtgtccaccaagtctgtttaaaaaccccccattttggctgggtgctgtggctcacacctgtaatcccagcactttgggaggccttggtgggcagatcacgaggtcaggagatcgagactatcctggccaacgtggtgaaatcccttcttcactaaaaatacaaaaattagctgggcgtggtggcacatgcctgtaatcccagctactcaggaggctgaggcaggagaattgcttgaaccagggagtcagaggttgtggtgagccaagatcgcacctgggtgacagagcaagattccttctcaaaaaaaaaaaaaaaaaaaaacacctgtttttaaattttattttattttatttttgagacggagtctctctctgtcgcccaggctggagtgcattggcacgatctcggctcactgcaagctccgcctcccgggttcaagtgattctcctgcctcagcctcccgtgtggctgggactacaggcgcccgccatcgtgcccggctaatttttttcttttcttttttttttttttttgagacagagtctcgcaatttttttatatttttagtagagacagggttttaccgtggtcttgatctcctgacctcgtgatccgcccgccacggcctcccaaagtgctgggattacagatgtgagccaccgcgcccggccaaaacccacctttcttaaaatcaggttcttacttcagtgagagtgtggccaaaactcagggccttagcgccactctcagttaccatggttttgggtttccagtctcatcacatcattcacaggttactgtgtcctcatggttacatatttctttgaatttgtgattccagttaaaaaggaactatttgacattcgagagatggctgcatgcaaacatttatagcttttgagagaatacagtgcaccagggagactaccaagtgaaaaataccaagagtttggagtatgcattttggccagggatcacatgaaacgaaccaactaaaattaaatagatcaaagaatgagctaaataaagggtttactactgattttgatcaagtagtttgtttattaattccagacaactgaatctctgtaatatccaaagtattcttttatgtgcaactacaagtatcagtaactgcacagatacttctctgtttgtccagtaagcacataattctatacttagcacaatgttcacaacagaatttaaagtctgttgtgtagcctttacagtagaatctgctacagagcctattatgggggttaaattactaatcattgcgttatttactctaaaccatgaaaaaagaaatctaacaattgatacccatccagaagagtgaaggccttctggcaatgccctttatactgaaaaatttctatttaacctatgaagtaagtaggttaagagcagtgggccaatgttccttttctgatattataaggaaaaaaagtcccattaatatttctcacccacactggcccttcatctttcatctctcaaggcataagtttgtccatgtataaagttggctgcaaaatcctctgcatagatagtatactccatgaggggacaaaagactgcttttttatttctattgtttgtagggccataagcaggaaaaaacagagctaagagtctcatgacagcagagaagttttgattcataatcttagagaaaatgctgtgttaagaatgtcatctgcttctgaggacaaatttatctggttagctttacctaaaggtctctgatgtatataaaattctggcagggcttagtggctcatgcctgtaatcccagcactttgggaagccaaggtgggcggatcatgaggtcaggagatcaagaccatcctggccaacattgtgaaacccctctctactaaaaatacaaaaattagctgggcgtggtggtgcgtgcctgtaatcccagctactcaggaggctgaggcaggagaatcacttgaaccagggagatcacgccattgcactccagcctggcgacaaagcgagactctgtctcaaaaataaattaattaattgattaagttaaataaaattccaagaatctggagaggaccttctgaaatgtaagattataaacccaggggttcaaggtcccaaagttctgccacagtgtggataaaaaggagatattcagtatcttggttatagattataatgggattattgtccttcagttggtggaccattaaaagctttctttacctggaaaaaaatatgccttggcataatgcattaaagccttgctgcattaaaccacatcacaatttagtaacagaaaatacatgcagttctattattaagtgaatggaccttccaatgagtatttcttaagggtcaactgatgttgtccacactaagtggatcagattgtcatcaatctgcaatacatttgaccaaggtaatccagtcaattcagttatccttgcttaatgctgtagcatctgtaataattcattttacagttttacaacttttccagtgaaataagtacttctatcattgaaggttttatcagaaatgtccaatgaaaaaacatattttctaataacattttagttactgttgtaacatcagccttcttgcatgggaaagtttttatacaaccagaaaacatgcattgaaaatgacaattgaataaaacctgtgtacaaatgtttaaatgacccatcaggtttcaaaaatatacatgaagttttaattgtcttcctagaattatagatttgataaaccaaacaatggttataaactatgttagcaatttaaaacaatcaccatacatacatgacacacacacacacatttaatttatttaatttggattattttttctcttccatgagtcatgaaatgcagagcttttaataataaaagccttgaagactcaggaaaaaccaggtagctgtctagcttctccacaagttcatgtttaacagtggattcatgtccttttaaataccaggtttgtttctccaatttagatgcatagcactaataactgatggcttatcatagggaatttgacttgaaccacagagttcattcaaattgcatatctaaacaatctcagcactggctagtttagtatgaaaatctggcaaaacattttcttggtattcaattaatttttgtctcgctttgattaggagttttataagtcattcccttcattagagttctgagggttgttacccagtccaaatgatacaatcctaaagttatctaaaacctgtatgcaacatgtctgggttcttaccactcttttcatgacctccttaaagacataacactctaatattttgtgtgcttgtgaagtttttagaaactgcatcagaattaagtcagtaactatagatatgacttaaaatggtcatacttaaatacacagttggtggctgggcgcagtggcttatgcctgtaatcccagcactttgggaggctgaggtgggtggatcatttgaggtcaggagttcaaaaccagcctggccaacatggtgaaaccacgtctctactaaaagtacaaaaattagctgggcatggtgataggcgcctgtggtcccagctacttgggagggtgaggcaggagaatcacttgagctcgggaggcagaagctgcagtgagccgagatcgcaccactgtattccagcctgggagacacagagagactcaaaacaaacaaataaacaaaaaagatacagctgtcagggaaatttggttatatctgtggcctacagtaatttatcaaaataaccataattataactgatagtgtacattcagatatattagaactttagaaattccacataattttggaacaaacattaataacatatttattaaaagataacttgaggcctagcatgatggctcactcctgcaatcccagcactttgggaggctgaggcggtgtatcacgatatcaggggtttgacacaagcatggccaacatggtgaaaccccatctttattaaaaatacaaaaattagccaggtgtggtggcacccacctgcagtcccagctactcaggaggctgaggcagaagaatcgtttgaactgaggaggtggaggttgcagtgagctgagatcgggccactgcactccagcctgggcaatagagcaagactccatctcaaaacaaaaacaaacaaacaaatatatataagtatgtatacacatatacacatatatgtgtatatacgtatatacacatatatgtgtatatgtgtatacatatatatatttgtttgtatatgtgtatatacgtatatatgtatatgtgtatatacgtatatattgtatatgtatgtgtatatatatataacttgaagaaagttaaacatcattattcatttgacaataatttccatgtagtttaacatattctgtaatcccatttacctcttttttggatgctgcggggtccctctgtaacatcccaaagttgagtaaaagaaaagacaattttggagctcaaatttgatgttgggaagcctgtcaaatatgtcaaaggtttaaaacatttgactaacatatgatcaaaggtcatcacaaaataacagtcattcatgtagccgaaggaataattaaaataatttagggctgagcatggtaacttatgactgtaatcccagcattttgggaggctgaataaggaaatctggctgtcctggtttgagcccaggagttcaagaccagcctgacaaaaccccatcagtaaaatatatatattttttactatatataaaaatatataatattatataatatatatgaacataatatatataaatatataaatattactatgcatataaatatatatatatgggtgtgtatatatatgtgtatgtgtgtgtattttatatatatatataaattagctgggcacggcggtatgtgtctgtggtcccagttacagaggaggctgagacgagataattgtttgagcctgggaggtcaaggctgcagtgagacatgattgtgtcactgcactccagcctgggtgacagagcaagatcctgtctcaaaaaatgttttcaaaaaacaaaacactttactctttgatagaggagactcagttttccaataaacagacttgagaaaaacagcgtgaaataaagtctgtcttttctctactctccttttcgtttactcaaaaggtgaacaaaaatatttgctttcttttattaataatacatatcaatacaattttgttcaaaaatcaaagtttacttttatattagtttatcaatactaaagctatttttaaataagaacttataaataaatctatcaaatctgtcatcttttgaccacactagatttccatacatttttataatttcttgtaattaaatttcttaaactttttatattttagttttatctgcatcctttttgtgcttttaatttgaaacaatcttttggtaactttaaactgttaccagatgatccagaccccaaaagagggttcttggatctcatgcaagaaagaattagaggcaaatccatagagtaaattgaaagcaagtttattaggaaagtaaaggaataaagaatggctattccataggcagagcagtggcattgggctctggttgcccattttatgataatttattaattatatgctaaacaaagggtgaattattcatgagtttcctgggaaagtagtgggcaattcctggagctgaaggttcctcctgtttttagaccatatagggtaacctcctgatgttgccatggcatttgtaaactgtcatggtgctgatgtgagtgtctcttagcatgctaatgcattataactatcatataatgagcagtgaggatgaccaagggttactctcatcaccatcttggttttggtgggatttggccagcttctttaacacatcttattttatcagcaaggtctttgtgacctctgtgtcatgcagacctcctatctcatgctgtgagttagaatgcctaacctccttagaatccagccaaataggtctcagccttaaaaaccgagtctgtggtgcctcctttgtttttcccatggatttccaggctgttagagcttaaatagccacttttaattaagcttttaaccatagtgctctttaaaaaaaatcattttaattttttttttttttgagatggagtttctctcttgttgcccaggctggagtccaatggtatgatctaggctcactgcaacctccgcctcccgggttcaagcgattctcctgcctcagcctcccaagtagctgggattacaggcatatgtgaccacgcccagctaattttgtgtttttagtagagatggggtttctccatgttggtcaggctggtcttgaactcccaacctcaggtgatctgcctgccttggcctcccgaagtgctggcaaagtgctcccaaagtgcttgcataggaaagagccaccacgcttgtagcaggacaagacgcagacaaaacctctcagacaccaagttgtagaaggaagggctttattcagcttggagcatcggcaagctactgccttaaaatccgagctccccgggtgcacaatttctgtcccatttaagggctcacaacactaaagatttcatgtgaaagggtcgtgattgatttgagcaagcaaggggtacgtgacaggggctgcatgcaccggtggtcagggaggaatagaacagggcagggagtttcacaatgttcttctatacaatgtaaggaatctatgaataacatcagcttctaaatcataagttgatttttaactactgggtttaggccagccaggcccaggcctggtttcgggcctggcgcccggctgcctgtctttggttttacttccttgttctttttactgaatatgaaacaatataaaacaaagcgagagggtctttctctcctctcactcccagcccatttaaaatcttttatcacccgactttagccaggccaaatggccaatatttctgtgctcagtgaaaggaaaattcaagatcattggtggaggggaagagaatcaacaaatgataaaggtcatgcagatgtcaaactaggaagaggtcactcaaaccagaaaggagtcattccctaagctgggaatcaaacccgggcccaccattgtaaaacagcaaagccttcactgctaagctacagcactaggtggtttctattgctcttcccagaaggagtctagagtagcaaattttgagcttttaaaggcttttcactgctcaagataatttttagacttaactatgacatgaacccctgaattcctgttccctggaaggaggagaccaagagaaagtactgccacatggttacaaggtcaagttcccaaggacttaactgaccagtttgctggggtgtcttgaacagtggacttatggggccccaagctcatgttctatcctaagttacccatctttctgacagaaagatacagaaagacataatcatagcacaaagtacaacagatcggctacagcttaactagcctaacaaatccttcttctgattaatcaacactttacagaggagataaacagtgatgcttaccattcattcaatcggtttgcacagagagataaaggaaagggaagggagaaaagcattgcctatggtggggtggggaaggcaagaagctcaggggggccagagagagactcattcactgcagcaacactgaatcaaaagttcaggcagccactcatcagtgttgaaaagatcttttccagcagttccatcagctctcaagtttctcccttttggggaggtaaaagctcaccatgttccacaatcctgtacatgcctaatcctgtcacccacaaccatcagcagagagtgcaaggcagattaatctaaagaaaatagcagttaacatcccatagtgtcaaacccattcttagccaagagggactttactgaaagggtggcctctaaccccctaaatcgtaggaaggacgttaaccttcctaagttgggcctcaaacccaaggctggtcaagcatccttgcctttttttaagagaggcctttaacactctgtgtcttaggagagattctaactcccctaagttgggcttctaacccaatcccatcctttacctgggtaaatgcacctcacttacaaagtcagccaatcagtggtacagtctactttctttgggtcaggggtctcctcattatcatccctttgtggttcaccagaaaaatgttaccagaaacgggtcttaatctagaccctaaaagagggttcttgcatcttgcacaagaaagaatttgaggcaaatccatagagtaaaataaaagcaagtttatcaggaaagtaaaggaataaaaaatggctactccataggcagagcagcagcatgggccactggtagcccatttttatggttatttcttcattacatgctaaacagggggtggaaagtttcccaggaaaggggtgggcaatccctggagctaaggagtcttcccctttttagaccatatatggtaactcactgatattgccatggcatttgtaaactatcatggtgctggtggacgtgtctcttagcgtgctaatgtattataattagcatatgagcagtgaggaggaccagaggtcactctcattgccatcttggttttggtgggattcgaccagcttctttaccatatgcagttttatcagcaaggtttttattacctgtatctcatgcagacctgtctcatcctgtgacttagaatgcctaaccacccttggaatgtagcccagaaggtctcagccttattttacccagcccttatatgagataaatttgttctggttcaaacacatctgacaaaactgaaaaatttttttaaacaaacacatattttaatgcctttataactttcctcatcaaaagcacatcttgcttgtttgcaaattatgcagaattgtttgtcttacacattacagatgtacttatatttataattaattccattaactcttagtaattctcatttttagcgaaatccctagaaagcaattttgaatagttttgtatccatatttgtatataaaaattattttataattgtttaaagaaatgtgtcttcaatgttctttttactaacagatctaaatatactcagcttttctatatcacataaaaataagataccaaagcatataaacttaaggtgatatttaataattaatgttttagtattttaatgtacaaatgactttgattttataaacattattaaattaacataacatgtctttaagatcttaaattattgaaaaggattttgaaactatgacctgggtacattctctaatgtctttctcagtcatcctggtgaaagaagagaaaggccagggcacggtgactcaacgcctgtaatcccagcactttgggaggctgaggtgggtggattgcctgagctcaggagttcgtgaccagcctgggcaacattgtgaaaccccatctctattaaaacacaaaaagttagctgggcgtggcagtgtgtgcctgtagtcccagctacttgggaggctgaggcaggaggactgcttgaacccaggaggtggaggttgcagtgagccgagatcgcaccactgcactccagcctgggcaacagtacaagactgtgtctcaaaaaaaaaaaaaaaaaaagggccatatgcagtggctcacgcctgtaattccagcacttcgggaggccaaggtgggtggatcacgaggtcaggagatcgagaccatcctggctaacacggtgaaaccccgtctccactaaaataaaaaaattagccgggcgtggtggtgggttcctgtggtcccaggtactcgggaggctgaggcaggagaatggcgtgaacccagaaggcagagcttgcagtaagccgagattgcaccactgcactccagcctgggcgagagtgagactccgtctcgaaaaaaaaaaaaaaagaagaagaagaagagaaaggaaccaatcaattaagcagatatttagaacaaagtcctcagaaaaattccttttataacaagagagttgcctgaaagatcaggctgcaaaacagataagtaagtaaggtccaacattaaaaaaaaaaaatgccttctgtgtaatcagcaagtttcacatatatatggtgggcctcagtgaacacattcctttccttttgaggacatacttagataagggaacttgcacagtcagggggcttgcttggaacatgcctgtagttgcacagataagaggaaccaggcacatccacaatggaaaattctgtcacctaacatatccacagttaaggaaagttaaacaacatggaataacttagactaagagttcatgtgcatactagaaggacagggtgaagctgtcaggaattcgtgccttatgcaaataaaatacatacttctaaccggttttttgcaccttatgtaaataaaacatcctgccccactatcttgcccgtaaaagtctttgtattcggctgggcgccgtggcttacacctgtaatcccagcactttgggaagccaaggtgggcggatcacaaggtcaggagttcaagaccagcctggccaacatagtgaaaccccatctctactaaaaatacaaaaattagccgggcatggtgatgcacgcctgtagtcccagctacttggcaggctgaggtagaagaattccttgaacccaggagacagaggttgtggtgagccgagattacaccactgcactctggcctgggcaacagatcaagactccatcacacacaaacacacacacacacacacacaaacacatacacacaaaagcctttgtattcaactgtgaaatggcaaccctcttttgggccccctctccatggcagagagctttcttcttttgcttattaaacttttgctcccatctcacccttgctgtctgtgcttcttaattttcctagtcatgagacaaagaacttctggtgatacctcaggcaatgaggccatttcactgggtctcaaatagccattggcacacaaaatggctatgaaggacagggcctgattgaatcctaaattgaaataacaggtatgaagttcagcacaggagagggatcccacattttccagaactgtcaggaggcaaagctaggccagaaaaagggtcatattgcacttgatgctgccttcagctgatggtctaggcaatgagtgcttgtccccaggcctcaccatgttcacctatccagacccctgaatccacagactcaaaaccaaaattgtaagacaacagtcacatcaagcaagtatcaaagtatatctaactgataattttgaagccagttctatttaccaggaattttaaaacatgttttatttacaacatattgtcacatacacatagcacaaacacacagacagaagcagattttacagctttcatttaaaaattctcatttgctgacttttaaatacttttaatttccctattcaacatatcaatcttccaatttcctgcttctttgccctaaatgattgttagctaggcaactaatttgcatgtctaaaggaacaactcttgggtgaaacaagaacacttatatttttaaagcacaaagctaacactttagggaaaaatattggttttgtatttgctttttttcccaatccttacaatctgtgaaaggcaaaaatattgtatcattaactcaaaccaagaaaagtatggtgtaagtaaaagtttagttaagacaaaatagaaagcaccttaaacaaaggtataatgtgtgagttttaaaataataagagtttctaacgtacacaggcagacaccttacaaatggagattttcttaatagatgtaaatttcttttacaaaatgttttcaaaacaaccagttaaactccaagaagaggtgttttagtttaatatgtggtctttttaacttagctcctctttcctaactaaaatcaccgagtttagggtggagcccattaaagaacagggcaaagaaagcattctcttatggctggagtcaggaaggataaatctgaaaaaggtgtgagcctattttagctgagggtctacctttttttttttttttttttttgagactgagggcggctggagtgctgtggcgtgatctcgactcactgcaacttccactacccaggttccagcaattctctttcctcagcttcccaagtagctgggactactgacgtgcaccaccacacccagctaatttctgtatttttagtagagatggggtttcaccatgttggccaggatggtctcgatcttttgacctcatgatccgcccacctccgcctcctaaagtgctgggattacaggtgtgagccaccatgcccagccgggcctaccttttataaacactttatctaggataacttttttctcaccttcaggaagagcatagtttaaaagtgtagcatagttaattgtcttaccagtgattcacttaagccttttcctttgcctcttattgtctttttaaaaaacaatattgaaatctttttataagcttgtgcacatcaacagtcattcctagataagactaattagaaaaacctcattttcaaatacacctcttaaaatgcagtattgtttatttggaacattccattgtaatttcaaattacctttagtatgtttttgccatttctttaagaatttgctgcttctggggtctaatacttatatatgtaaatgtagccatagctaggaggtggattattcagttcttaagaaattaagaatcccatttttaccttgaatcttggctttggcactgttcttcttgatcaatttagccaacaatttttccctgcctaaggtcataagaaaaagaaacaaaagcactagaacataaaaaaactctgtcaatttccaaaaaccaaagtttatatgccctgtaatattgtcatttactattggttgatatctgacctattcagagaaaagggacctctaactggattccatccagttaattatcaaatccaatgggatcctgaacccagtcatatttctgtcataaatttctaaccaagtttggattagaaatttgctcaaacaaacttggagagctcaaaacacaaatccataatgctttgtgtaagagttaaagaaagagtaaagaaacacaaaatgcggctcaacagttagagacagatttatttttgagaaaatataactgtggggcttctggccaattttggtcaggagcactttctcttacagactaagagtatatattggttttagggtgagggtgcctatcacaagcttggaattcttctgtgtgagggagaagttttatggagggattgaaatgtctctgggtggaggggaggttatcttggggataacatctttctggccagagaggggttatcacaaggctggcgtcttcctggccggagggaggttatcttggggctagcatgtctctggtcgttgaggagtttggaatgtttctgtttggagatgttatttgtggtttatggttgtgctgaccttagccattaggctgacgccctttggatttaggcagtttttgatcaaggtgaactttagaatgaggggcttgtccaagatggcgacgctcctactctgtcaatccagacaccatagttataacaaagatgaggggtagcatgttctttctggctacttcttgctgatgaggggacagagagttttctggtctcaggttgactataggagcaatgccgtctgtaggtgtttttgcatagttgtctgtggaatggccacgatcctgccgtctgtactaaaaatacaaaaacaaaattagcagggagtggtggtgggcacctgtagtcccagctactcgggaggctgaggtgagagaatggtgtgaacctgggaggtggagcttgcagtgagcagagattgtgccactgcacttcaacctgggtaacagagcgagactctgtctctccattggtagagagacaaagatatgtgttggtgccacacaaaaagtacaggccttgtcgtgtatacaggcagagatatggaaggggaataagtgaactaaagatggagtgtttttcctttcctgtcattcattactccagatggacaaagaggaggccacagagacacctattatagtagaaacataggaagagttattttttacacacttaatttgatcagatgttgcaccattgatattgagccatggaaaaaggtgggcacaagggacagcacaagttatgcaggaggtattggttgagggagaggccataaaatgagccggacagagaaatgctccatatgcttcaagtgatatttggtagttaacttggttagtttgatggtcagggagtatttaaaaatgatagtatggttgcactggttaggtgttaaggatcctacagggagatttccctcagaggctgaaaagcaaagtgaggcatgttgtaaaaggtgggtgtgtttagttataggccctttaatgggagggccttggggcttgaggcattgcaaggagttgtaatagatttgaaataatttgatagcctgattggccctgcaagtaggataatcatcaacaagggtgtcagctctttcaaaaaaggaagctcctttttggaatttataaattagggttatgctccctcctgaaaggtcatgaaggggtgcgggaagggctgtgtaggctgaggaaaacagcgataagcacgtccagcattccagagcaaaggaagagttagcttgcagcaagaaggactgtgtaaggtttatagagtgttcaagcttgagagcagtgaggagtggttgtattggtgaggttgatttacttagggaatttatactgaaaaaaacaagcaaaaagagaaaaagattatttgggtaggagtaaagtcctggaaagttccttgaagccataggtcccatggaacagcaaggaggtgggctgggctcggtggctcctgcctgtaattccagcactttgggaggccaagacgggtggatcagctgaggtcaggagttcgagaccagcctagccaacatggtgaaaccttgtctctactaaaaagtacaaaaattagctgggcatggcggctggcacctgtaatcccagctactcgggaggctgaggcagaagaatagcttgaacccaggaggtggaggttgcagtgagctgagatcatgccactgcactccagcctgggagaaaagagcaagactccatttcaaaaataaaaataaaaaataaaataaaagaacagttaagaagctgatcaggttatataatgggagttttgtaggggtaccactgaaagtctgtaacatggtttgttaggaagtgatgaaagtttgggagagaaagacacataagtggtttatgtggatttttggggagacagacaggtcctggggagacacaagagaaggctgaagggattttatatttggttggttgggtatgtggtgaagggaattctgttttcttgagagcagtataatgaatccagttagggagtacctggagttttgctgccgtgggtgtggtaagaatgatttggtaaggtctctttcatttaggtgtgagggaggaattgggggtagggctgggatcttttaccaggaccaatctcctggctgtaggaagggattagaagagttggtgacgagttgtggcaggtatttgtcagcatatttccaaatgaaatggcgtatggtatgtagaagaggggaaacagggggagttggtagaggtggcacttgacccacagatggaacaaatggggcaagtggtctcccatacatgagttcaaaggggctgagcattaagggtttatgtgggagagcccaaatttttagaagggccaaaggtaaaagtgtaactcagcctttatgtgtttggagtgagtacctggtgaggtgttttttagagtgccattcattttctcaccctttcctgaagattgaggtcgagaggggatgcatagcttacaggcaatttgtagggcttgtgcaagtgtttgagtaatttgagagatgaattcaggaccaatgtcagattgaaaagaaagaggcacgccgaacatggagatgatttctgttgttaatttggaggtgacagtagaagcccatttgttggttgtggaaaaagcctcaagtcatcctgaaaaggtatcgaccagaactgaaagaaatcaaatcctttttactgggagcatatgggtaaaatcaatttgccattcctgtcctagaaggcgtcccctggcttgggaaagaaggaggtttagtgttggagtggggtgaagcatttcagcaaatagaacattgatgggaaatggcttttagctgttcctttatatctgggcttatgcgtatatgggagcttaagaaatattgtaagataagatccccatacaacagtagtttttcagggtcaggtaggactaatttgttttttgtttgtttgtttttcttttgttttgttttgagacagagtctcactttattgctcaggctggaatgcaatggcacgatcttggctcatcgcaacctctgcctcccaggttcaagtgattctcctgcctcagcctcccgagtagctgggattaccggtgcgtaccaccaggcctggctaatttttgtatttttagtagaaatggggtttcaccatgttggccaggctggccttgaactactgacctcgtgatctgcccaccttgacctcccaaagtgctgggattacaggcgtaagccactgcacccagtcaactaatttgttttgtatgaaccagtatgggggcttgaattgtgcccccactgtgactagttgttgtatttggtgttctggataaaagaagggatatgttgtataaagggaaataggtattgggggattggatgattggttgaggcttgttttgcccaatagttagcctcatgatttcctaacgaaatgtttttatctgattgaagtcctttgcaatggataactaaagacttttctggaagcaaatgatggattagttttccactaatgataggagttcccttagccataagatagccccactcactccaaatttgggcattggaatagatgatgttgtaggcatatttagaattggtgtatgtattaacttgtgtgctttttgctagggctcttattggggcaactaattctgcttgctgggagaaggaggatgtgcccaaaggcaagggggcagcctctatgacccttctaggtgggagagagtgagtatcatcatgatatccctcaatgatggcatatcctgcttggaggggagggttttttgatgtgctgccatctataaaccaatctggggctccatttatgtgagtggaagtaaggtagtgaaacatggtgagacaacttttcttttattttctttctttttttgagatggagtctcactctgtagcccaaactgtagtgcagtggcgtgatcttggctcactgcaacctccacctccagggctcaagcgactctcatgcctcagcctcttgagtagctgggactaaaggaacttgccaccacacccagctaattttttgtatttttagtagagatggggtttcaccatgttgcccagggtggtctgtctcaaactcctgagctcaggcaatccactggccttggcctcccaaaatgctgggattacaggcataagccactgcaactggccaagaactttcaattaaatcagagcatgagtggtggctggggtctaaaattcgtgctgaaggcaaaagagtggcggaactaatggggagcatctatgaagagagatagacagttgaaggagagttgcatgtaaggcctacatgagagaggatgagatggaagtgatcacattatggctgagcatgtcttgcagactgtaagaagaaaatacctgaaggggttcatagaatgtgaatttttgtgccttagggataattagagagggtatggacaaaatttttaagcaaagaggccagcctttctaaatggggtctagttgttttgaaaaatatgctaccagttggagggaatctcccacgggctgttctaatagtccaagggcctgattataagaactgtgtaaatatagatgtaagggtttcaaggggtttggaaggcctagggcaggggcctgtaataaggcatgtttcagtgagagacaacatgataacggtctggggtgggagtgagtgtttggtcaagctttccttttgtgtgttcatacaagggtttagcaataatggcaaaatttgctgtctataattggaaatatccagataatccaaggaaagaaagtaagtccctttttgttttagaaaaagggatttgttgaatgccttgctttcatgctggtggaattaatcgagtatttggagttatgattaatcctaggtatgatacttttggagaggttaattgggccttccttctggacacccagtacccacatttagccaaaaaacttaaaagcctggtagtatgttgattacaatgttctagagaggggctgcaaataagtaaatcatccacatactgaagcaagatgctaggttgtagaggtagctgggagaggtctaattgaagtgcctgactgaaatagtgagggctgtccctaaaaccctggtggagcacagtccaggtgagttgttaagagtagcctttgtcagggtcagtccaagtgaaagcaaaaggttttgagaggagggatgtagaataataataaaaaggcatccttgaggttcaataccaagaaatggctagtgttgggaggaattcactataggagggtgtaggggtttgggacaacagaataaaaaggaacaacagcagagttgatttgtcacaaatcctgaaccagtctataggaggcatccagctttttgattgggagaataggagtattgtggggcgaatgggtgggaattaaaatactggcagtcttgggaggctgaggcaggtggatcacttgaggtcaagagtttgagaccggcctggccaacacggtgaaaccccatctctactaaaatacaacaattagccaggcatggtggtgtgcacctgtaatcccagctactagggaggctgaggcaggagaattgctttaacctggaaggcagaagttgcagcgagccaactttgtgccactgcactccagcctgggtgacagagtgagaccctatctcaaagaaaaaaaatacttgcaaccaaaacttggaatatgatgggcttgagtccccataatccattagctttgaggcgatattgtggggccactatgtagcacttaagatccttcactgaaatttaattggagaatgatggacagctattatgggggagttggcgttccatactatgggatttacctggctgatgaatttgggttttaagactttttgatgtggagtgtctgaggaggggttttgtttttgacataataagttagggtggctttgatgtagggccaataaatgaatgattccccctagtttgtgtaggatgtcccttcctagtaaaggagtgggacagtgaggaatgaccaagaaagagtgtgggtggttccctgaaataagcagtataggggcgtggggttttgcgtggggtttcttgtatgccctttatgccaacaacagaaatggatgaacattctaatgggccttgatatctggttaatactgataggctcaccccagtatccaggagagaggaaataatcttactggatactgtaccaattaccctgggttctgtggactcactggacatgggagctaaggatcctggtcctcaatggacatgggggccaaggatattccattgtcagcaccagcagtgaagacatttcctcctgtgacagtcagggggcctgattatgagctgcatccaaatggggagggtgtccccgttgggggcagtccattttccagtgtccccaaagactgcaagttgggcacggtttgttggaggccaggggttagaacaagactttgttttaacatctttattgccacatacaaaacagactcctggagaggtgagggagtttcccttggggttatcggggggcttttgtgtaactgacttttggacagcagaagcgagcatctggcattttaaccagagatgtttgtctttttgaattttttgttcctcatctctgttgttaaagacatggaaggccacatttaggagatcccactgagatgtttggggaccctcccctaatttttgtaatattttctggatatctggggcagactgggaaataaattggaggtggagaagtttgcccttctctagattctggatccagactgatatattttagcatggcttcagtgaggcatgataagaaaatggcaggattctcctaggtctcctgtgtaatttctctgagtttttcgtaattaactgccttatgggcatttttgttcatccctgagaggagacaggtaatcatgtcgtcccttcacctgatgccattgtctccctgttggtaagtccaatctgggtctctatggatgattgcatcattggccactggattttgtatagcggctttgttatggagttcatctgtgtgggcttcagctgaacaccagatatgctctttttcatcaggagtgagggtggaggttagaattatataaatatcatgccaagttaaattaaaggattgggttatgtgcaggaattcccggtgatcatgggaggggttttcagagaaagatcctagatgctgtttgagctgcgacaaatcagatatggagaaagggatgtgaacatgagcaatgctttcaaccccagccagttactggagaggaagaatggcagaggtggtttgagtggtagtttttgaacaggtaacaggtggaggaggaggagtggggtctggtgctgaaggcttgggggcaggaggggccactggggcagagggttcagtcagtcaaggagcagatgcaggggatgggaatatggggggagttcatctgccaggtcaaaaggggtttcagaagaaggggttttgatggaaggggttttggaggaaggggttttcagaggagggagagacccggggagggttttaattgagaagaaggattttatgaggggtgcaaacttgacatagggagggtcaggatctaaagttgaagaaagcctgaatatagagaacctcttgccatttgctattcctggttataaagctgtcaaggtccctgagaatttgaaagtcaaaggtgccatttttgggccatcagctgtcattatctaatttttattggggtcaggccatgttgcaatgctttggctaaagactaaatgctttggcttccccagaagccaactttggcaaggttgtgaaggagacagcccagtggagaggatgtaggaatgtgtgattgtttggcacccatgtagactggtgagaagaagccgagggtgtctgtttttgttctaggcatccccagatgaaagacagagacctggagtcctctttctaaagagaatggtcaacctgagaagaaactgggtgtccccaagatttcttctagcttagtcccgctggtcctccaaggaccaggatagcagatctgactttcccaggtaccgcaagaaagccaggggaggacagatcttacccatcagctggatgactatctgatgttggatgttctggttggaataggcaaagggcctctttgactggagctgcacgaggaagacagacagagagaagggaggatgagggaggaagaggagagaagagagcaaaatacccattgtggccagtcagaggttgattccggagacctgagggtttagagaacttcctggggaatagccccagccagagccttgcagtccccttcaggttagttgtcctcctcttgcaaatcggtcaaaaagtgaaatgacagaaaagatggggtgtgtggccagaaaccctcaggatccaggaattaactcaggatgagctgccactgcccactgcttcctgggttgcaagagactctctgtccccagaacccatcctgggtttccgcaccaaatgtaagagttaaagacagaggaaagaaacacgaaatgtagctcaacagttaaaaacagatttattttagagaaataaacctgagaggggcttctggacgatttcggtcagatgcattctcttttacagactaagagtatatattggttttagggtaagggggcttatcacaagcttaatgtttctttgtgggggataagttttatggcagggttggaatgtctctgggtggaaaggaggttatcttgaggctgacatcttccggccacaagggggttatcttggggctggcatcttcccagccagagggggcttacctcggggctggcatgtctctggttggggaggggtttggaatgtttctggtcagggatggtatttgtggtttatgataatgctgaccttaggcattaggctgatgccctttggattcaggagtttttgatcaaggtgaactttagaatgaggggcttgtccaagaaggtgatgctcctgctctgtgaactctcacactgacatagctaatattgtctggtgattttccagatgacaaccgctctcctaaaaaatctaccaaaggaacataatgatctcagtttggataaatggctgacaaagagacaccatattgaaaatgaaatataatgctatcatgaaataacggctttacaataaaaatttgacaatgatagagaaagcacaaataagttccacaaaactgaaagggacttaagcccctacctttgttggtcattcatgcataatgaaagataattctgattagattgctcttctctagaaaaaaagcacatggctagttactgttagtaagttttgtcatcaaatacagtatgaatcgtgggcatcatctttccacatatgaagaacactacaaacattctaagggtctaaattataagaaaatacaaatagactaataactccatgaaataatcataataatgcagcaatgttgcattcactaagtaaccatttttgagatcaagatgttactctttcattatagatatgggaatgcagcactgtcagtggagatgtattcctgtaagaaatacaagatatataataaaatatatttgtagaaattctaatatatttaactttaattttagtcacccatagttttaatcaagtaaaacagatgccaggagatgaataattatttacctttgtcaacataactataaaaggaatactaattctcactatttttctgtttgctccattatatttgaacattggataatgtttgatactctgtgtcctactcattttcttaaattttatttaaaactttttttgttttgagacagagtttcgctcttgtcacccaggctggaatgcagtggcatggtcttggctcactgcaatgtccacctcctgggttcaagtgattctcctgcctcagtctcccaagtagatgggattactaggtgcccgccaccactcctgtctaattttttgtatttttagtagagacagggtttcgccatgttgggcaagctggtcttgaattcctgacctcgtgatctgcctgccttggcctcccaaggtgctgggatcacaggcatgagccactgagcccagcctatttaacttttaaaactattaagttattaaattggtttacaaaatatctcaacacaattgcaatttattgtgtatctcatgtttcaaaatccttcccttagaaagacatcaaaatgatttaaaatcaaaatatgtttcacaaaatatgccaacacaaagtattgaataattgactctgtaataaacctaataatgaatgagtaaattacaaaaattttatccctagctagtggtgacttctaaaggggcaatttcagtaaaaattttaagttcaaaaaaatagtatctttaaaaatacaacgaagacatgaaacttggaacttctaagttaaaaaaactgttgagacaacatttttcagaccagaatataaaatggtttctttgatttttattccctcacaatcatggagaatcaaaccaaaaataaatatagaaattattcaagaatgtcagatctttttgaaattatttttataaggtagatgtaaacaaataaaatatttgtttttgtaaagggggttacacaagttttctttagactataaataacaagaaagcaggaaccattttctacatatgttccaaataataagtgctattaagtgctcaatcaatatttcttcaataaaaagccagcattagtatcaagtgctagaaataaaaacaccattaaaattatttcaatgaatcatcttgaaataaaatttaaagaactatcttttttggctgtgcgtggtagctcatggctgtaatcccagcacttttgggaggccgaggcaggcagatcacctgagatcaggagtttgagaccagcctggccaacatggtgaaacctgtttctactaaaaatactaaaattagctgggcgtggtggcacatacctgtaatcccagctacttgggaggctgaggcaggagaatagcttgaaactggaaggtagaggttgtagtgagctgagatctcaccactgcactccagcctgggcgacagagcaagactccatctcaaaaaaaaataaataaataaaaaccaaaaaaaactatcttttttgctgtggtgattctttatcaggtaatgcctgatgaggcataaatgaccaacacaaaacattccagactggaaaaattcaattaagggaaacatttttttccttttaaagatgttgtaggacttttccttagttcagctaaagacagggtccttgtcacacggtcatgaaatattcggctcacagacactttgaagggtgagaaaaatggaatttattaaggataaagaggaaccagggctcctcagcagtacaagagtcctgctagcataggcttcctgcttcacagattgaattccaggttccactcaggaagggaaggggccaggctccccccaccgcgagcttcccaaggctccaccccagtgcacacccctcccagtgtgcaggccggtgggaggttctctgatggcccctttttactcagctgcctcattcctccctctaaggaagtacatctaactaccgttagaataaggatactgcttcctgctatcaggagcagtctggggactcaactgtcccctcagaggcctatctaagggtccctggcagaaggggccaatgtccaaggctccagctacctgaccattcaaagtctgatggctgaaggggagaagagacacagcaggttattagaaaacatgcatcaaaacgaaacaagaggaggggtaaggacagctcaaaagtcccaaggcttttcaccagtttgcacacggagagggaagccaaaagcccaactggtaaaacaacaacaacaacaacaacaacaacaacagcaacaacaaaacttgaactttttgccagcatattgggcttctgggttcccttcccctgagcccagtgctaagccaaccagtttaaggtttgggaaattaactttttccagtatggagaatgcatctgaggaaagtgtcccatagtatggagacacaactacctatctgtgaagagaggacagaggaggagaaaggaaaatatgtttttatcaaaggagtcccagtgtttcagcatgcattcgaaagggtcacagactgaagatgaatggctacccatttagaaagaagggagcaggcgtgcctggttcccttctcttcctagcagatatacctgtggtatgtgagggagagaaggaagagtgtcccctttcccacttccatccttggatccctgagtgctggcaaccttggcagatgccacccataggtgccaaagcagcttgcacctgtgaagcagggaggacctagagaataagaattatctactctcacccatgtctctaacccacctactctcagtagccttggcgttccctagacctcatttatgccatggatactactcatccatgaaaaggaacaaaataatggcattcatagcaacgtggatgaaactgaagaccattattctaagtgaagtaactgaggaacagaaaatcaaacatcatgtgttctcactgataagtgggaggtaagctatgaggatgcgaaggcgttaagaatgatacaatggactttggggacttcggggaaagcgtaggaagcgggtgaaagacaaaatacaacacattggtcaatgtacagtgctcagataatgggtacaccagaatctcagaaatcactactaaagaacttatccatgtaaccaaacaccacctgttccccaaaaacccatttaaataaaaaacaaaaataaagagacaaaaaaatttaaaagtctaggatagggaaaaaaagaggtcttatgaatctataagacatacttctgtcagcgtgcctaataggtttacgtatttatgtgttgtgtgcacaatgtttctctactataaacagagagctctaattcgttgtcttaaagaaaaatacaagtgcataaatcaaccattttatcaataaaaaagactagtcaaatggtttttcaagttcatgtgacttaagtcacatttaagctggctttcaagttattggcaaaataatattagaaatgttgtaagaattattagcatttttgtttgcatttgttgatcaagtgatttcatgattattcctgaagaatactggaagatttgccataagggttataaaagtataaaacccagcccaagacagaatgatctttgcttgtgtaatttttgataaataggacatggaatatcttggtttaatgaaaacagctaaattctgagttattggtaaaaatacccttatatttaaccttaagagtctcacttaaataaacatctgaaattcacagctataaaaatgattaacagggaattcaatttaaataatgactatcaaagttttcataaataatctaggtaaagggggggcaaggtggctaatgtctgtaatcccagcactatgggaggctgaggcaggcagatcacctgaggtcaggagttcgagaccaggctggccaacatggtgaaaccccatctctactaaaaataccaaaattaactgggcacggtggccgggcacctgtaatcccagctactcaggaggctggagcaggagaagcgcttgaactggggtggcggaggttgcagtgagccaagatcacgccattgaactctggcctgggcatcaagagtgaaactaactcaaaaaaaaaaaaaaaaagcctaggtaaaatattaaataatctggtaagtgtaatggactaaatgcttgtaaagagacttgccatacgattagggatctaagattattagtagatattaagtaggtaatttccaacttaaaaacacaggaaaacattttttaaatgttcttattaaaaggtaaatatctctgtttaattcaaagcttctttaaaagttatgtataaaacaaggtaaaagaaaccaggaaataagagatgtaagaaagttaaagctataaagaggcatttttggtaaaggtgaaaaggaaacaattttacataagaagacattttgtgtggtaaattttttgtcctaaaatgactaggttgttcaagaaagagaaatatttaggcaaaacagaaagtttaagcatgttgtgcatcatctacataggttgtagaaaggttagttaacagaaactttgtgttttttttagaaaacgaggttgtatacttcagttgggtgtgattaagaattataatggtctttctagaggtgggtctttgatattaacaaaattacatgaatacaaaaaataattggttaaaacaagattttatttaaaatatttattttttatgagacagagtctcactctgtcaccctggagtgcaatggtgtgatctcagctcactgcaacctttgcctcctgggttccaggaattccatctatatttctgagcaactgtccataaatcatggacttccataacccccttgctcaagtttaataattcgataaaactactcacagaacttagcagagaaactttacctatgtttatcaggttattatataggatacgactcaggaaaaccaaatggaaaaaaaaaaggtataggacaaagtaaggcggggaaaaaatggggtgggtagtaaatcttgataaacagccatgattaagaaccctccatcctttgtgttctgtaggaacagcttactgaaaataaatacccttttcattatgacttagatgatgcttcctcttttagatatcataaattcacagactctctaaattctcatttttctctcataaacaaataattttgtcttcagtgttcagaacaaaatacttgttaaacaaactttgcttaagtttctctcctttcctcaggctcccagactctggtccaccttcagtctgagctaacatataccccacctttatgcccctcctaagaaaaggctgactttagggtggaacattctctacccttcaatctgattttgccattctccattctcctctctttctcccaccttccttctaatcttgtttgctcctccatatgaaactgtacagtccttttctctcttgagatgattgtagatgtgatgcttggtgctttccccattgcaatactcttttcaaataaagtcacttcttacctacatctgaatttatttgacagtatcaagaaacagcctcaggataataacaattacaccctcacagaggacatcacaacccgcctcccatctcaactctcacaatgtctgcctgtggattcccagctttccagggctctgtagcttcactcagtataaaggctccttcaatggctgctctgagcaggctgggatagctccaggggaagctccccaggaagatatgactgtgctattcatgaactcctttgacaggtcaagattggccttagcctgcagtcaacgggctcatgtctctgatttccagtcaaggttattcatttagtttttctttgttttgttttttgagacagagtttcactcttgttgcccaggctggagtgcaatggtgtgatctcggcttaccacaccctccgcctcccgggttcaagcgattctcctgcctcagcctcccgagtagctgggattacaggtgtgtgccatcacgcctggctaatattgtatttttagtagagacggggtttctccatgttggtcaggctagtctcgagctcccaaccccaggtgatccacccgcctcagcctcccaaagcactgggattacaggtgtgagccaccgcacccacctacagaatagatttatccactgtcacaaatactccactgtacaaaaagagaaactaatttttttttttgtaaatcaccaattgacctaccacaatttcttgtggaactatattaatttctctgcaggtataaaggaaaagaatttttccttctcacccagtaatatccctaaaactaagctctgagattctgcttgaaaccacccccagaaggtacagacctcagatatttattacacattctcaggagaagaacaaataaaaataagaatttttaacaaattaaatatatcattagattttttgtgatagtcacttttttttgagaatattttcctatctttcaagatctgtcaataaaatgcattgaatacttaataaaaatgcaagttgaaatgagaaaacaagtcttttcaagatgacacaccctgaatgcaagttgaaataagaaaacaagtggcagtactggctggaatattaatacacctgattctagtgtcaagtcatgatatcccatcatatggatcctcccacctctattctgctcattgaagtactcagtgaccaccctctggagagcctcttcactgtggccctgaatgtgcctggagtgcatttttctttgcaggtcattgcatcatcttgatagaatggattttcattgtctttggggatagtttttctcccttcccaattctgaaaaaatccagatggtaggaattatttctgtctttcccctaagtatcaccactcaattggctgaccagcaatgtgtctccaagtaatgaaaactggggttggaaaaagaaaatttttatgccacaatgagttagctttttagataaagggtaaagcagatttacaatcatctaccagtaataatttgaagattcaagttgattatctacaaataaaatatcacaggctctgatgtgtaagttctggatttaacatgacagtgcatacactgcatgggacaggtactatacatatctggacaccacaaagagtatttaacgcctgcatttaaactactgaattagcatgtacctcacttggctcagtaatccacctgcaccaaactcatatcaaaagtcactaaatctctcgtctacattatatatattctgtagatacacaactacaaaatgtacatactatacaaatagtttgaatcaacatgaagttccattgtttttgacaatgtacccacagatggacattatcatggctaaaatctatataatatagatgagattataaatctaaggttttaacactaacaaaagacaacccagagcatcttggtaagtcttgtttttattttcttcctgagagtcagtagaatggcagctgtattttgttatgttagtcccatatatttctgttaactttattatttgcaaaaaaagttttgcttgtatttgtagaaaggtaaaatggttttttttgttaaatatggagattagttatgtatgataaaaacaaatgtgcttttgtttctttgttcccaattaatgtacattaattttaaaatgcattaaagcaatagcaaagaaaataaagagatgccatagaaatctctttctcttcatgtttgcatgcagagatacactgcttcctaaggatatgtaaggagagatgtggattttaattttagaatcagatttttcaaatgtacttaaaatataagcagcaaaaattttattaatcttaaactcaagcaaattccaatcacagaggcagaactaattaaaacatgttttaattgaatatacttcctaggtttctcctagcaatcctgttattgtttcatgatccacttgaagaaatgaagatacgtggaaaaatagtcattgcccaagattgccctccattttataaatgctccatttatgctgaaacaatctgaatagacacggtgctttttgtgcatctggttggaggacagaaactccccaaacttttctattcagctgttggatccacaacttgctgttgagctgtaaatccacatcaggaagcccaggtacaaactgagagttggcttctccctggtaatctaaacagatgcttactgagcctgaaatgctattttcccaccaccttctgctgactgctgctttggcaaaataaagattggccacgaatctaccaacaccacctcactttaaggcctggtatgtcagcattctccatcatactctgagacatagcatgtgggagacatgactctgtaattaggagcttaaagtgtttcagggagaccacgtaaatctagtgagaagtgaattagcaatatatgagagcatgtaatttcatgttaaggcgggtgctgtgaacttgattacattagtatgtaagttaaagcagctgggagaggcagaccagaaaatatagttgttgagctgagtcttgagagaagggcaactgcaccttccaccttccgcgtgcaggactgtcatcagcacatcttccccatgctttcccattgctcatattcctccagtggaaaagaagggggccaggcacggtggctcatgcctgtaatcccagcatggtggctcacgcctataatcccagcactttgggaggccgaggtgggcggatcacgaggtcaggagattgagaccatcctggctaatatggtgaaaccctgtctctactaaaaatgcaaaaaaaaaaaaaaaatcagctgggcatggtggcgggcgcctgtagtcccagctacccgggaagctgaggtgggagaatggtgtgaacctgggaggcggagcttgcagtgagcccagatcgcaccacttcactccagcctgggcaacagagtgagactccatctcaaaaaaaagcaaaaacaaaaaaacaaaacaaataaacaaagaaagacagaaaggaaagggcaaagttcacatgctgaagcaagagggactgccagacttagaaaggtggagaaataggtgggcccaggataatattggtgagaaggctgcttttggttgatttagttacagagcttttgagctcatcatgaatagaaatagggttaatgcagagcggctataagcatagacttgggagccaggctgattgggaatataagtcccagcttcaccttttatgagctctatgatcctggacacttcacctcttattattcagttttctcatctgggaaaaacagataacagtacttaaatcctaggattcagaagagttcaaggattaactcaggttaagataagtgaaacaagggagaagcaactgttcagacaagaaataaaaggaaattgacaaggatttccatttgaatctaataatcgtttagggtatctgttacaattttagattcccaggcctcagccccaggaattgagattcattagttctggggcccaaaaggctgttttataaaaagaaacttagaaaaagtcaccaaaataactcagtttctgtatgcccttaccagttccccactaatgtgaacatctcgtgttgacatggtacatttgttaaaactaaaaagtcaaggttgacacattactactaactccagacttcatcaggttttccactcatgttctttacctgtcccaggatcaaatccaggataccatactgcatttagagaagctgcatttttcacaagctctttcagctgctaagagggaggtgggtggggatcacatcttgaaaaacactgggaccgttacaggaatgacgcaaaattgctgcatccccaagttggggaggtgaaatgcaattttgaagaggagaattggtggaggagatgaatatagaaagctgattttagaggtagagatggaatcctctccattagatgagagggtgttaccttcagaacaaggcattaatgccagagaaaataggttttggaaggaagaggtacaacctcatattcaggctagattgagaatacacgagtagggttgtgagtaggtcagaatcagcaagtgcagcaaactgggaacaggtgtttcagagaacgcacacagagggctcacataagggaattacaaggggtcagttagctcgtgagctacatacaacctgcatgttccagaacctggtgctaatgctttggcagtgggtcacgatgacaaatatcaagcactgccacattggaaagtagtagaaaaggtaagggtgaggctgggataatcaattttatttaaggagggttctaagggtcttgggtgaaacaggggctggaagaagaggtgtataaaacacttgaagctctgcttgtgagtcagttgtcacactgaggagacacaggagtcaccagcttgaggtgacaggtaaaggtttgtagaattgagaaggtgaagatgaagcaatatatttttttaagaagcaagcagcctattttgggaatccatggaggtcttttgaagtagatactactcatattttactaaagaccttaggttctgggactatcactgagttttcttaatcacagtccaattgctcagcttcctaacaccagttataaaagtcacctaacctgttcttttttagagaatgttaaccattttccaatggactcaagattcttataatgtctataccatttttctttcccagttagttgttctttctgtaccctagaaatcctaaaccacaagctgatattctttaaatttcacattaagtacatgttctgtcacttgccaaatgcatttaaaagagttcaatagacgcaaggcgcagtggctcatgcctgtaattccagcactttgggaagccgaggtgggtggatcacagggtcaggagttcgagaccagcctgtagtgggcacctgtagtcccagctactcgggagactgagacaggagaatcgcttgaacccgggaggcagaggttgtagtgagctgagattgcgccactgcactccagcctgggcgacagagctagactccgtctaaaaaaaaaaaaaaaaaaagatagacttcagtagaaattgccttagaaacctgtgtcctatggggcaggcttctgaagggctcctagatcttttgcgttgctcgctggcacattgttgggcccaactgggtaataagtgtctggccattagacttaaggtcatctaatccttaacttgatagattctgggtgttctctacaaatttgcatagaaactagcacttacctgggagatttctctgccagctgtcaaaaatgtagttccatattcaacggtcctgtgtgaggaaataatgaagccacagaaatcttaaatgtggttagggaaagggctgggtgatgaagattctagctaaccagcacactgcagcaaaattagtttccagaaacactgcataacctgaatacagaatcaagagtaatttggcttttggttaagattggctttggcatttttttttttttttttttccgagacggagtttctctcttgttgcccaggctggagtgcgatggcgcgatctcggctcaccacaacctccacctcccaggttcaagcaattttcctgcctcagcctcctgactactgggattacaggcatgcaccaccatgcctggctaattttaaatttttagtagagacggggtttcttcatgttgaggctggtctcaaactcctgacctcaggtgatccacctgcctcggcctcccaaagtgctgggattacagacgtgacccaccgcgcccggctggcatgttttttttaaaccaaggaatagtgtatttggaagtgtgggaaaactacatcaaaaaactgaaccttgagttgtaataaaatcaggatttagtgttgcttgatttcagtgatatatgggcatctaggttacaataaaagaaatgtgaataaaagaccagaataaaatttctctagaaacattgagccctaagattagatagttcatcttggaataaactatataaaactgccaataggcaactgcttttgtgctacaaaaatggccatttcacttggctcaaatacatatttcagatctttgtcttttccttgtaatgaagatgtaaaagttttagttcacactataccagagtaaaatttcactggggtctgtattacaaatgttaaaataacccaaaaagtcaaagtaaatttgagctttggtactcagataatcgttttcatagtcttatgttaaagaacttatctttcccaggtatcaaactctaagaaaactgctatagttaccacctactagcaacttagtttccttgccccataacatttgtcagagaacctgcccagtttcagtgacatttatattcttattctaagttgacccaatttttcatttatctaaatgattgtattcccttctagaattcaagccaaaggacagaacaatgttagtgttccttattctattgatttactctttttttgagacaaagtcttgctgtgtcgccccaggctggagtgcaggcatgatcatggctcactgcaacctctgcctcccaggttcaagcaattctcgtgcctcagtctcccgaggagctaggaccataagcggttgccaccatgcttggctaatttttgtatttttagtagagagggggttttgccatgttggccaggctggtcttcaactgctgggttcaagtgatctgcctgcgtcagcctcctaaactgctgggattacaggcgtgagccagtgcacccagccctgacttactcttgaagtcatgaatttatgtccagcgtccctctgtcaaactggtttttaaatctttgaccactcatatatgtcaggacttctacttagttaatggcatattataaggtgcaaaccatcttataaacaaggattcatcatacactttttcttctaagtttaacacagatcattgattctagtttgcaatttatcaagataaggtgataagttgaagattttaccttaggtgctaaataattaaaatggataaaaatacaccaatattatcaggatttagtgaggatcactgaagctgagtggctagaattttaattctaaaaaaaaaccaacagtgatttatttttaactaaaatgtaaacttgaaaacagtgtgctaaagtcaaattatgtggtttaagtcaccctctgtacagcaactttaaatctactttctgtacttccattttgtttctgtgtaactgaaaacttcaaacactctcattctaattctacactattcctggaaatcctttctctttgatatatttatctaatttcatattctaatgtgtttttcctttcagacacaacaatcaactactcaaagatgccatctaatgcactatgccactaagtattgtggccagagagttattttaagtgtaataaattatcttaaaattgagggccgggcatagtggctcatgcctgtaatcctagcactttgggaggccgaggcgggtgaattgcctgaggtcaggagttcgagaccagcctgggccacacagtgaaacccagtctctactaaaatacaaaaaatcagctggccgtggcggcgtgcgcctgtagtcccagccactcgggaggctgagacaggagaattgcttgaacccggcaggcagaagttgcagtgagccgagatcgcgccactgcactccagcctgggcgacagagctagactccctctgaaaaaaaaaaaaaaaagagaaaacaaatattacatcttaaatacaggcatgaattaaaccaacttgtgtatggtcaaggcaacttacaaaaatgctttaagacatatcaagactgatataaaccatttaagttaggcagagatgcaacactatgtgaatagaagtgttataaacacactcgccacattttaattagtttactaggttttcttttaatataaacatgagaaatgaaaaccacatcaattgtagcatttattttgaaaataaaactgcaatcaatactccaatctctaagctctgcattccataaatgatactttttcaggaggtaggattcctaaggtttatggaagttctttttaaatagcaggacatgaaatatgatacctgcatccaggctaacatgtgggataataaaatgtattgcatcacctactactattagggtccaattccttctaatttgttacatatgaattaacatggatcctcctctttatcacatctagggaaaataatctgaggtgatcaatgcagataaaagccttgcaaagagctactttacaagagaaaagggcactttataaaaacacaagaattccaaaagtcttagtgaaattttaagctttgatacttgtagaagtaacaatgctacaaacatttacaaatcattgaaaagcttgttgtatttcttttacgtttatttagttttgccattttttaaagtgacagtgtctcattatgttgccaaggctggagtgcaatagctatttacaggcacaatcacagtgcactgcagcctccaaggctaggcctcaagtgatcctccatttaagcctcatgagtagctgggactacaagcatgcctagctcctgagtattaagcttttaatttattgtttcagtccttcttgaagatagcagatattgactgaaacaaaaggttaaaagtttaacattcaaattctgcaaaataaagccagaggcagtggtacacacccatggtcccagctacttggtaggctgacatgggaacattgcttgaggccaggattttcaggctgtggtgtgctatgattgtgtctctgattaatcattgcactgtagcttgggcaatatagtgaggcatcatctattaaaaataaaaagaagaaatacaattacactttcaaatgatattttgtaaagatttacagcatgtatacatatgctgcagtcctctggagggcccaggcacactatattaaagctaaaaactgccctgaaactttcaggacaccttgtattttattatttttatataaccactggaccaccatgctgcttggcactatgaaaacatctttgaatacatttacttaataagaaaatttatcagcaaatgagaaccattatagttcataagaaatacaccatagagcttcataaaagtagataatcaataaccaatactttctctttttatgacccccaaacatgctaaactgctaataagaagggcttacaaaggatacgaatggcaaatgttaattggcagcttttgcttgatgatcgccagtaactgtagcttccatggtaaaagtaggaagaaagagcccttccatacctgacaatgctgggactgctcctagtggctttaggagttgttagactcccatgttttaacagtgatactgcactgattccaaatgcatatgcaggaatattggggaaaagaaaaaaacataaaagaaacagaaaagttatctttaaaatctaaaaagttaaactattgttttaaaagccttacatagttcacagctatcagcccacacattaagcaaatatctgtacgtgggcaggagtcttcactttgaagtggtttttataactctgtttacattaaacaggacagaagagtgtaagagtgtgttgttgccctgacaaggtcccattctttactacgaagtgcaatcttagttgtccttgagttaacttgaattgaggtgtttcttctttagaaaataccaacttttctagttctttagcaggagaggtgatattttcctgtcttttttgatgaggggttcagatgttaaattactcctcatttcttccttcagaagaggatggccttagcacgctgaagatgaattaaatcatctgcactcagagacccattcttggcagcactgtagaaaactttgtcttgttccatccttgaaaaagcctaagaatgtcaaatagaaaagaggtacaattttaaaaaggtttccaatcttttaacaatcaccactgatgataagccacacatgcagactcctttagatagttcagttacagctactttttgttttttttggttttttttttttttgagaaggagtcccaggctggagtgcaatggcacaatctcggctcactgcaacctctgcctcccaggttcaagcaattctctgcctcagcctcctgagtagctgggattacaggcgcctgctagcatgcccagctaattttcatatttttagtagtgacggggtttcaccatcttggccaggctgatcttgaactcctgaccttgtgatccacccacctcggcctcccaaagtgctggaattatacgaatgagccactgcacccggcccagttatagctactttggctgaggtttacactgccaagttttgtcaactcattaaggtaatctcagggctagaattagattgctggagcaaaggggaacttgttttattaagttacttaaaaattgggctcccaaagatgtcacagtattgtgacaggcttctaagagcagtatcatgttacctgtgcacttgttccttaaacataatgaatgtacacttttgcaaaaagttagtttattaatctacttaaactctacccaatctacagtagttattatatactttaagcaaattttaacgatgcaggcatgtgctggattgtattgaaacatcaaagaagtctaatgactcaagcatcaaaaggcactacttcacttgtacattaattatgatagaaaatgtattattttaaaatacttccaaggtaccacaaaacatgcctattttaaatgttcatccttgtcagctgtaactctgctgtgtacttaccaaaagtcacaaaccataaatattactttgtctcataaaagttatcatttccagtaaaatcccatgtatttcctgcatccagtatttgagacgcgcacaccttatacagtctaagtgcaggtctcttggcttaggcactaatgctttgtctaacaaacccatgggactgactgcactgtggtatatacagtaggaaatgacataaatttgcaaactgagtaataaaaaatagtcaagagtggtaagtgcattatgtatgtagacattgcttggaatacaataaaagaaatcatttatatatgatgatttgaaagggtaaaagttcaaaagggaaagattacaaatgaattaaatttgactaaaatattctgaattatgctcacaaaagagaagataatatctataatttcaaataatgtggatctttgtaaaaaccataaaagatacaggaaacagaatgccaaaaaggtaataagctcttcagtatgttagttaattttgaagctttccatttttctaatcactacttaatatgacctagtcacagatgttggcattggtgtttgactgaaaacccaccttagtaacttcgtagccttacctccagcttccaagctctttctctgtcaagaagataaactggtgaatacaggccgttgttgtgtgccaaggtgcgaagatcgaagtagaatctgctataaacactgttagtaatgctgttattataattaattagcttcaagaattgcctttccaactcattcctggggaaggagaaacacaacaaaaccaacacaggacaatgttagttcaaaaacattattctcgtgtaagaaatgtggtaaagtcatcatgtgctctagtttattagaacacatgaaagaactcacactgtacagaaccctattgatctaagaaatacaagaaagcatgcaactttcccagttctctttgaaaacttagaaaaacaaaaaacaacatgaatgtaaaaactgggttaataacgcgattatctcacgtgctttcaaagacatatttgaatttaatatggagaaaaacgacttaatcttaagaaacatggtaaagccttcagctttttcatttctttgaaaacatgaaaggattcaatggagaaaacccttgtaaatacaaacatccatggtaaggccttcagttgttccagttccacatgaagaacagaactcatttctgaaataaaacctgtgaatgtacagaatgtggaaatgccttcatgtacatgatatttgctccaagacccatgataacacacactgtagacagaccttacaaatataagaaagcacactggattggaaccctagtagattaccaaattcagaaaagttttcagttttaacaatttcttcaacatttatatgaaaatttcccctacagggaaatcctctccgtgtttcgaaattggagagcctgatgcaaactgattatggcataatcttaaaaaatgtgcataagtaaatgttatactacttataaatattttgtttctcagtgattcttcatttgaaagggtctctgtccttacttccacttcttttgcaagaaaacactgaggtcaaaattttgtagatactccttaaacaatattaaatgaatttaataggcagtgtttttttgttaagtcagttaataaaatttttctctgtttatttaagaatatcacactgagctactagaatagctccaaattcttttttgaaacaaatacaggctatgcaggtggattcctacactaatgtccaaacagggcacagctgcttgcagtccattctgcatccagcaccccaagtttgggatgaggagaaaggggacagccttctctgcactcgtgcagctgactcagggctcattcttgagggttccattgcacaactcagactccatggtcactcccaaggcaccacaatagtgatcagatgacagaaatgatggatgccatttattagctgtcactattacggggcaggaatactctttacatttcagacggtagaaagatcaaagagaaacaccttggctagactaaacccattttatgacaagccttttggtagggttctggccttacacagtgtttctcctaagttggaaatgaaaccccaaggtgctcagcacctgtcacccctggccagaacagagtgtggggatgaattgaatgcagtgagaggggaacaggctgggagcagccctctgccaaatgattattcagctgtcccggccgaagatttttgtttgtttgtttgttttgagacagggtcttgctctgtcgctcaggctaaagttcagtggcatgatcctagcctttcaagtagctgggactacaggttcatgccacttagctgggctctttttttaaaattatttttgtagagacaggctctcacttgttgcccaggctggtgttaaactcctgtgattaagtgatactcccaccttggcctcccaaagtgctggtattacagacgtgagccactgtatccagcactttgtcaaatgtttaaataaatataaaactagagtaatcttaccactttcatagtaatccccataaagacttaactgtataaaagcaattaatacctcaacaacatatttggtttcttggttttaaagttttatccattggctaagtcaacaaatgcttgctgttctctggtatggaaagcagttaggatataagcagatatatggttttctcatttgtttaactgaaaaccccactgaaactacttctaacattagtttcctattcatataaccataagactataggaatgtaaatcagataacgctttaataatcagctaatcaggagttaatttactataggaatctatgcacttcataatctcttatgtttttccacaaacatattttaaatgtgtaaaatacagtattttatataattaacatgtttattaatagaagcttagttattgaagaaaaccattatgcctacaggatatgtatcttcttagttttttgttgttttttaaatggctaatagcataccctttaccggcgcagcaaattttctgaataggagctgctcagtttaacttatatgtatgtatgtatgtgtgtgtgtgtgtgtgtgtgtgtgtgtgtgtatatatgtgtgtgtgtatatatatatgtatgtacatatacatatatatatacacatataaaatcctcatagcttagctctcacctataagtgagaacgtatgatatttggttttccattcttgagttacttcacttagaataatggcatctagctccaactaagttgttgcaaaggccattatttcattctgttttatggctcagcagtattccatggtgtatatattccacactttctttatctgtccattcattgatgggcattccatatttttgcaattgcaaattgtgctgctatcaacatgcatgtgcatgtgtctttttcatatgacttctttcgctttgggtagatacctagtgtgagattgctggattgaatggcaatactgttttccatagtggttgtactagtttacattcctatcagcagtgtaagtgttcccttttcaccaaatccataccaacatgtacgatttttcaatttttaaattatggccattcttgcaggagtaaggtggtatcacactgtggttttcatttgcatttccctgataattagtgatgtttctgaaggaaaatatattctaagaagacaaacagatgttgaaaagttttaagaaaaatctgataaacactaatttttaaatggttcaatttacagtccaaaagagatctttacaatcaacagtagagggacaagataaatgtacattacacactttgttgcaatgttttacattttctaaaaatcgtgaacatagctcctgttcagagcatagatcaaggtgcttctgcattcacaaacagcattgtgtagaactggagctggcttctgccaccactgcttctggagctcacatctgtggaaacctgcacatttctctggatattctctgaccttgtaactagaactagagccccaccggattagctgcaggttttgagaacaatttagctgccattatagtggagctaagtgttcataattacaaattttgctgccttcaagaaaccagtttacagattgatgacagtagtgattaagagcactttagcttctgcaactttcaaagtacttctatttgtttcaaattcattttctgttacatcctttgctaaaatggctactagcaatatcaccgtgacaactcagtttctactattagcaaagcagtaatttagcagccatttcaaaaccaactgaccaacactagtgagtctcttcttagtcacaagaatcctcaattcactggtaaatatacagtgtagtaattctgaatgaaagtctttaaaaatgtttttggggtatattataagtgtatatatttatatggtatataaaatattttgatgactatgacgtgtaataatcacatcagggtaaatgaagtatccatcatgcctcaaacatacctttgttttacaaataattcaattacactcttttagttactataaaatgtacaattaaataattcttgagtgttgtcaccctgttgtgctatcaaatactagatcttgtttattctttctaactatatgtgtgtacctattaaccattaccccttactcctcatcccccatactacttttaccagccctggctaacagttctcctactctatatcttcatgaggtaaattgtttgaggccaggcgcagtggctcacacctgtaatcccagcactttgggaggccgaggcgggtgttcgagaccagcctggccagcatggtgagaccccatcactactaaaaatacaaaaattatccaggcatggtggcatgagcctgtaatcccagctactcgggaggcagaggtagaggaatcgcttgaccccaggaggtggaggttgcagtgagccgacatagcaccactgcactccagcctgggtgacagagcaagactccatctcaaaaaacaaacaaacaaacaaaaaaactgtcttaatttttacttcccacaaataagtgagaacatgtgaagtttgtttttccgtgcctggcttatttcattcaacctttccatccatgttcttgcaaataataagatctcattctcttttacggttgaatagtacttcattgtgtatatgtaccatattttctttagccacttatctgttgatagacactcggaatgcttccaaatcttggctgttgtgaatagtgctgcagtatacatgagagtgcgggtatctctctgatatactgatttcctttcttttgggtatatacccagaagtaggattgctggatcatacggtaactctatttttagttttgaggaactccaaacgtttctccatggtggcagtacttaaattacattcccactaaccatgtatgagtgttaccttttctctgtatcctcaccagcatttgttattggctatctttagaataaaagccattttaagtggggtgagatgatctctcattgtaattttgatttgcatttctctgaagatcaattatattgatgttgagtatcttttcatatacctatctgctatttgtatgcctttcttagttttgaaacagggtctcactttgtcactcaggttggagtgcagtggcacaatcacagctcactgcagcctcaacctcccaggctcaggtaatttttgcacctaagcttccccaacacctgaaaccacaggcacgtgtcatcatgcctggctaatgtgtcctcttttgagaaatgcctattcagatattttgcccattttaaaaatcagattagatttttttctatggagttctttgagcttcttaaatattctggtaattaatcccttgtcagatagttttcaaatatcttcccccattctgtgtgttgtctcttcacttagttgattgtttcctttgctgtgcagaagctttttaacttgatgtgacctaatttgcccatttttgctttggctgcctgtgcttatgaaatattcaagaaatatttgctgagtccagtatcccagagagttttcccaatgttttgcttcatatttcaggtcttagatttaaatttttttaatttttaatgttttaaaaaatagagacagaatctcactggtttgcccaggctggtattgaactaccgggctcaagcaattcttctatctcggcctaccaaagtgctgggattacagccgtgagccaccgcacccaactgagatttaaatctttaatccattttgatttgatttttgtataaggtgagaaatagaggtctagtttcattcctctgcatatgaatatccagttttcccagcaccacttattgacaagactgtcatttccctatcatatgtgcttggcaccttcactgacaatgagttcactgtagatgtataaactggtttctgggttttctattctgttccattggtttatgtgtctgtttttatgccagtgtcatgctgttctggttactatagctatagagtataatttgaaatcagataatgtgattcctccagttttgtttgttttttgctcaggatagcttcggatattctgagtcttttgtagttaaatataaattttagaattcattttttatttctatttctgtaaagaatgtcattttttttttttttttttgcagacttgtggaggtaccacattggtggtctgagatcagacctgaaggaattctctgggttagcagacagggactcacttcttctcttactttcccacaaatgaagtctctctctctgtgctaggctgcctggggctcagagaggagcaatgcaagcacccctgtggccaccacctctgtgacagcactaggtctgaagctggcacagcactgtggcgggccaaggcccactgtaacacctacctgctgccacctatttcactcaaggcccaggggctctacaattagcaggtagtgaagccagccaggcttctgtccttcccttaagtgcagtaagttctcctggtccctggatggggtcagaggtgctgtctgggagccagggctggagtcataaaccttagacatctacctggtgctctgctctaccatggctgagctggcactgaatccaccaggcaaatccattcccactcttccctcccctttccccaggcagagtagtctgtccccacatatatcgtcaacacagtcccatggggattactgtcaggtcaccactgattctcactcaatgctcaagtgctctcagtcagcctgtggtgaatgctgcctggcctgaaactcactcttcagggcagtgggctcccctctggaccagggtaggtccagatatgccatccaagagccaaggcctgaattggggactccaacagtccacctggtgctcttctccactgtagctgagctggtatctaagctcaagaaaaatcctcttaactcttccctcagcttttctcaagcagagagagtctctcctcacagccaccacagctgggaatgtgctgggccacacctgcagccagcacatctctgagtctcactcgaggcccatggcatgtactacctggtcaccactgatgattcttcagggcccaagggctctttcatcagaaagtgatgaatcctgccattactgagtccctttaaggcatcaagttcccttctggcccaaggtttgtctagatatgctatcctgaagctgggacctgaaatgggggtctcatgactctgaccagtgccctctcctactgtggctgagctagtatccaagttgcaaaacaaagtcctctttcctcccctcaagcagaagaaagaggtctctgtcagacctgtgagctgcactgtctagggttggaggcggggtgggcaagcactccctagctgccccagttgctgtctctgtaggtcacatgcccctaaatacactggcttcaagggcagcacagcagtccttgtggcctagacagactttcaggtttattaaggaccccagagtattttatcccacagtagccagtagcctttcacaactcaagttccaaccagtggcatgaaaaattcctctctggctagggctagtctaaatgcttcctccgtgggtgggcattggatgagcacagccttgttttgctttctgctatgacaaggcagcactgaatttagtgcaaagtcccacagttgctgtgctctccatcccccaagcatgtagcccctcttctcaccacaggtccactgctaggacatgggggaggagtggcatcagcaattcaagactgtcttttctacactattcagtgcttctttcagtgatatgaagttaaaaccaggtactatgaatgcttacctgatttttagttcctatgcaggtgctttttttatttagacagttgctaaatttgctattcctgcggggagcacaattggcagagactgctattcagccatcaggctccacctctgtgaatgcatacattctgaaagacagtcttaactggagtaacaggaaaatgtaaaaaaaaaaaaaaaaaaacccaaaacctcttgccactgcctgtcatgatcttggatcttcatatggtgctcaatgtcatcaagaggtattccttcagatttccctaaatgtcacccacaaagccattctcgctgtctagtggacactgtgacagcctctgctggaaatgcctccctggctcactctgcctaccagctccaaggcccttccctttacaacagtcatgaggccagactggaagaaagaccccatgaagtttctgtttcagcatcatgttggtgccatctgtgagcaaccccatgactcagcaagatttattgcactctcacaggtaactcggggcccccaaagtgctgctgtggttttatgagtgccccaggaacctcctgagtgtggtgagcactgggtgatgctccagcaatatttctcagactgcctgaggggaacactggaacttctaactcatcagcccaatttctaaacacatgcaacactcctactgggatgggacagggacacagggatctgtggctattctgtatctcgaggtttctataaaacagaacttcagataaaagcagggggaacaccagcaaaggcaaattcacaatgtgtaactcagggtgaaactacacagttttcacagtccagaggccttagacctgtcactggccaaataattatttccaaggccacacatgtgctccttacaaagagactggaacttgcacacagctttgaaaaagccataagatatttactgtactattatgttctggtagtacactggtaagataatgccaaaaatattcaccagaaaaatacttttcaatttatgagcagattattaaaacatcaatttaccaagacctaccagcaaacaatgaaaaatatgaactattgttctaaagctggatggaaaaatatgtggtgtttaggcccattttcattatctgcacaacgtaagctttaaaagtatttcttaaagtatttaagtttatgggaccacataaagtactgaaaaatggttacaaagttcacaaaaaccatacaaactcacatttcttcaactgtaatgttcttaaagagcttgcagtagtcctcattccacacagccatatcactccaaaccttggaggcaagaagaatggctcccaagacaatcctcttccagttagttggacaaatgtcgatatcagcataacttacaagtctttctatgtaaatctgcaaaacagagcactggcctttgatttagctcagtttaagtgccaagaattcttatgaatgacagatttcttctggttttgaccagaaagtaagtgcttatgttctacagagatttgcttgatcagaccaaacaagtggccatatcacaattgtaggtcagatacttctgctacctactctgctcatagaaattcacagcccaattttggtcacaagaatgaccgtatatctcagtcaagggcatcatgaagacaggcagtgctgtcaccttcacactcataaaagacagcagacatgcaggcccagtgtggaataaagtcattcaataaatccttaagtgcctacatatgtaatgtctcacacggagctggtaggtagatgggaattttataagtacgtcaagcttgaatatgtaaaacccatgtaatagtgagcaaatgttaaccttcttctcacaaaaactcacccttctgtggcactagctttaaaaactgctgatcaagagagcctcccagcagctgctgtgtagagcagcatggcaggagcaggtctgtggggttgtaaaacattccccatattcagttgctcacttggtaagaaacacatgtgtataaaggatggtccttctcacagcccctatcttgcacatcttcatgatcacttcaaaaaatttattctgtcttacatcacctgcaaattagacaattctgttggttttaaggtggaaacagctgccagtctctgtatccctgggattcctctacacctgccaggcagttggtgagacaatcccctgaattactttacatctatcaaacatctgtcctacaaagaattgagcaaagtgaatagctgagtaaacattaaaggtgaactgtgaggtgttgttacctcagagggtgctctgcagaacagtatgtctgtgagctacttgaactgtttacatcgaaacaaaaggaaaaaactttatataaataagcaagtttatttcttgtctgaagggtatcagattgcagaacactgccagatctgatactgatctgaacactgccaaactcaagtatgttttcaaaaacaaatggctattgaacatgaaattttacagattccactccctttctcccaaactctgcactctcaagtatttcaagagtgaacctccctcccagggttcaactgcgtaggaatcagagacctctgaaacaacatggcaagccctctacttcctgtcccctttcctgctaagctgctgacctgctgacactcatccatgccacgtgcccttctgggtgagtttgagaattctttattcccactgatgccaactcttccctcagtgcagttgatcccatctcacttttgcagcacactgttcccacaatcacctctttctgaagattttcttcctctctaccagaaatttcctccaaattgtgtttcctttgtccccatcccactccccactcctctccaactgtgtcctctcactgatgctcacagcaccataccctcataccagctcctcatcttccatctctccttcagctacactgcctgcccctgctgacatgactctcccaaggctcctcttgccaacaggcacttgtctcttgtgtcttcacgctgacaaactaaagctctgcatacattgccatttgcctaggtgttggggccaaatacctgcatttcagttcccctgctccaatctgtgtgcaatgcctcttacgtctaccttcactggtggtctgcatggtttgatggtgacccacagtctatcactgctcacctgtattaccctagttgcttcttaaccctcttcactgcctccactctgcctcccaactatagcttactgtccccaaagcagccagcataacctcttcatttagagcatggcactcccctgctcaagatctccccaagagcttcccatcaaactggagtaaaaccttaacttcttcctacagcctacaagccaaaaggccctgtgagctatggtactgcctgaagggcctcatctccactctttccctcattcttcactctgactatgctggtcaccttgctgtttgttcctcaaacacacatgaaatgcatttctgtctgtcttggcagtcatcctgctgcctgtaatgtcagcactctttcccgtcgcgccttcagtcaggtcactgttctaatgtcagctctctagagaggctcttccttatctgtctacctaaaatagcccccaatcactctgtatccctttatcctgcttcctcttcctgctgtttcatacacttaagttccatcttcctagaatataagctcataaaagcaagaactgtgttccacctgtcctctcctctacctccgcacttagaagagcggcacagggtcagcatccagtgagtgttcactaatcagtcactgcttggcagcattcagcactgtgactacagcttctcctatcttgaactctttctccttttattatcctcttctgcttttcctcttcccactctagtagacactcttctgggggcttgtcccttaaatgataatagtctttaccaacctatattctgtccattttatctgtttttgagacagggtctcactcagttgctcaggctagagtgtagcctccacctcctgggctcaagtgaacttcctgcctcagcctgccatgtgcctggtgccacaggcatgtaccatcatgtccagctaatttcttaattttttttttttgtagaaatgggtctcactttattgcccagtctggtcttgaactcctacacttgagcaatcctctcaccttggcctcccaaagtgctggcattacaggcatgagataccgtacctggccttactttttgttttcttaagatgcagggtctcggctgggcgcggtggcttacacctgtaatcccagtactttgggaggctgaggcgggcagatcaggaggttaggagatcgagaccatcctggctaacatggtgaaaccccgtctctactaaaaatacaaaaaattagccgggcgttgtggcgggtgcctgtagtcccagctactcgggaggctgaggcaggagaatggcgtaaacctgggaggtggagcttgcagtgagccgagattgtgccactgcacgctccagcctgggcaacagagtgaggctccctctaaaaaaaaaaaaaaaaaaaaatacagggtctcatcatctggcccaggctggacttaaactgctgggctcaagtaattcccccacctcagcctcccaagtagctaggactaaaggcatgaaaccaccatgcccggcttgtccaatttcattctacacactttcttggtatttaaacagctgccgttgctcttcattctgtagctctatgtccaattcatgctctagtcctgtatatccaaatgatgactagactgtgctactctgctctctcaaaggcacaccaagcttagcctatgtacaaaactctcccttttccaatccagctttccctcctgcatcacctatctctacatctggaaacaccactcctgcttccctctagcatgtgctaacagtcccaaatgacttgcagcttctcgagaggactgtatctggtccagtgccctttgagggctttgattcaggtgcacagcaggagccttctcccctagaatctaactggttgctaaacaagtattgacctaagtattttttcattcctggccatgcagttgactttcctctataggtttgttgtggggaggagtaagactatttttaacaatttgagcagaatttattatttaaaatgataggtttacaaaaggaatttgtagggataatgtaaatgtaacgacacagctatggtttggtagaccaactggaaccacattcctgggcaacttcatgagcaagcacaggtgatcagcagggatagataaacacacatcatccaaggaacaaagaattgagggcagcagctgtcaatgacaacatgcatcagaattgcctggggatataccctgggactcagcttagacctacactggcatcccttcctgcccatcagccagatggttttgttactgctccccattccaagctgtccacatgacctggatgtgtgtgcactgtgtgtgcatgtgtttattgatgtgttgggggagaaatcagaaatccctcctgctgcctttaatagcaattgttctgtgatgagaaaagcaactgtgacattttaagccataatgatgattcaactaaaatgtgtgtatttgctttcaaaagtttctcttaaaattctgagataacttcagaaacctactgtattaaaaaacaggaccataccaccctgtttacaagaagaacttctaaagctgctttataaatagaaaatatcttaccaaacttacgattgcaaactcagctgttagcctcatggctttaaacagagtacgaacaaatctgaagatcaatttgtgttcaggatcatacttaaaatattcctccaaaacctcttttcgctgaaagaagaaaggatgcaatgtaagtatccattgaagaaaaaaacctgaggtgctcttaagacagcagtgttcacatttgtgcccatgtgtcacttacgataattttgattggtgagatgtcttttagttttttacaatatgaacagcaggatcctgaaataccataatgatttaatactcatccacattcacttaaaaataatatgagcttaagctcagaaaatgtttatattcttttttaccctttccctcacataattccatccaaatgtaagctactccatccaaatgtaagctttaatgtcttactgactgtatgtcatacttctctgcaataaactttgaaaaaatatagttacctgtaaccatgaggctctaagcctgtgctgataaatacaatagtcactagccacatgtggctattatgtacctaaggaagtacatttttaaatttttacaccatgtaagttgatataaacttaaattcttcttcttttttttttgtttgattttttgagacagattttcactcttgttgcccaggctggagtgcaatgatgtgatcttggtgcactgcaacctccacctcctgggttcaggcgattcttctatctcagcctcccgagtagctgggtttacaggcacatgctaccatgcccggctaatttttatatttttagtagagacagggtttcatcatattggtcaggctggtctcaaactcctgacctccggtgatccacccgcctcagcctcccaaagtgctgcaattacaaaggtgtgagccaccacaaccagcgaacttaaattatttttaaccctcttcataaaaatcatgcttctttgttaaaagtatttacatatacttatactgcttgatactattaacaattatcttttaaaaagatatgttttctgttatttggatagtatatttactcacattagctcactaattaaacatacctgcagatcagttcttattccagcatgttctttttacaacacttttaaaataagatgactagatgccacatgaaatggggaacaagacttaaagaaagatgcctttgactgcgggcacgaaacagatacaaatctatgatgaaaatacagactcaggctgggcgtggtggctcacccctgtaatctcagcattttgggaggccaaggcgggtggatcatgaggtcaggagattgagaccatcctggataatatggtgacaccctgtctctactaaaaatacaaaaaattagctgggtgttgtggcaggcatctgtagtcctagttactcgggaggctgaggcaggagaatggcatgaacccaggaggcagagcttgcagttagccgagattgcgccactgcactcgagcctgggcaacagagtgagactccatctcaaaaaaaaaaaaaaaaaaaaaaacaagaaagaaaatacaaactcaataaaagtgagacttactgggccgggtgcggtggctcacgcctgtaatcccagcactttgggaggccgaggtcaggaattcaaaaccagcctggctaacatggtgaaaccccatctctactaaaaatacaaaattagccggacgtggtggcaggcacctgtaatcctagctacttgggagcctgaggcaggagaatcgcttcaacctgggaagcagaggttccagtgagccaagatggcagcactgcactccagcctggacagcaagattgaaactgcatctcaaaaaaaaaaaaaaaaaaaaaagtgacactgtaagtgggtgtaactgttcatcaaatatgcccaaagatctatgtgcatctctataaaataagaatgtgtattacttcaaaaactgttaatatcttagtataatatctgtttagtaaaataatgcttcctatgtgcctatgtgctttggtgtttacttcaccaaagcaaacagtttttacaaattctccttgatactgacttgcggagggtttcctgacctcttcttcctcagcatagcatgtcctgtactgtgaagtcttttataccataaccagttacaactgcctgtaagtattgaccctccctaacaggcaatggcaataaaccaaacacattttcactcctcgaaccacacactgaaacacaagaacgttttacaaagcagtagtggtgggcaataatctctttagaactttaataaatgtaaatgtgattcagatttgctagcttcctttaatttaaattactaaaaataataaatacatcatgagaatatactacagagaactaaagagaaacatcagtttcatttaaaaatacaaccgggccagcacagtggctcacacctgtaaaatcccagcactttgggaggccaaaacaggcagatcacttgagctcctttaggagttcgagaccagcctgggcaacatgacaaaaccctgtctctaccaaaaacacaaaaaaattatccaggcatgctgacacacatctgtggtcccagctactcaggagcctgaggtgagaggattgcttgagctgagatcatgccaatggactctagccaagtgacagagtgaaactcggtctaaaaaaaaggtacaactatcattctcaaaaataaatgaagctgtcactcattcacaaggaaatgtgtcactcatgtcacaaggaaaataagtatttgtttccagtgatagaatttaagctttcctgaagactttgaaaaacttgttccttctactgtaagcttgacagcttctcaatacttaaggatgttttaaaataaaattggtggttaaattaaaaaagtcctttttgatacaataaaacataaaccaatattttccaaataactaatgcataatattataaatgcaagtatgtggggaaagaaccatttattgtgcaagaaagatcggtgagtactgagaatacatttgctaatatgtaaaatgccactgtaactaatttaagaaactagcacttgtgaagttttgatttagtattaaagaatacccacaactgtcttaaagctttaaaaatacaccttttaccaactacatatttgcatgaggctaggtcatcttattgcttctttaaagcaaattgcaaagaaagagctagagaatccagctgtcttctattaagcgcaacactacagattatcaataatatagatacatgatacactttttactcaacttttcatcatagaaaagttatattttcttttaaaattttatgttaacaatattgttctcaaggaatattttctattgtcacaacctgggtcatgggttactactgacatctagtgggtaaaggccatcagtgttgctgaattttctgtaatgcacaggacagtcttcacaacaaagcattatctagctcataatatcaatagtgttaagactgtgaaatctaaactaaaaatagattttgaaaaaaatctcaagtttatatttctatcagagtaaatatcaatataatcaatataaaatcatactcattgggatacttaatcatttaagaatttaaaaagtctcaaggaccaaagaaaacacaaataatttgcttcgatattttagtaggcacaatacagcttatgatgtctagagctatgatctaacgctgagcttaatatcatgcaaagtaattagccagaataacaagacaggttttaaaaaagctcacctttgcttgatatgataatatagtgccaaggtcacactgtggaaggaaaaaaaatattcataacaataaatgttatcatttgttaggcttgaagacattttttaagaggggggcagaggaaactctcctagcggctctgaaattcaaatcttatagttcagaacagtaccataagggcactttcttattttcatttcttggcttttagcaaaaatatgagaaccaaaatgcaaggcagtatgcttttagaagacatgtttctgttgtgattataatatataaataacaacatatttccctgttatatgctcttctacccacaaaacctttcatcccatgcaatttattttatgcatttatctattttttgacccagagtctctctcactctgtcacccagactgaagtgcagtggcgcgatcttggctcaccaaaacttccacttcccaggtacaagggattctcaagcctcagcctcccaagtagctggaactacaggtttgcaccactatgcccagctaatttttctatttttagtagggacagggtctcgccatgatggccaggttggtctcagactcctggcctcaagtgatccacctgcctcggaactcccaaagtgctgggattacaggcatgagccaccgcacacagcttcatgcagtttacatctatgtgtccatatgtttaagccatacagtagtgttttctttttaagatgttaggccctgcattttagtttagttcactatctcctaccacccatttttaattatttccctaaaaatacataatgaaagtgctttataaaaaaattatttgaaatcacttttgcataattatttaaaaatatattagtaaatatacgcacacaggaaatcaatgataggtgcagtgatcccaaaatatgcagtgctgacaaggcagtataccatgacacagtgtaatatgaatggcaggtaccttcaattagtttaactgaaatatttatgaacagatacacctcttcagatacatgtaactatattcctaagttactcacagatgctgtgtatcacaaaacaagaggttctcttacataagttatgtgcttccatttgctctcagcatctagaatgagactcaaaataactgagggaaggaaaatccctcggttaataataggtctatacaatattagcactttttaaaaagcttataacattagcatttaagatggatatgtctatagtgcttcaagtagttttcacttctaaaatcattttaaaatcacagaatttgaagttacatgctggaaaggaccaatgaccttacatgacatttaatccaacactcattttacagatcagggaaacaaaccttaaaactgacttgcccaaggtcccaccaaataggagcagcttctcatcctaaactcaaattaagcagtgctctcaaactttgctgtacattaaaatcaactgaggagctttaataactgcctcattttcaacatgagactttttagtttaattagttagcattgggtaggacttcaggcattagggttgttgttaaaaattttcctggtgacttcaaagtgcagcaaagtttggagtgattgagttggggtgaaaatcagaatcttctgggatgcttttcttcacaagaagatgcctcacatcgattcctattttcctaaagggcttctcagtgcctagagacagagggaaggttgaggtgggaagatacaaatgtttgcagacatgtattttgaaaaaaaaaaccttgcaaaagtgatcccaatgagttccatctaccccattgacaacagtgtactactaacccataataaacatttttcaaaatcttttcttgaagccaatttgccctattaatttgctcaataaacctttatttcactaatagtgaatataccaaatgataatttctcaaacttgttgatgggaaattaaaacttactttactttcaaaagtagacttctaaaaattagaataatgaggaaaaaagcgtgaaatttgtttgagcaagattaatgtttaaaactacttttaaattgtatgctaacacatcaaaacttttgaattcaaaagaagccagggatacaaaccagagtgattttttctttttttgctcaaggatttagaggcttggctgaatacagacatgtagtgattatgcaataggtcccaaagcgcaggacttgagacagggtttgaatccagttttcactgaaacacaatttcatctctactactgtgataagggagagaggaagtgacattattatgagcgtaaacttgcctctttgttgttgtaattattagttttagaaacggagtttcactctcgttgcccaggctagagtgcaatggtgcgatctcggctcactgcaacctctgcctcctgggttcaagccattctcctgcctcagcctcccaagtagctggaattacaggtgcctgccatcacgcccagctaatttttgtattcttagtagagacagggttttgccgtgttagccaggctggtctcgaactcctgatctcaggtgtttggcctgccttggcctcccgaagtgttgggattacaagcatgagccaccatgcctggccgccatgttttttttaaattatactttaagttctgggatacatgtgcagaacgtgaaggtttgttacatatgtatacatgtgccatgctggtgcgctgcacccatcaacccggtatttctcctaatgctatccttccccttgcctccgattccccacaggccctggtgtttgatattccccttcctgtgtccatgtgctctcattgttcaacacccacttatgagtgagaacatgtggtgtttgattttctgttcccgtgttagtttgctgagaatgatggtttccagcttcatccatgtccctacaaaggacatgaactcatttttcttatggctgcatagtattccattgtgtatatgtggcacattttctttattcagtctatcattgatgggcatttgggttggttccaagtctttgctattgtaaatagtgcagcaaaaaacatacatgtacatgcgtctttatagcagaatgacttaaaatcctttgggtatatatatactcagtaatgagattgctgggtcaaatggtgtttctggttctagatccttgaggaatcaccacactgtctccacaatggttgaactaatttacactcccaccagcagtgtaaaagcatttctatttctccacatcctctccagcatctgttgtttcctgactttttaatgctcaccattcttactggcatgagatggtatctcatcgtggttttgatttgcatttctctaatgatcagtgataatgagctttttttcatatatttgttggccgcataaatgtcttcttttgagaagtgtctgttcatatccttcacccactttttgatgggtttgtttttttcttgtaaatttgtttaagttccttgtagactctggatactaggccttcatcagaagacattaatattctaaattagcactttccaaactgtgttctaaaaatcaatactcataatccaaggaagtgataatgatgtacactggacaaacccaatggagcttgtggtggtgttggttgttgttccttttaaaataaacttcatctcagggtgctctcaaagagcatctttgtggcccatgaggttctcatgcacaatgggagaaaatcaaatgcagatacactgtggtgccagtagagaaaaagctgttccttcttccaagactaatgtccaaagaagtacgcattgatttaggcctgcaatgcactgaaaaactaatatttcacaaaaatcattcaataaagggaacctatccttctcattgagttcagcattgtcttaaggcataaaggcatcaaacaaatagctgcactttttctgggattgcttatttgctgatttttccttccaccatgatgtctaagattaaaagagaaactgatacttaatatttaaaatctggatatcaatatatagttgactccaatttcttaaaatgattgctgaagaggacaaccaaatggctgaaataatttttgaatgaaggagtctatcccttggcattatagttgtactcacgattttagtgtcattgtaagatgaggctggctggctatgctgtcatcaaggaatattgtcgaacatgaactgtattgttgagtaaaatgctcagtagatacctgaaggggaagggaagtataagataaacttatcaaagtatactttttcattggttaaaatgtcaaatttttcaaagcactaggatatttcttacactccatgaatgcctgagtgtggtatcatgagcactctatagaaaacccatcagaggctcttaacttccacagaggatgtttgagatacaggttataaaatgctgcccttaatgtggtgcctatcatcaaaactaacaaggattttatgaattccctttgtaaaaaatgaaaaaagtttaaaataatatttcatttttttatagtgacataaaacagctgaggatttctatttctgttatttatttactacagtaaaatgtaatgtattgaataatattggtataagaccattttactgcaatgaatacaagactaagactaacacatttactaagttactaatcctaaatgtattatttcaggcgatattgtgacaaaacaagtgtttcagattcagaggctcgtgtaccagggctgctaggccaccaacaagtgaggaagacataggtttctctagtcctgttttcttatgtggaggataaaaagagtatcacctaagtattctctcacaccctgaaaacagatgacaacttaaaaaatttaactttcacttcatgtttaaataagactgccatgacatgactcaaatgagaccctcagagaatactttccgttcatttcaaaatttgattaattttattctatacatcatttgacctgcacctaggcattttcctgctctacccctgttctctgtctggaataatgcttttctccttccttgtttcaacaagcttgactccatctaccctcttggatctctttgccagtagcctcagcctcacatgttttgtttttttgtacactaaccgattacaagatactaattctagcagagtattcccctcatgagaaagtacgcctctccataagagtaagggagagccctaactgttcctacctctagctgctcagcataaaattttgaataaatcaaaaagttcaagtgtttgacaaattaattcagttataatttggaaggtaagtcttactacatttaattacagcaaaaacactactaacggtttactgtttataggtattatttaaggtagtcacaaaatagaaacaaatctaacttcagtcagcataaatcacagagtatgaaattttacaatgtttaacaagaaatggaagggtttacttagtggttttaaggttttatgacaaaaactagaaaataatcatacctcatattttagtaaatcaaaaccaaaggctttaccatcaaaggtccagtacctgttggacaccgatgcccaaccactgacttcttccgctgtacctgctgcctctcattttaacccattaaaaacactaaaactgttttccttgtagaggtctttcccctccttgcttagttagattcttaagctggttttttgtttgtttgttttgcagctgttgtaaaggggttgagttcttggtttgattctcagcttggtcgctgttggggtataacagctactgatttgtgtacattaattttatatcctgaaacttttctgaattcatttatcagttctaggagttttactggaggagtctttggggttttcaaggtatacgatcatatcatcagcaaacagcaacagtttgacttcctagttactgatctggatgccctttctttctttctcttgagtgattgctctggctggctaggtcttccagtactatattgaattggagtggtgagagtgggcatccttgccttgttcctgttctcagggggaatgctttcaacttttgccattcaatattatgttggctgtgggtttgaaatggatggcttttattatattgaggtatgtcccttgtatgctaattttgctgagggttttaatcacaaaaggatgctggattttgtcaaatgctttttctgcatctattgagatgatcatgtgatttttgttttgaattctgttcctggggaggagccaagatggccaaaaaggaacagctccagtctacagctcccagcgtgagcgacgcagaagatgggtgatttctgcatttccatctgaggtaccgggttcatctcactagggagtgccagacagtgggcgcaggtcagtgggtgcatgcaccatgcacgagccgaagcagggcgaggcattgcctcacttgggaagtgcaaggggtcagggagttccctttctgagtcaaagaaaggggtgacggacggcacctggaaaatcgggtcactcccacccgaatactgcgcttttccgacaggcttaaaaaacagcgcaccacgatattatatcccgcacctggcttggagggtcctacgcccacggagtctcactgattgctagcacagcggtctgagatcaaactgcaaggcggcagcgaggctgggggaggggcgcccgccattgcccaggcttccttaggtaaacaaagcagccgcgaagctcgaactgggtggagcccaccacagctcaaggaggccggcctgcctctgtaggctccacctctgggggcagggcacaaacaaacaaaaagacagcagtaacctctgcagacttaaatgtccccgtctgacagctttgaagagagcagtggttctcccaccacgcagctggagatctgagaacaggcagactgcctcctcaagtgggtccctgaaccctgacccccgggcagactaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaacaaaagtagataaaaccacaaagatggggaaaaaaacagaagagaaaaactggaaactctaaaaagtagagcgcctctcctcctccaaaggaacgcagttgctcaccagcaacggaacaaagctggatggagaatgactttgacgagctgagagaagaaggcttcacacaatcaaattactctgatctacgggaggacattcaaaccaaaggcaaagaagttgaaaacttcgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgactggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggcaaaaatgttaagggcagccagagagaaaggtcaggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctcagagattttgtcaccaccaggcctgccctacaagagctcctgaaggaagcactaaacatggaaaggaacaaccggtaccagccactgcaaaatcatgccaaaatgtaacgaccatcgagactaggaagaaactgcatcaactaacgaggaaaataaccagctaacatcataatgacaggatcaaaatcacacataacaatattaactttaaatgtaaattgactaaatgctccaattaaaagacacagactggcaaattggatgaagagtcaagacccatcagtgtgctgtgttcaggaaacccatctcacgtgcagagacacacatacgctcaaaataaaaggatggaggaagatctaccaagccaatggaaaacaaaaaaaggcaggggttgcaatcctagtctctgataaaacagactttaaaccaacaaagatcaaaagagacacagaaggccattacataatggtaaagggatcaattcaacaagaagagctaactatcctaaatatatatgcacccaatacaggagcaccaagattcataaagcaagtcctgaatgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccacctcaaatcaacagaatatacatttttttcagcaccacaccacacctattccaaaattaaccacatactgggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacatatcgaaatgaaggcagaaataaagatgttctttgaaaccaacgagaacaaagacaccacacaccagaatctctggacacattcaaagcagtgtgtagagggaaatttatagcactacatgcccacaagagaaagcaggaaagatccaaaattgacaccctaacatcacaattaaaagaactaggaaagcaagagcaaacacattcaaaagctagcagaaggcaagaaataactaaaatcagagcagaactgaaggaaatagagacacaaaaaacccttcaaaaaattaatgaatccaggaactggttttttgaaaggatcaacaaaattgatagaccactagcaagactaataaagaaaaaaagagagaagaatcaaatagatgcaataaaaaatgataaaggggatatcaccaccgatcccacagaaatacaaactaccatcagaaaatactacaaacacctctacacaaataaactagaaaatctagaagaaatggataaattcctggacacatacactctcccaagactaaaccaggaagaagttgaatctctgaatagaccaataacaggagctgaaattgtggcaataatcaatagcttaccaaccaaaaagagtccaggaccagatggattcacagccgaattctaacagaggtacaaggaggaactggtaccattccttctgaaactattccaatcaatagcaaaagagggaatcctccctaactccttttatgaggccagcatcatcctgataacaaagccagtcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaatccaacaacgcttcatgctcaaaactctcaataaattaggtattgatgggatgtatttcaaaataataagagctatctatgacaaacccacagccaatatcatactgaatgggcaaaaactggaagcattccctttgaaaactggcacaagacagggatgccctctctcatcactcctattcaacatagtgttggaagttctggccagggcaattaggcaggagaaggaaataaagggtattcaattaggaaaacaggaagccaaattgtccctgtttgcagacaacatgattgtatatctagaaaaccccattgtctcagcccaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaacacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccagcaagctaccaatgactttcttcacagaattggaaaaaactactttaaagttcatatggaaccaaaaaagagcccgcatcgccaagtcaatcctaagccaaaagaacaaagccagaggcaccacactacctgacttcaaactatactacaaggctacagtaaccaaaacagcatggtactggtaccaaaacagagatacagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacatgggcatgggcaaggacttcatgtctaaaacaccaaaagcaatggcaacaaaagacaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccctatcaaaaagtgggcaaatgacatgaacagacacttctcaaaagaagacacttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaactggaaataccatttgacccagccatcccattactgggtatatatccaaaggactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaataaccaaacaccgcatattctcactcataggtgggaattgaacaatgagatcacatggacacagaaaggggaatatcacactctggggactgttgtggggtgggggtaggggggagggatagcattgggagatatacctaatgctagatgacaagttagtgggtgcagcgcaccagcatggcacatgtatacatatgtaacaaacctgcacgttgtgcacatgtaccctaaaacttaaagtataattaaaaaaaaaaaagaattctgtttctgtgatgtatcacatttattgacttgcatatgttaaacaatccctgcatccctggtatgaaacccacttgatcatggtggattatctttttgatatgccactgggaactacaaaacattactgaatgaaattatggatgacacaaacaaatggaaagatattccatgctcatgaatgggtagaatcaatattgtgaaaatgaccatactgccaaaagcaatctacaaattcaatgcaattcctatcaaaataccatcatcatttttcacagaactagaaaaaacaattctaaaatatggtaccaaacaagaccccacatagccaaaacaaaactaagcaaaaacaacaaaactggagccatcacattatctgacttcaaactatacagtgaggccattgtcaccaaaacagcatggtactggtataaaaataggcacatacaccaatggaacagaatagaaaacccagaaataaacccaaatacctacagccagcttatcttcaacaaagccaactaaaacataaagtgaagaaggtaaaccctattcaacaaatggtgccaggataattggcaaagccacgtgcaggagaatgaaactggatcctcaactctcaccttatacaaaaatcaactcaagatggatcaaggacataaatctacaacctgaaaccataaaaattgtagaagataatatcagaaaaatcttctagacattggcttaggcaaagacttcataaccaagaacccaaaagcaaatgcaatgaaaacaagataaacaggtgagacttaactaaagagcttctgcacaggaaaaggaacaatcagcagagtaaacagacaacccacaaaatggaagaaaatcttcaaaatctatacatctgataaaggactaatatacagaatctacaaggaactcaaacaaatgggcaagagaaaaaacaaacaatcccatcaaaaagtgggctaaggagataaatacacaattctcaaaagaagatataccactgggcaacaaacatatgaaaaaatgctcagcatcactaatgatcaggaaaatgaaaatcaaaaccacatgccataccaccttactcctgcaagaatggccataatcaaaaaatcaaaaaataatagatgttggtgtggaaaaggtgaaaacacttctctacaatgctggtaaaaatggaaactagtacaaccactatggaaagcagtgtggagattccttagaaaactaaaagtaggcccaccattcaatccagcaagcccagtactgggtatctacccagaggaaaagaaatcattatacaaaaaagatacttgcacatgtatgttcgcagcagcacaatttgtaattataaaaatatggaatcagcccaaatgcccatcaatcaacaaatggattaagaaataccattcagccataataaggaataaattaatggcattcccagcaacctagatggaattggagactattattccaagtgaagtaactcaggaatggaaaactaaagatcttatgttttcattcatatgggggagctaagctataaggatgcaaatacatagaatgatacaatggactttggggacacaaggaaaagggtgggacgggggtgagggataaaaaactacaaattgggttcactggatactgctcaagtgacaggtacaccaaaatctcacaaatcatcacaaagaatttactcatgtaaccaaataccacctgtttcccccaaaacctatggaaataaaaatatataaataaataaactacggcattcctctcagcaaatataaaataaaatgaaaactcaagtttacgttttcctctctcctttttagcaggacaaattttagaaatgtttttaaataataacttttttctctttctgagactgggtctccctttgttgcctaggctggagtgcagtgtgcaattatagttaactgcagcctcaaactcctgagctcaagcgatcctctgcctcagcctcctgagtaggtaaaactaaaggcacatgctaccaagcctggctaatttgttatttaacttttttttaaaattttattattattatactttaagttttagggtacatgtttttgtagagatgagctcttgctatgttgaccaggctaaaaataaacaaattttaattaacttaaatatttctaacactttgggcattcatgaaaacagctccatctatgttgtgaggtattgggataatatggcagtgaaagtttgaataaaaatattaaataaggccttaggagaaaagtataatatgcttattatagatacatcactaaaaaaattgtctgggttaataccattaattatattgaaattaaactttgattcacatgtaaatataggtcccaaatttggattaagtataatagattggccacagatttatttcctctgcctctggaagtctcgttagtcatacataaaatacaggttacacacaggatcaagagagaacgttgacagagatgatttttaataaatgctgggtcataaaaagtagataaaggagtggtaaataacacagaagcacaactttggtccctacagaaagcgactggaagagaagcaagccagtttgtcttgtagaactaaaggcaggctgtgaatttacaggcaaatggaactttggaaagtagggtaaaacataaaacaaaagccagcaaggtcagaaaatctgtggttagaactccaaggccacctgtcgacccatctgataagaaacttagatgtgtgttctctggatataccaaacctgagaatttctaggttcagaaataccacggcgtaaaactgagatataaagaaaactgtacaccaaaaatagaactccaacttgcttccctaattctgcttttggaaagcaagtagccattcttttacttcccaggaagaaaattgggagatcctttctcagaagaaactgaactggctcgaataaagatccccagataatacactgaagtcccacaaatgaaaagctagtttggcttccaaaacctcacactgagtgccaccagttaacagaagtccagcttccaaataaagccagggaccaccacacattggagggaagcctccaacaagagacatcaaaacaacagaaaaaagggattcatgggaccagtcaaaatcaggagcaaaacttacaaaaaaaatctgaaaacactctgaaaaagatataaaattcaatagaaatgttagagtaaaaagtcacagaaactgaaaaatcgaaggggaaaaattaaaaaccactgcaggtatactggtctaagcagctgagtgtctgaataacaagactatcagaaaaaaaagaacagagaaaataaaaaaattctcaagaagagatagtcttcagacttagtagcctcaataaaatgaaaagattcccaccaagctgttatgaaatttcagaatctcagtgagaaagaagctgctaaaaagcttccacagagacataaaacctggttacaaataatgtatctcacaatggcaacagagtcaagaacaacactgtaatgattgcacaattgcaaaatatcttcagaaccataaagtttagattcaacctagaagtttgctctgtatcaaaaagaagggattttaagactggccagatccctaaacatctctgcccaggaaaatgtgctcaagtacaactagtgaggataacaggacagaaggaaacagaatctaggactcaggtgatcccacacaagatggcagttatgtgagatcccaaaagacttcaaggagctagcacagaaaagcagacattgagcatatctagggaaagccactctgtattgaactaggatgacaaaatgccaaagaaagttaccccccacccctggcaaaaaaaaaaaaaaaaaggaatatatgtgttttagcagatggaaagtatatttgaaaggcatgtgataaatgcagcaacacttggggggaaaacagctgttagaaaacaggcaaatgaatatagtcagaaaattagcttcaggctaaaaaaaaaaaaatggatgtgaaagcaaacagaccagccaggggctacttactgcatttggctgggtaaagtaacataggctagggaaaaagagatgatccagaaaaagtacagaaatgctcagatttcagaactgtttcagagaaagaatgaaggacatataatgcagaggcacagtgaaaacatcatatgacttagcagtgaatagaatttgcatagtgataatcatgtaaatattagtgatttaattaaaaagtgtgctacaattggaagaaacagagggagaaaaataaggtcatggtgtagtgaggaaggtatgctttcacccgctatgacaaagtcaatagacagtgctgatagctattctatttttgttatttgttactctgtatttgttactctgtatttgttattttgttatttgttaattcttagctattctatttttgttatttgattaagaatatgattaaatatttaaggcagatctttgtaccacaaccagagtattgaaatttaacttaaatgtcagaaattcttaaaatttctaagctgaagacttctctgaataaattttatacttaggaaaatacaaaaagaggtccgtgctatcaccacagggtccccactataatttcaaggaatcaagagagacatatttttatatcaaactatcaatttcttaaccttttgactgtttacgtacatgctttgcatagttgctttttctttttttcttgtactaagaatgaaaaagaaaatggtcacttctgataaaaataccataaaataagagtagtagttaatgtcttactaattactcctaaatgaggaaaaattccatttaaaaaaattactttcaacaatttatatttaaattatctggcatgataaatctcatagagtaaaatctaataacttagttttactttttgacctagtttactttttgtttctgttacacacaaatgaaagaatccttgtgcacaaaagaaaagggcaaaaaaaaaatggggacagatgaaaaagttagctaataaaaaatttaactgttgcatatatgagccatgagtattttctcattctgcatttacacatagcttactttatttgccagaatctgagagttaacagctctaagaactactttctggccaggcacctatctctggatgcaccagaatccctgtaagcatctcgaaccacacttagtgatcatctactaatatgtcactaaaaacaaaacaactggaaagtaacttatcttaaatttaaattttaaaatgactatacaaacctgattggacatggtgtccgcagcacaaaaaatcatttttttctaaaaaaaaaaaaggccagcataataaaagctccaagaggacttgggccatgctttgtttcctacaccgcctccacctttgatgctggaagggccttgcaggcaaacattcctaccactgaagagtgagggacatgaaatagcttttgtttttacctcttctatgctctctatgtgtgagaagcccatagctctggaaggaactgggaaaaacaactctgacatggcttggatattttcccccctccaaatctcatgttaaaatatgacccttaatgttggagaaagggcatagtgggaggtgtttaggtaatggtggtggattccttatgaatggcttggtgccatccccatggtaagaagcaaattctcattctggtagtttaagagagaaagggaagtaaagctctcctcagcaaatgtaaaagaacagaaattataacaaactatctctcagaccacagtgcaatcaaaccagaacttaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactacatgcccacaagagaaagcaggaaagatccaaaattgacaccctaacatcacaattaaaagaactaggaaagcaagagcaaacacattcaaaagctagcagaaggcaagaaataactaaaatcagagcagaactgaaggaaatagagacataaaaaacccttcaaaaaattaatgaatccaggaactggttttttgaaaggatcaacaaaattgatagaccactagcaagactaataaagaaaaaaagagagaagaatcaaatatatgcaataaaaaatgataaaggggatatgaccaccgatcccacagaaatacaaactaccatcaaagaatactacaaacacctctacgcaaataatctagaaaatctagaagaaatggataaattcctagacacatacactttcccaagactaaaccaggaagaagttgaatctctgaatagaccaataacaggagctgaaattgtggcaataatcaatagcttaccaaccaaaaagagtccaggaccagatggattcacagccgaattctaacagaggtacaaggaagaactggtaccattccttctgaaactattccaatcaatagcaaaagagggaatcctccctaactccttttatgaggccagcatcatcctgataacaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaatccaacaacgcttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgcttgcagacgacatgattgtatatctagaaaaccccattgtctcagcccaaaatctccttaagctgataagcaacttcagcaaagtctcaggatacaaaaccaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcagtgaaataaaacaggatacaaatggaagaacattccatgctcacgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccacatcgccaagtcaaccctaagccaaaagaacaaagctggaggcatcacactacctgacttcaaactatactgcaaggctacagtaaacaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatacgtagaaagctgaaactggatcccttccttacaccttatacaaaaatcaattcaagatggattaaagacttaaacgttagacttaaaaccataaaaaccctagaagaaaacctaggcattatcattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctgcaaaatgggagaaaattttcacaacctactcatctgacaaagggctaatatccagaatctacacagaactcaaacaaatttacaagaaaaaaacaaccccatcaaaaagtgggtgaaggatatgaatagacacttatcaaaagaagtgccaaaagacacatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaactattgtggaagtcagtgtggtgattcctcagggatctagaactagaaataccatttgacccagccatcccattactgggtatatacccaaaggattataaatcatgctgctataaagacacatgcacacgtatgtttattgcggcattattcacaatagcaaagacttggaaccaacccaaatgtccaacaatgatagactgaattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatattctcactcataggtgggaattgaacaatgagaacacatggacacaggaaggggaacatcacactctggggactgttgtggggtggggggaggggggagggatagcattaggagatatacctaatgctagatgacgagttagtgggtgcagcgcaccagcatggcacatgtatacatatgtaactaacttgcacattgtgcacatgtaccctaaaacttaaagtataataataataaataaaaaattaaaaaaaaaaagagagtgtgacaccttccctctacctgcctctccctcccttctcactgtgtggaaccacctgcttcccctttgccttccatcatgattgtaagcttgctgaggctctcaccagaagcagatgctgaagccatgcttgtacagcctgaagatctatgagccaattaaacctctttttgttataaattacccagccttaggtacctctttatagtaacacaaaaatgaacacaaattctaaccagaaataacttactcaagacaggcaaagtctactcaaaactacaaaaaaaaagttataaactcccatatttactgcactgcattacttcccatattaatatagatcctcacttgtattcttgttgcttaaatcaactggaaaacttggctgtgtatggctttttagcaaacaaacaaggatttaacataacattaaggaaaataagcagaagtagggcatgtttaaatttacatcagatgacaaggttaatgacttaaaagttccgagaagtataaacttggatgtgataaatgcatgtgatcagaggactgtgcaagaggaggccaaaatcacagattcaatctctgttgatgaacaacagtttttttttttttatttgtttaaatggaaaccaagctgaagcctaagttctatctttaaaatgcacccttaggagcaaggaaaaaggggcaaagaattataaataaagataaatctatgactcctccatcacatgacaaattgtgttgataaaaagatggcaaaatgtataaataaaaaatttacatgatttcactaacacagtaacaactaaaaaaagtatatcacatattaaaataagacaagcgaatatgtgaaaagttcaaaaaattaaaccaatatgagtttttctaaatactttctataatacatctgatcaaacaacaagagttttcgatctttttcttggcagaaaaaacaatgttgtctcaccatctgtttgagattttctcaggaatattgtgcttgcctttggatggtcagaagggttgggctccaaaggtatatctatagagggagagaagaaaaaaagatgtgatcatttataaaaatttatcaactcatttatttgactgctgcatttaggctatttcactacctctacttttatccttatccgttgaaatgaatgtatagacataagatagagccaggcaagatggcacaggcctgtagtcccagctcctcaggaggcggagatgggaaaatcacttgagcccaggtcaggaatttgaggccagcatgagtaacatggtgagaacctccttcatttaaaaaaaaaaaaaaaaaggtaaatttgcctttaagttgtgtaaaatcaactgcatagaataaaacaagatggcaatatgttttaaaagacaggtctattttataggcaaaatataagatgtaatctggagtttttaaaattttaaaaaagtaaattcagcatatctatctcttccatgtcattctgaggacacagaaccttagttctgttgagtagctgccttccatagttacatgagatctctaagtcctcatttcttcattagcaaaatgtagggagaacacatataggcctttatttgtattgcaaagagccaaatgagacatacataaactgtgctgtaatcctaaagaatgacaataaagagccttttttgggctctcatccaacactacccgtctattaactggtgtgtaaaatcactcagaggctttccttacaccaccaagtggagtatgtttacacaagtacttacatgctttgtgtataaaagtataatgaattaattcacatatttgtttaaattctttaatatcttgaaaagcgagtatagtactccaagttacaaagtcacacatcatgagtcttaattattctacctctgaaaaaaataaaagcccaaccaaagttgttatttttttgttttttttttgtttttcactttaagttctgggatacatgtgcagaacatgcaggtttgttacataagtatacatgtcccatggtggtttgctgcaactattaacccataatcaaggttttaagcctcacatgcatgaggcatttgtcctaatgctctccctccctttgccccccacccccgatgggccccagtgtgtgatgttcctttccttgtgtccatgtgttctcattgttctttttgtttaggattgtcttggctacacgaagcccaatcaaagtttaaatagaagagctataagacatttcctctacagtaataaatctctggcatttaaatgaaaccaaagagccagtggatttaatatctttatgatacaatgttttctatttgtaaaaatttagtttttattcaagaaccatattgttactcagaattctttttacttagattcacctctttgcaaaagtttagaggcaaaccaactaagtgttttctcttttctaccccctcccatcccccgcctctcccagcagtgtagagactgaaaaactcttaagtttcttatctttgaacaagatgttattgtcaggagggggaaggacaaaggggaagccatggcaacaaacactcttacacaggcaaggtctgacattttaaccttcaatctttatattacacattcaaagtctacgtttacgttttatgtcttttgaaagttttgaccacgaatcatccccacctctcttttagaacgaggaggtaaataatgtctgttaagtcgccagaataaatctgcagacacattttgtgttaaagtaagaattttaaagtaatcagagcctcataggtacactcctttgggggaacccccccacacccatttttctgcagccctagccatgacatttcacacctttcccaattattttaagcaccctccattttctttccttctgtgttcaacttagttagaagaaactaagcagcttctatccaggtgacttaaagcaacccatatagtctctcctatggcaacctgcattctgattttaaataagaaatccccaaatatttcagtatgaattgtcctgagatttggctactttaacaaaggaaacaattaggcacttacctggttccttcacttaggtaccacctggataggtataaagagaatgagatgggtactggaaagttgggatatttgagtttttattgagaaaagggagagaatattccaaagaagcctcaacaaagtcccacaggatactaaatagagctacagacaagaacagccataaataaatggtcccatgccagaaggggagaatgagatgagggagcaagaactgggagttttggagggaaggaaaaaataaactaactggagtctttggggaaagactaaggggtgggaacgcaaggcaagccaggttttgttcctggacaggcctaggatagctggctacaggcagaaaggagcctgaggtgggggatgcctcccagaggaccctggggacagcagcagccagaagtatgccgagggcagaaggcacctgtcacctccttaccttcaggcatctcccgttcacagatgtggtgcatgtggaggccctcaccagctacaaaagtcacctcaccaggctctacagcagcagccacaggcactcctgctatcaggtccccagctgctgcctcatagatctcagactcacagtgacacaccaatccctggtgctggtgcaacccagggctggccctggggcacacacaacaggtcagtatgtttcccatggggtgcctctactcctgtcaccatctgtgcctttgctcacagcttgggccacacactcccgctgccctaggctgaggctatgctgcacttgcagagatggtcttgcctgctgctcgcctgcccacttcacagcccaggcatggccccagctggggctgcgggccaaggcccgtgccctgctgactcccctgagttgacttgtctgggagggtgaagaccagccggcttatttaataggttgtgaacccaacaagcgctgagacacacaacaactgcctgaagagagaacagatggagctcctcctccttctgcagtcacctacagactgaagcccactggcccaggtgggagcccaggcttgtggctcacaatgccccgccccacacttcacagtgccctccccgacacctcacagtgccccaccctggctgccacccctcccccacagctcaaaatgtccctgcctgggctgccccaccctgtgacttatgctgctgctgctctcctggcccctcatgcagtgccagtgggactaagattttcattcatcaccagcttcctgagctttttagtcctaagaaaagcataaggtgtttccttacttgaagccatcttcctctatgagttctatacaaaccctcagttagtagagtgggtcccattagcaaccaagttgaacaacttttatttgctgacttaatgtagacacacctgaattgttgactgcttttgtaactaaatattcctctcctgtcttccaatgagtggtagtttttgtctgcaacttgaccatagcggtccctggggccctagctctactctcaataaagaattatggctgtgtgtcttgaatcacaccttaggacccatcctgcctccacctccttctccataaaatagaaacctaacttgtccctccaagttctgaaatgctgaaacttaccaactcccttttctaccctctgtttcttccttccatggcaaggactttcagattttctctcttttactaaaaagcattaagcatgattttgtcatacaaaatagagagctgtaaagtggggtaccacagtcctaattcaataaagatgaatattcaatatctggcaatcagtatgtgcctgacagtgttctaactatgctatgctcatttaaccctcagaacaatctcattttacaggttttacagaagacattgaaatggagaggtaagttatctccccaaggtcacacgactgctcaggctggggccatgatttgatcccaggtagtatgaattctccaattactcaagtgtgattatcagaaagtgtattggtccattttcaccctgctataaagaaatacctaaggttgagtaatttataaaggaaagaggcttcattgactcttgttctacatggctggggaggcctcaggaaacttacgatcacagtggaaaaggaagcaggcacttcttacatggtggcaggccagagagcgtgagcgtgtgaaggagcaactgtcaaacacgtataaaatcatcagatctcgtgagaactcactcactattatgagaacagcgtggggaaaactgtccccatgatccagtcatctcccactgggtccctccctcaacacgtggggattatgggattacaattcaagatgagatttgggtggggacatgcccaaaccatatcagaaagtaaaggtagaagtcaagcttggagggaaagtgacatagtagattagtacatttttaaaagaaaaacctttttttgatgtggattttaaaatgcctccccttcattcaacattgattaagtcccttctacatgccaggcactgtatgtgtgaaacagtcctttcacatcttttctttttttttagatggagtcttgctctgtcacccaggctggagtgcagtggcgcgatctaggctcactgcaagctccgcctcccaggttcacgccattctcctttctcagcctcctgagtagctgggactacaggtgcctgccaccacactgggctattttttctatttttagtagagacgcgatttcaccgtattagccaggatggtctcgatctcctaaccttgtgatccgcctgcctcagcctcccaaagtgctgggattacaggcatgagccaccgcgccagaccaaaacagtcctaactcttaatgctcataggcagatacaaaaacaaaggcttaaggagttcagttgtctgagaccacactgctggacagggtataaacctgggatacagactcacctctatttgaccccaaatttgatgctgggatggttttaattttattctgaaaatttgagtcactgaaccatacaaaggtgaagagtctctgtcagatgtgggtatagtggtctgtataataagaaaggactgaaggaagtaacaagaccaattaagagactttatctaaaagaagaataatgataaaggcagtggcagtgacaaaagtcgaggaaaaattttccgatcatttcagagatggaataggaagtgtgtggtcaagagatgtgaaagaagaggggaagtagagggaaaacagagctgctcaggctctgctggggaagactgggtatgtagcagtgccttcctcctggcagagaatgtaggaagtgaaataggtaaggaggaaaagatagttttttattctcagtgtcacataaaatggaattctatggtcaaaagttgaatataaatctctgtaggctaagttcatttgtgacatcccaacatatgttttcaaaaataacacacatactaaatcaaaccattaagagtaactggggaaattttctaaaatttgcatgctaataatatcaccatttttcatttattactttcatggagcaattctgaatctatggttatagcaaatgaggcaccttgtataaaataaagctactacatgaaacaaaacatttaaaattctattgtcctcagagaatagagaatgcaactgaagccatggtcatggaagtgattaccttgagaagttgtgtacagtaagaagaattgggaggaaaaaaaacctggagaatagggtgatttccacggcattaagtgaagcttgccaaagtgagcactgggagtcaacagacctgcatataaatcaggaatggctgcctctgtaagtcattagaaaggagatgatgtctgcttttcatttctataacagcagcacctaacacagtgcctggtcaataggtactcaacatgtattatctcaatgcgcagagtcaaatgttgccaggagggcaggaaagctacaaattggctatgataacttagtgattgggcttgtgtgtgtgtgagtgagctggatgtcaggtaatgggtaaagtattgaactggaggtgagaaaacaatgacacaaactgagggcttctctttccaagtatttggctgagaagagagatgtaggtagtagttaaagggtaaatatggtaaagaaagtcttttattccaagattcaacaaaaaggatgagtatacttctatgttaaagggaaagagtcaacagagaaaatacatttttgagtttagaagagaaggaagaacaaatgcagaagggccctcaaaaggcacaagtgcatgcaatctggatcagggcagattagctttggacttctacaaaagcaagatgggagaaaggaccatgtcattccagagatatttctggtagaggaaaggtttaggaagagatcttttgatgacctctattttaatagacttttcaaaaaactactgtgggaaaaaggatgctatgtatagaaaagtctacaattcttgatacatctaacaacaacaacaaaaaagcttgatacactaaacaaaacccaaataatgtcttccctaaaagtggataactggaaaagcaatttgagcataaaccaaggagttcaattaccagtaagtatatcaaaaaagtgaaacatgggtttaatttttcccacaaagagttaaaagaagtaacaacaactttcggggaagaggaaaaaagaagaagaaaattatatgaaattccaaaatgtgtgaatatttacaaactctaacataagttcactacaaaaaggactagaagaatcatcatcataggaagcaatgggtaatttcaaaaatcagggaagaagggatgattcatatgtaatttaattttcttgaaaatatttaagttcgaggacaaaaataggtgatacattgaaatgtgggaagccacagtggcaaaaaaaagaattcaagaaagttcagtttcagtaaccaatatctagtaaaaccctcaggacctagtggctacaatctgcgttaatagcatctgaagacctagaaatatcattagataccattttggataatttttgttgacttgagatgatgtctatttaaagttacaaaatagtgcctgcacttaacaacagacacactcaaaaacaggtatccatgactttacttttactttttatttttttgagacaatctcactctgtcccctaggctggagtgcagtggcacaatcttggctcactgcaacctctgcctcctgggttcaagtgattctcctgccctcagcctcctgagtagctgagattacaggcacacatcaccatgtccagctaatctttgtatttttagtagagacggggtttcaccatgttggtcaggctggtcttgagctcctgacctcgtgatctgcccacctcgacctcccaaagtgctgggatttcaggcgcgagccactgcacccggcccacagatatccatgactttaaaaaggaagaattttaaactctctaaacaggaaaatattgggaagcattgttatgaaaatagattttaaaacattttggttgaagacaatattgaagtacattaagaaaaatcctatcctaccatgacattggcaagtctgagagagcaaagagaaataagttggagtactgtgatttgaattaatcaggagcttgattctgtgaaatgagctgagaccttgtttctttatggctccaaagtaaactaattcatccattcattcaatacctatttagtacctgagcccttagcaaacatgccgcacactgtatgtaagttctggggctattgcttggaccaacataaacaaggttcttattcttgtaaaacttatcttccagtaagggagttaacagaccatgttgcctgctttacctaggatggctactgatctccagctattggatcttcattccagacaacagggtagagggagtaaagaagaaggaaggttttttagaaggtactcatagcacagtgcttacaaattattggcttaaaacttagtcacaagaccacacctagctgcaggggaggttcaaaagacataatcatatagctagggtaatgaatacagaagaaacaattggatatggaaaggaaactagcatgccattccacaatctctaaagaaagattagggaagttttggcttaaagcaagaataatcacaataaaattttacaatcctttgcaagcatatatgaaaacatacaaaaaagtttgtaatgatcttttcttaagctgagaggacagaaaaaatgagaaaaattaaattattaagtgaaactttggtttagaggtaagaaacatttgatgacagtcaagagatcagggttgtacagtatattatgtgaatgttgtgactcactggtttcatcttggatatcataacttgacattttgtaaaagtcgtttttcatgagaatttttccaggtgccctataaagtcctgtcccatcaaaagtgaataataatcttccatattcatgagatatcttaatggcatctcctacagtcttccattgtttagtttaggtaaacctgggaatcacttttgggtattgtctcatccaacttctgttacccatccgcagcataagtcatgaaggtcttggatattttgtgctctagcaattaattcatcatgaatcctggagttattttctattccaatcatttgtcctactttgcttcccttaagcataatgaatttaccaccattaacttctaaaccatatggaatttgtacatgtgatttgactttgtgagcaaaaattctatggatgtcttgaaatttgtgcctagtataaaacttattttcagtagagattatatttctgcactcaggcagctatgtaactttcactgttattgctggtcgggctttccagacatgatgataacctcctaggttctctggaagagggacatattcttcaggatgacattataatattttgttaggtaaaatcttttatctatctaaattgatagttcctaatgtcttgagtaacaagactagtactttttatttttgttagctctgtgagttaatgtgaccaatgcctgaggttgagtaatcaggccagtatcagactggtctttgccagaactttttgcctaatacgtttctctattgttttctacaggtcacaggatgttaacacgggttctagaatgcaatttttaaaaatgttttgtgaatgactagcaacatggtaatttaattttcaaatataatttacaagtgaaatgtgtaggactccaacaaggcacaatgacctagatcctgagtatgattccatcggaagaagcaaatactgagttgaacaagctcactcatgtctgcttacaccagtcacttttgaatgctcaatggcaggcagggggaatgacctgtgtttggcagatgtccactcagtatgaccctggattggacatatagttaccttgggtcaggccagccatgtgttgttggactattccttggagatacactcttagtgactgtcaaagttcctgagtcattaggtgcctgcagactatgcccactgatatttgcattaggtgcaggctgcctagctgtgctgacactgagtgaagctgtgaggtttcacaatgacatggcagccaattacatatgctcagatgtaccatgtatcaagagttattcacataatcaattaggcaatatcattctacacacaggcagtaataaagggagtaaaaaaccacaacaatgactcgggagaccaatgtgcctccagaagagtccagtgggtccagaagccctttagatactggtcagaggttccttttgggcagagatcacagcagcagccaccaggtatggagaagtccttagagttctcatggacaaagcttctgaaggcatcttggacaagaccttatctttgctggcttcatgatcctatgcagatgggtccattctcattttctcagccacctttcacttcctatcagttcgtttcaggtctctcatgatcccaggcagcagtagttgttatcgtctcagtccaatcatatatgtttatctctttggggatgaggggacaacttcattgtggacttaattctactggagatgagtgaccccattttaagacatcaggatcacaaattattatcgcatgtcatcagggcagagaatagctacaacctggagctgaaagcagataactccatttattctagaaacattctgtcttgattatggtgccagttactgtgagggacttccttttctccacctattttttacaaggtttgagtctgaactgctaatattctactgatttatggatgaagggactgactgcaccattccagcctgtcacagcacttgcaccaatacttccactttaagagttttccaccttgtccagaactacagtccattaatcccctcattttctctcttaagagaataaacaacacatctcatgtacatacccacacccctcttctcccaaataccaaatacacaaaaatccaatctctctcctacctaagcaattttagatagtcactttctcttaattactttaagctccctgactcaatgcttgtcttttctctggcaaaatctcatccctggatgagcaccactttgtgttggctcaatgacaccactcagctgaaccagaaaaatatcaaaaagtggtcagaggtgtcatcataaattcaaattacttacataacaaattggccctaaatatttccaaaaatcaataaaagttttgtttctccaatgacatcatttcttcagaaacccaacatgtataaccaatcttttctatgttcctctaacttttattctacttctttcacctgaatatcttgccatatcattcaaggagaaaatatatcccattaggcaagagccgatcatcttcccatcacctaagaaactaatatgcacaggatgcaaccacctcatctttctctgactcatcatatcagaaaaagtacctttccttttctcacaaggcaaatctgagataaaaggtttagatggcctataattctagcacctggggagaccaatgcaggcagactacttcagcccacgattttgaaacaagcctaagcaccttagggaaacccatctctaaaacaaatacaaacaaataagtagctgagcatggtcgtgtggtggcacatgcctgtagtcccagccactcagggtggggagcactgaggtgggaggatcacctgagcctggaaggttgaggctgtagtgagccgtgatcacaccaccacactccaggtggggcaacagatatttttaaaaggatcttctctgttaaaaatgatcaaataaacagatggctatgaggctgaggtggctccagtatgctcagttcctccttcaacaaaccaaaacttgactcaattaaataataaaaggaaacttaagcttaaccaatcaagccaccaactatcatctaaccagagactttccaccgtaatgttccaaatgaggccactgctgcactttccccaatcaagtattttctttttctttcatattcaccatataaaagccttcccccaccctccctaagcctctctgttggagctctgggatgtttgcagtctcaggctgcttggtttatacatttccgaatgctcaaatatacttcctaatgtttcaaagagcctaattgtatcttttaacagctctcatggttatgtcattgtttctggattttcaagttctacctccttcatgggactgattctcagtatgtgaacacgttctcttctaccattctaaagactctcctaatatgggcagtttcttacaaaactataacacactcttactatgtgatccagcagttgcactccctaggtctttatccaaatgaccagaaagcttatgtctacacgaaaacctgcacacagatgtttatagcagctattaaaatagctgccaaaagttaggaggaaccaagatgtccttaagtagcttaatgataaatacaaatgtgatatatttagaaaatgaagtattaatcacctctgaaaagaaatgagctattactaactgtgtattacacactaaatgcatattactaattgaaagaagccaatctggaaagttatctacgctatgattccaagtatataacattcagaaaaatgcaaaactatggagaatgaaaagattggtggtttccaatggttaggaaaagaaaggataaatagagcacaagattattacagtaatgaaaatacactgcaggatatcataacagctataatgatacattcattatacatttcattctcattatacatttctccaaacccttagaatgtgtgccaccaagagtattgctctgggtgatgatgatgtgtcaatgtaagttcactgactataataaatattctactctggtgtaggaggtcattggtggagcgacccaagagtgtacaggaatcgagggcatatgggaactctggactctgcactccattttgctgtacactcaaatctactctaaaataataatgtatctttaaaaatctattactatcacatagcccttttcaagtctccaactggtctgagccagttctattaaatctcagaaaacactggttaataagctagttctgacccaactggcaagaagaggcagaaaagacccaggccaggggagcatattgcacatgcatgcaccaggaaactggaggaagcttggaggctctttagcctagtcctgagcctgctgaaactgcagttacaggcacaggtgcctggggcaccaatctgaatctgccaacatccaaggccacatgaacacaaatgcgcagagtctcctccgcaattggtagctaaggatgttaggccatgattggactaccatgggagatgatctggggacaatagattctgtagacttttgttgtctcttccctgccccaagcatttcactctttactcttgccacaggcagcagggaagctccctatgtacatcatccccacagcctatagctttgtcacaccctcagtctcataccctcctatggcacagtcagtcaggacatccaaccctcaaactcaagggtgcaaacacggccaagataatggggtgagcagaaccctcacctttgatctgcagacaaatgccccctaccttctgggcctctaccagcaacgggaggctctggaaatttccagacacacaccagtgttctgaactgcaggctgctgccccatcctatggcagagtagacattttctccaccagattgccctgttatccagttgaatgaaatgtctttttaacatagaaacagggcacagaaactagtgttctttggccctgaaccccatcacactgtctgcaggtatacacccatccttagcaaataccacagatttgaggactcagtccctggagtgtggtcattggctctgctttcagaaaacatcaaggtacttttggcaactctgcagatttcatgaagaaaagcaaaaacataaacaaaaccaagtgatgaacacacacacacacacacacacacacacacacacacacacacacatacacacacacacacacaccccaaagtgacaggatgtccctccaggacatttgcagagaggggagcagaaaacatcccaggggcctttcacagctacttccttgagcccattttcagacagtgctgtctagacctgtctcagcccaagcaccgccaccctgatatgcaggagctggcttccctacctgaaattcaacatcaagaaatgatctcttggccaggcatggtggctcatgcctataatcccagcactttgggaggctgaggcaggtggacagcctgaggtcaggagttcgagaccagcctgactgacatggtgaaaccttgtctctactaaaaattaaaaaagtagctgggcgtggggttgtgcccctgtaatcccagctacttgggaggctgaggcaggagaatcgcttgaaactgggaggcagaggttgcagtgagccgagaccgggccattgctctctagcctaggtaacaagagcaaaattccttctcaaaaaaataaaaaagaaaagaaaccatctcttctacttaacattaacaggaatgtcctcaagcagtgtcctcattggcaggggtggagtgggggagtttcttaaaaagtgaggtctctgcccaccacctagagaacctggaaatgtccatcaatgccacaaagtccaaatcaatggatagtgctccaatgtatggcagattagaccatctctccattagatctgggtttctattccattaaatgaaatggcttttctattacagggtcaggataagggatcaaaagggtcttacaactgaactccagtgtacagtctgcacagacactaggcttgtgcaaatatgccacggcgaggccccaggacccttgagccagctgaatgcactgagtttcaggaaacaatgagatacattcagcaaaaaagtgggcttcatgctgaaagaaatcaagccaagaacacacacatcactctgacacacacacacaaagacacacacacacatgcaaacacatatgcagacaccctagtggccaataggtcctttcaccaggaacctgcagacaggagagcagaaagcctcccagggttccatcactgcactttctggagccccttatcagacggccagccccaggacagcactgttttatcctggtccagcccaaactgcaatctccctctgatgtgggagctggcctcctcaccagaacctctctgtcagacaaatttctttttaaaatggtgagagagaaccttcagacagtgttctgatcagggtgggtggagaggggggcttcctaggaagtcaggcagggcagggctgaagccctctgggttagctgtgggcttttgatataaaggcagataagactggacaggtggggggttagtgaggggatggactggggtgtgctgaagaactccagttgggagtgttctgttgctataactgagttcctgaacctaggtaactcataaagaacagaaatttattctctcacagttctgcaggctgggaagtctgaaatcaagaggcctctggagagggcattcctactacatcctcacatggaggcaggtgaaagggagagaggatggatgtgatgtgctcacatgacagaagagtgacaaaaagtaaactgattccttcaagctctttttatacttatataagatgtaactattttgtatgtatataaaaagtaacatccccctcatctactacagggtagtagataccacccacatatgggaaatgcagaatagataaataatttattctctcctttatcagttttccaaataacatgtagcttttttacctaaacacctccattaggctgcagctcccaacactactgtcttagggattagagttctgagagatacattttgagggatacattaagaccatagcaattgtaaaaccaaagagtatcccagccaggtctcaatcaatgtagtagtttattttgccaaggttaagaacatgcccagaagaaataaatacagaatcacagacacagtctgtggtctctgattttctccaaagatgattttgagggcttcaatatttaaaaaggaaaagtgacctagagaggaaataggaaatgtgtggtgatcctcacgttgcaagagaaaaggagcaggtagggaaatagtcaattatgtactgatcttatgctcaataaatcagcacttaattagaaaagatgaacggggtagctacctgtggaaatgtttaaacttttatctgtaactgcttacaaaggcaaggaaaggtggcttcttgcatgactcagctttcaggttacctttttttcttttggcatagtaaattgggtccccagtttttattgtcctttcatacaatgatcaatccctagatctattatttcactaggagttgcaaaatagtaatattctaatgctatcattacaccttcatttattagctgaaatacttacataaaaagtaacttccccttgatctgttagttatccagtgacatcacccacacaggaaatgcagaatagatgaattattcccttatcagctttccaaataataaattggatcactcgcagcctttttcttgcttgtaaacttatttattataattacaaatccatgcacttattgctgttactataccaattgaagttccaattgtcctgtttttggacagtaggagcatcatgtcatctcctaggccctctgatataccctagttatgtttcatagcatccttatttgatgatatgtcagattgatccagaatcatctcatacatcttctgtccagacctaaattcaggtatttctccaaggaactctgatctctttttataaaaaaaattgttatttccagaatacagcctggatatgagaaatgctgccttactaagttggtccttgattcgtgcctttttctgtgaatacatacaggagtgctccttccttctgggttctcttttttttgagagttaaaacatatcatgacatgaatcaagttaaattatgcctctgagtttcagtttccttttcagactatttattttgatgattacatgagttagtacacagaaaatgtacagcagtttttgtgatatactttaggtgatcagtaaattctcagtgcaaaatgtgcaaagggtgaaggggggaactcccatcagtcctacctaactggatagcaagctccttaaagccaggatcgtagttctaaacctctgtgtatccaccataactcctagcacaatgctttgcatcaatcatgagctcaagaaattattactgatgaccaataaccatcatattagctgcatgaaagtgcaataacatatgcactttcaaaccaaataacaagaagaaaatctataaatagcaacctgtatcaaatatttctgtgtattgttgtaggtctgtgaaaccacaacacactgatatattgaaagacatagactaaatccagtcctaaagcaattcgaaatttccacaatataatttaaattcattaaattttcagatttctgaattcattcaagttctaaagttatcattctgggacagttcaatgtctttaagcttttaatcttctccattctaatttcctgctataaaatcaataaagtgtaggttgtaaagaaaaaacaatcatgaatccatgatgacttgtcctatccaaattgaggactataaagtagttgtttattactttgtaacttctatctgtatcccctttctcctatactaagaatcctaggtcctcaatgacaccaggaatgacagaattaaagtattatttctcctcatctccttcatcctataataccgatctacaaattgaagatgaacaatgccaacaacaaacagttttagggtccttgtttggcaattcatttttttccttaagatgtatttccttttggttgtacaaattgcaatgctttaaagcgtcttgaaacagttatttttggtatgtttagaaccctcaactagtgttttaagacatatttatgtttaggtattttatattcattttttatttactgtactttcatttattaagattttattatgaataatattaatattggctggatatggtggaatgattcattcagattggttgggactttgggtgctcacttcagcagcacatatactaaaactggttgggacttgggccataccagtgtttaagtatttctctatccccctgccttgatggatcctgccctgccatgaaaaattgactaaagtaagtttaattcattaaaatgtgattttaatatgcctacttctcttgaaagacatttgccaaggttctaaactgaattctggataaaaacaggtaatgaattctattatctgtttaaggaatgaattccttgcattcacagaagcaagaatggatgacaaaactttgtatccttcaaatgaagatgaagtggccaggtgtggtggctcactcctgtaatcccaacactttgggaggccaaggtgggcagatcatctgaggtcaggagttcgagaccagcctgcccaacatggcgaaaccccgtctctactaaaaatacccaaaaaatagctgggcatggcggcagctgcccagcaactcaggaggctgtggcagggagaattgcttgaacctgggaggcagatgtggcagtgagctgagattgcgccactacactccagtctgggcaatagagcaagactccgtctcaaaaaaaaaaaaaaaaagatgaagtatgcagagaagaaagagctttcacttacttgcatgaagtactgaagatgtgacctcaatttcacttgctgcttgatcagactgaaaggctgagacattgttggtgccaagctcactagcactagtaaatctctccgggctctgggtatgcatggagctggcactgatgtcatcacctccatgatgtagatcttgcttatcaaacactgcaaccagctagaaatgaaacacaaatgtgcatttataaataaagacatttaaattactaccaaaaatttatactactttaacataagtctacagtgggaaaatacccgagtgaccccagaatgttaagttttaagaagcaaaaccttggctgggcgtggtggctcatgcctgtaatcccagcactttgggagggcaaggtgggtggatgacctgaggtcagaagttcgagaccagcccggccaacatggtgaaattctgtctctactaaaaatacaaaaattagccaggtgtggtggcacacgcctgtagtcccagctactcagggaagctgaggcaggagaattgcttgaacccaggaggcagaggttgcagtgagtggagatcgcgccaatgcactccagtctgggcgacagcatgagactccatctcaaaaaaaaaaaaaaaagaaaagaaaagaaaagaaaaaaaagaaaaaccttaaaaagacaatgtttctgttaatgttgatgctttatttctacatttctgaagtgaatattttatagacaaaattctatggctgaaaaataatgaaactgtttgctatcacagcatgctaagatgaaagtaagtttaaatatgttctaaaatataggctatattgttaagtggaaagaaaaaatgcaaaacacagagcgagaatgtgtatatatatatatatatatacacacacacacacacgtggtataagctacacttcatataatgagaaggggatattaaaaattatacatgttatctgcacatttgtgcataagatatctaaaaaggataaaaaggaacctaatgaaatgggaatctaataaaaggaaatctaataatatgagcatgcagaaagaggtggggaagaacataactagcctaagtaactttggaaaactattttcattgttgaaagctaaagacaaaaaaaagtcccacaaatactattttctaattagtaaatttatttctcaacaagcatacggtttcacaattctcaatctactatacacacacatacacacacacacacacacacacacacacacaccaggaacaaacaaacaagttaacatattttggaaaataaaagccaattttctcactgttagaagttacaaagaaggaaaagctagaataaactcagtggtgttagagtggaatcaaaggcaacagtaagaactcacagtttttataagtaggtaggtaggtacacagtcagataggtatagacaaatgtcaatgcatgtgtgagtacaccaacatagagttcttagctctgtcaatggagagatcctagagtaaatgacattccagtgctaatgagcacacctagtgctcagatcatggtttctagtaccattctccagttaatgatgaaccagggctccctagaaatagggttaatttcagggctgaggtcagagaagatgcatgataagcctggaacactttgtgatgccaaaaataaggaagaactcaaaaatgatgaaggcatatcaaaaggaaacaggtgccaacctgaaggggctctcaatggccaatgttgagtgttgggagaaaagctgagtgttgggagagaagctgaggcagggcttggaacacgtccagggtctaggattaaaacccctcgtggtctttggaatgtgtctagacttgctggctccttgcttctagcactccctttatctcaagtagccgtatgtttcaaagaaaatgctaaaccgtcacagctgtagctcattcacttgatacaccgcttcctttcaacccccacatcttcactgcctgtttctttgtttgatcatcaataaatagtgtgggatcccagagctcagggcctttgcagcctccacactagcattggctgcatggtcccactttctcttttaacttgtcttttctcgttcctttgactccgccagacttagtagcccccatggcctggtgttgggtctgatcactccaacagttgagacaacctgaaaataaaataaataatattagcattggatcataatccaaagaatacactaaacagccatgagtccataataatataaataattgaataaataagtggtgtagaagcaacagctgtttcctactagaacattccaaataaatgcagaagtaatgatggaaagaaatcattaggcaacctccaccgtaataactgctataggtaaaaatctactcatgggtcctaggactaatgggggagaatacaatatcaaacaggatatttgtatatctctaaatgtctccccgtatgatacatttcagctaaaaagggaaaaatatttggcagcccccactgtaccaagattaacatcaccagtaatggcaacatcacgtaccatctgataaaatgccctgagaagtatgtaacattacttctgtgacattcctgccacatgaatcgtatttatttcatagactgtaccttcatttgggtttgtctgatgttgcctcatgattagatggaaggttacttcatgatgaaacattccacaaacccaaatggaagtgcagtctacaaaatatttacaaaataaatataattcttaaaaagtatcaaggccatgaatacaaaagaaataatgagaaaattatgcaaactggaggaggctgacgaaaaatgagaactacatgcaatgaggacagaaaatgggtactggagggagaattcagatgcgctctgaacattagttgactgtactgactcagtatgagtttttcacctttaataattgttctatgattatgctaaacattaacattagggataggtgaagggtatgcagaaatactgttaatattatttcaatttttctgaagtatataattatttcaaattgaaacgttttaaaataaaaattgattctatttcttcttataactaatacagctcttaaaatgttagtacacttattaaaaatcccattgagaataaggtctaaggatcaacaatgactgtcaccttgggatattcatcctacagccccatgcctagaggaactaaccttaggattctgatgagaaaaccatgcctgaagccaaaatccaccccttttctgcctccaatccaaggacagaaatatacatgtacagaattcaaatagcacacataattacaatcctcattttataaatagttttgtcacttggaacaaatgctatttccatgaatatgtacattttacatatcatcaatccatttatgaaacaacaaagagggtcatagagacatgtaaacaaacaagaagctcagaaccctgctgaggtataatataaaaacacctgattaaataatctggaaggagggtaaatggtatgaagaaatcaaaacaggatgaatagttgagccactcaaagttacagggagcaaactaagtgggaaaataaatcgttaacagttacaaaaactggaaatgtgcttgtatatatgagacaaattgtccataaaatcaacttgtttatctgacattggctggcaaggatctccctgtactagtaacacagacattcaactagattaggagtcatccagcaacttttcctgaaaatggcaaaacagtaaacatgtttggagctgtggtccacatcatctattccatattctactcgacctctgcagcatgagagcagccatagacaacacataaacaagtaaacagggttacgtttaaacaaaactttaagtataaaagcagtactgatagggtttttgcatatgttactttaattatgactttaattgcttaaagtatttcctggaaacacgaagttgttaacaagtgttagttatttttgtttgagagaatttcaagagattgaaattatcaacagaggaatgtgaaagtcgttgggcattaagctaagccataaaaactttaccctgaaaatcgtgggggtgtccttgaatgcccacgagtttaatttccattttctgcctgaggttttaaggagtatgcaggattaggagggtaaacactcatagctcattagtctaacagtgaagaaaccatgagggcctagagtaatggaaaggcaatgaagtgaaaagacagttaaaatgtgtaattttccaaatacagaactgagatatttaaaaggattgtatgtggtggttgggtgccattacaaaggaggtggatgaattttaggcgtctagatttgtggtgctgatggttgggcaggggacaagcacacagggaaacaaggaaaaaagatgtatttaggtttaggtaaaaatatcacatgctcagtatccaattcctgttaaacacctggagatgggagtctgtggtgcaaagggagttcgagtttaactatacacgattgggtgatgctggcatgcaaggagagatgaagccatggatttcattaaggaccccaatctgaatgtggaccgcacacaagaatcagaaccaaaacctggacacagccaagactgcaggtttctcttcccttgctccaaatccactttcagaagaattagagaagaattgactaaagaatgtaagtaaactccaggaaacagggttccacagaagctggggaaaggtcagtacgtggaagagagagatcagtagtacctgctcgctacaaggaggcgcctccaaatgtcaatgcctattttcaacaagtgggacccaaagtgattcatgccagtgctctaaaatacacctgacccttgaacaatgtgggggatatggatgctaaccccccacagtcaaaaatccaagtttaactctcaactcccccaaagcataactcctaacggcctgcggttgaccggaagtctttgtcactaataatacaaaaaattaagacctattttgcctgttattcacattacacactgaatatgctgctcccagcggaggccgagactcctgcccgggcaccccctcacagcccccactccagcctccccagactcaccctcggcggggccaccttcttctcatttcagtctggggccacattctccgggcctgcggggcatggcaggaggcaaagccaaaggcgaagtggccacaaattccggtgggggcgctggctcctgccccaccccagcatctataccctgagtctgataggacgagaaggaacatttcagccagccctgattgggtcatattatccaatcagagttgttttgcacagtggctctcatccaatccgaacatgccttacaggatatctagttaaataagtcattataaatagttgctccgtgggctttccgcatttcaccctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcgtgagtccgggagtctgggataccggcggcagaggaaggacaggcaggagtctcggcctctcggggagcgacgtgccgggaaaggcaggagggccccagcggtgggggcgggggttgcgcgccggggagggcggcctcaggctgggagcctggcagatcgtctgactctccccgagccccatcccaggccgagccaggacccctctgatgcacaggcgtctcaggagcccgtttctttcttgaatccggggcccagtgcggcttgaacctagcccccgacctcctcctcgccctctcagagtccgctggggtgggcgctgaaggagcccgggtcggagaggagccctccccttctctcctgcgtggaagccctgcagcctccgtttcttttgggactggggtccggggccttctgcctgacccggggtgagaaagggagccctgatcaggacccggtgagagggcgctggagcccgggagcggcaggagccttgagcggcagcccgggaagaggatggggtcaccttctgccccaggtcccccactgccaggatctctgtcaccttctgggggtcctgtcccctggggtcccaccccccgggctgcctgtgggtatctctcatctggaactggaaataaccctcttcatagtacggcttagcaaatatttattcgcccatgcaccccccttttttttccttcatagtgttctttttgtcttggatcatttgtgtttttcctacattgatgtgaagcatttttaaagacactttagagattagtcctttattggttcatttctattgtaggttgttgtttcctactctggtctttgttgtttaatttcagttttaatttcttgcttggtttagttcatgtaacaatatttttcttagaatatttgtatctgtgtttgtgaaacagaacatctattatttctgggttttttattgtctgatcagattgtgtattaatgtaatgctggcttctcgaaacaaattgaaaaaccatccctttcgtctttctctttgagagagagtgagcagtgtcaatatttttttcttccttaaatatttggaacattttcaaagtctgatcctggtgttttccttgtggagcattattgttgatttgttggatttttaaaattagttagttaattttgtttaatatatataggagtgttcttattttatgctatttttgtgccagttttagtaagttgggttcagcatctgttgcgatctctgttgtcagacttttgatcatatgtatttcacaaaattctctgattatcttgttataatactgttatgtagagttgttgttttgattctgatactggtcacttgtgttctttcatcttttttccttaatcagttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgagggtgagtccgggagtctggggtgccggcagcggaggaaggacaagcaggagtctcggcctcccggggagaatttcacaaaattctctgattatcttgttataatactgttacgtaggctgttgttttgattctgatactggtctcttgtgttctttaatcttttttccttaatcagttttgctagtggtttattaactatgttgtttataaaaacaacttttagccttggtttatttgtgttatgtttttttttccatttcattgatgtttgttatctttattattgccttcatcctgtattctttgcacttgatttttctttcttgattcttgagaaaaaagttgaggtgccgggcacgttggcttacgcctgtaatcccaacactttgggatgccaaggtgggtggtcaggagttccagaccagcctggccaacatagtgaaacccccatctatactaaaaatacaaaaattagcagggcgtggtggcagacacctgtaatcccagctactcgggaggctgaggcatgagaatcgcttgaacctgggaggtagaggttgcagtgagccgagatcgccccattgcactccagcctgggcaaccgaacaaaacttcttctcaagaaaaaaaaaagaagttgaggtgattgattttcagtgtttctggactcctgccctgcagagatcctcttgctgtaacctgtttcatgtgaggtagagtttagaaaatatttattggcctctgtgccttacttttcttcatatactcttcttattttgttgatttatctttagggatttttttccttatgttaaattgaaggacttattgttaaaatctgtaagttagccctttattggcttatttttgtcataggttcttgttctctagtttgatttttgttgtttcatttctttgtgttcatagttgtatatagtaatctggttgataatgatcttgtatgcagtagctttgcttaatttatttattaattgtaacactttatgtcatgttaggctgtgctgagtgcttctgggagcagccaggtttccatgaactcccagtttactctaaatactctagcagcccacatgtgcacacactggataatggtcatgcatgtagagcaatgatgctggggaggcaccgactctgtcattctgtgaatccaccgcacaatcacaaacattagcattaaaataaaatggactgttaggcaactgcaaaggactaatgcacctatgtggcacaaatgtgtctttccgtattcaaagtacttgtaagagcttcaagttcctcatactcagccactgacctcagggttcttggtacacaggcatacatgtgcagacacacatacaggcacacatatacacatgaatgcacatatgtgcacacatatttacaggcacatgcagatgtgcacacacagacctgggtgagaaagtcagatgtacatggaacagcccctgctttgtaagctgtctggctttgtagggagaaagaggtgaaacaacacacttgttatcttggaagaggagatgaagggagctgagctggatatgtccagtggggagaaagccaggagccactccaccgaaaatcgaggtctccacatggatgatacccacaaaacattggcaggaaggacacagccagcaccacatcagtggtgactttcatgagtgtcaactgtggccatccaaattaaaggcctggcaatgggataagttagcaactgaactttctgtatgttaccttattaactttctgtatattagcttattaactttctgcaatcaaatgctgattaagcattttctgagccaaaagctttgtgtaatttgaatctagtgaaaaaatgttatgcgtttaacactataacttgagatctaaaaacaaaaaaacaattgcataagaattggtcagataccttgtctttgaaacatactgaagtcttcaaaattaatctgatagctctgcagttggtatgtggcataagaaaatatttggcatgaaggggagtaacacaccacatgaattcattcattatgaagaaattcattatgaatatatgtgggcaaattattaacaaccctcccaaaagcagaaagctcagactcaggaagatccatttaaatggagtgatttgggagatgatttcaagcgcaactctgcattgactcagcatttattaagtcatacagcaggctactggaggcctcactgcagcctgggctggtattcagtgtcctcctccttccttctcagtagacttccttggccttgataataatacgtgttaacaaacacaaatctcaaaatacacataatgtttcttcccccacaagccagggtatcagctctgcaaatcagatgaccccaaggtcagtggggttgaccagggacaccattctgcattcctcctcagcttccagatcctgaggagctctggggccttccttctggacagggaacatgtctgcctggcttcctcagccaggtacgggaggctttggggacctgtgtctgtctctgggaaggaggaaggagcctgtggcatcttccttaagcaaaagcacatccagcccatggccaaacttcagagtggggcgaggggcccagcacagctcctccgttcctgcagcagagcccagaaaacacatctgatgttgtggctgcctcaaacctacaaacaccatgggtttgaagtgtcctgttgacatggccatggccactttccccgtggaccgtggcaagtttttgtttttggtttttgttgtttgtttgagacaaggtctcactttgtggcccaggctagagtgcagtggtgcaaactcggctcattacagcctccacctcctgggctcaagcaatccttccacctcagcctcccaaagtgctagaattccgggcttgagccaccgtgccaggccttgtgtagaagtattatacattatctttaaaatgtagtttagtgctaataatctaaaattgtgttgccatttactattaatatgccctttgtggtgcatctaataaaatgctttgcttcataacctgaaacaaaaaaactttcactatatttacttgatcagatcaacaactatagaagtcttagaataatgatattcttactcaaaagaaaagcaacaactcatctttaatgaaactgtttctgtgttttattagtggttgagaaataacacattccttcagcagtggcagcagtcagataccatatgaattttttatttttttttactttgataaatcctgaggctctgttgaggaagaagcttccacagtaggccctaggagagctgcagccaccatgtccacactgtgttatgcacaaatgggaatgtagtttcccagagaaaacaacttctgtgggtagatttgtgatcgaagtttgtgaatagctttaaaaaatccttatgaaggccaggcacagtggctcacgcctgtaatctcagcactttgggaggctgaggcaggcagatcacctgaggtcagttcgagaccagcttgaccaacatggagaaaccccatctctactaaaaatacaaaaattaaccaggcatagtggcacatgcctggaatcccagctacttgggaggcagaggcaggagaattgcttgaacctgggaggcagaggttgcagtgagctgagatcgcaccattgcacacaagcctgggcaacaacagcgaaactctatcttaaaaaaaaaaaagaaaagaaaagaaaaaaaaaggctgggcatgatgactcatgcctgtaatcccagcactttgggaggctgaagcgagcagatcacctgaggttgggagttcaagaccagcctgatcaatgtggagaaaccccgtctccactaaaaatacaaacaattagttgggcgtcgtggcacatgcctgtaatcccagctactcaggaggctgaggcatgagaatcgcttgaatctggcaggcggaagttgcggtgagccaagatcgcgttactgcgctccagcctgggcaacaaaagtgaaactccatctcaaaaaaaaaaaaaaaaaatcctcaggaagattatttacttataatctcctccttccttaattagcagtctcagcatttctgcaataaccaagtctcagcatccagtgaagcagcctgcaacatgcgggagctcagggcattgccactgcacatggggcacctggtgggactttggcaaggattttgtcattaacactgagcaaaactctacgaagacagaggcattcttttagattaaaaactaacaacataaggcgggacatggtggctcacacttgtaatcccaacacttcgggaggtcaagggggacagatcacttgagctgaggagctcaacaccatcctggacaacatggcgaaacccgtctctactaaaaatacaaaaattagctgagcgtcatggtgcacacctataatcccagctattcaggaggctgaggtgggagaatcgcttgaacccaagagcagaggtagcagtgagctgagattgtgccaccacactccagcctgggcaacagagtgagacgcttacagaaaatctttaatttctatagaaaatcttcagtcttctatagaagaaaattaaatattacaaaattgaagattagaaaattacatagagagccgggcatggtggctcacacctgtattcccagcactttgggaggccagggtgggtggatcacccaaggtcaggcgttcgtgaccagcctggccaacatggtgaagccccgtctctattaaaaatacaaaaaattagccaggtgtagtggcgggtgcctgtaatcccagctactcaggagactgaggcaggagaatcacttgaacccaggatgcggaggttgcagagagcagagattgcgccactgcactccaggctgggtgacaagagctaaactctatctcaaaattagagagaaagagagagagagacagagagaaagaaaagaaaagaaaaagagagaaagaaaagaaaaaagaaaagaatgattgattccatagagaaacaggtatttatcaatcttcttgattctggtgctcatcacaaggctgcaagttactcagttccaccgtcttttgcatctgtggttgtggttgaaaggaatggcctgaatcatgcacctcataactcacagagtggccccatgccttccagttttctttttttttcactgaggttctgaattacccatgtagtttaaggagttttgttgttcttcacaattctgtctgtggctaatcttatgtccatgggattcatttgagtctggaacatgtcccagatggcaagatgcagcatgccatgatattttcaaaatccatgaacatggttgtttggcagttccacagtaaatatgtatttggagccttaagctatttctttcatgatatatgctcaggtactgatagcgacactgttgaattctacttgagccctgaggcactgggaaactgtgatggttaaagaaatccccaccttgtgttcctgccttaccgcaaagaattccccttccccgttgacttagctaagactcacggatccccctcaaaggatgtcccacctatgacaaggtcagacacagacccccccaaatgctgtccttgtttcatgaaagtttagctgaactgcttgtccccacagattcatcaggatataatgctaattaactcagctttgatatgggctttaccatgtccttcaggacctgcttattagttagagaccccttggactgcataacttcttcaaagacattttattttatgcttaatcatatagaaatataatgatttgatagattaaccaatgtggttttcctcccttgttctccagtttcccactatttctctcccatttagtctaaaccttggcatctcctctttcaaaggggaagttttaacaaaaggacaaagagaaagaaaagagtagacactcacattttgaattttaataaacttggaagaatgatgacacaagagtgagtttgtcccatcccagagcagatgaggagcttctgaatgagagtgggggaagggattgtgctgttgacactcgatggcaattacactgatgcagacagggaccttgagtggtggggggctgagagtgctgagtgcacctccccgggcagacaagaagaaacttgcaagtgcaggcacaagatgaggaatcacagtgaaacttaccacaacattcagcctctattcaggagatacttcacaacacttgccaggtacttttctaggcactggacataccgcaaataataaagccataaaaaaaaatatgtccctgtggaacttgcaattttgtgcagaagagcaaatagttcactaaagaactaagcacaactggccatgcatggtggctcacacctgtaatcccagcacttagggaggctgaattgggtgaatcatgaggtcagtagatcaagaccatcctggctaccatggtgaaaccccgtctctactaaaaaatacaaaaaaattagctgggcgtggtggcgggcacatgtagtcccagctactcaggaggctgaggcaggagaacggcgtgaatctgggaggcagagcttgcagtgagccgagatcacaatactgcactccagcctgggcgacagagtgagacttcgtccaaaaaaaaaaaaaaaaaaatagaaaagcacaaccatacaatgtgggaaggtgtcaaaagttatggaacaaaatgaaggaaaggggatagggactgctgaggggtgggctacaatctgaattgggggttaggaggggatggagtgagaatgttctatttgatcacagccttgattcatgtgagagatcctggaggagaaagtgggcaaaagccgcccaagtggctgtagcaggctgggtgctgcattacatagggcacattaagtgaaatgtgatggctattttgtgtaatcctttaaaatcccaatagaaataggactttgtgggaggactacattttgaaataattattttcaaaaatagttatttcaaaaaaagcacagcagttgcatcctattgaatagtgggaacactggatgataagttaaagtatcattttgtgttaaaatattgaagcaaatatggcttggtgtggtggctcacacctgtaatcccagcactttgggaggccaaggagggtggatcacttgaggtcaggagttcgagatcagcctggccaatagggtggaatcccgtctctactaaaagtacaaaaattagccagttttgttggtgagtgcctgtaatccaagctactgaggaggctgaggcaagagaattgcttgaacccaggcggcagaggctgcagtgagctgggattgtgccattgcactccagcctgggtgacagagcaagactccattaaaaaaaataataataatattaaagctacccattaaaaaaatttgaaagtcccagaaatgtggcaagacaaacaaccctattaatggccctaatgaagccctatagatttctcagaggatcctccatgtgttagaaccatacctagggctgcagctggctaagacattctccatcagcctctgggatcaaaggcggggtgtggaggttgtctggatgggaccatgagcctccctctcagtaaaacacaagcacaagggcgacatccctcttggtttttcgtaatgtaggaacacaggcagagcttagtgttctcagagcctctgagatcccgggcaaagcgtttggtaagatgctgcagatatttccttctaaaaataaaaactcccttggtaaatgctcaggcatctcaatggccacaccagccctcatatgtgtacccaactcccttcatttgcctctgttcccactgaaattttccatgtgaaatctgggaagggatgggacagcttgcataacttagttgatgactctcccacaatcttatagacttcactaatctttgaggctcttcactgactcatgtgacaaagtcacttaattctgtaaatttgggccagttcattttgctagctctcagtttgctcatctgtatgcaagaagtttagtgtaggtaaaccaaggacgccaatatgcctgtctctccagaaggtcaataacagaaaatctgagctggggggtgcagttccaagtcccaattccatgcctcaaagatcagctggttgtctttattcatcaccaggcacacatctccttgatactctcaatatctaggcataaaatgtgacaagacagattatctctgtgttatttttttctccattcctcatcacttgtatttccttaactcattgaaatcagttttccacattttttgaaggagagtcttttggcaaagatgtgaattatctacaagcagctgagagaaatggctactgccctcagtgtgctggttataagtttccaagtgatgaataaaagatttcctaaggcatcagtttccgtgatggtgtgttcttttttttctcttgggcacaagggaatgagcagagcaggtacacctctgggtttgttttgtttgtttttagcttatgtacaaaatcaagctctgtttttcattgaaatatctttttttcttgtatcagagaagagttgtaaaagactcattgtgggttcagggaagaatgttttaacatgcaaggaaatgttgcaaaattggaaagaggacataattccacaaaactaaatacaactgggggaatttttaggatactctgagttaatcttattatttgcatcctgctaaccccaatcaaataataatttagaattgtttaatttactaaactgcacattcaattgactaaactgtagaggatgagcaagtgtcaacaataattaccctccttatgggctaacacaacaggctccagtgagtcataatacacacattcagaggtggtccaatgcagtcccaccatagaaatccttcccatgcttagccactgttgtcattaatctctccaaactcaaaccatggttcaaacacagttgtcccttggtatccagaggattggttccaggacccactttggacacccaaatctgctgggaacaggccctaagcctgtcataaacaggccttaaagaaactggccataaacaggatttctgcagtaatgtgacgtgctcatgatggctatgacacacactgctagaagatattggtttattggagcagggcaaggaacacctggcctacccagagtggaaaactgctcaaaccacaaacaacagcatgagcggcctgttccataacaacatgtttttgctgcagatgatcatccagggactgtttctctgctcctcactaagaatgtttgtttcctgtaaagaatgcttttagctaatctataacctatagaaacaatgcttatcactggcttattgtcaataaatatgtgggtcaaactctgttcgtggctctcagctctgaaggctgttatccccctgattcccactttgcactttatttctgtgtgtttgtcttcattcctctagcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttggtaagtaagacggggagcttggaagcatcagggtaacaatgggacaagggtcgagcaggcatgagtcttatttgagtctgttttggcagctcctcagaaaagggggaaggaaggttagtactagccgacttatgcagctttgtagtgtggtagagaaatattgcccctggtttctggaccaaggaactatgaatatagagatctgggaaaaggtagccagagcactgaaaaaggcatatagggatggtgctgaggatattcctataaatatctggtcagtgtgggctctggttcatcccaccttggagcctttccacacagatcatgatgaggaggaatcagaggaagaaggagagtataatgaagtaacaaaagaggtgacagagcagttttgcttgccagctaaagcagcaaaggagggaggtttgtccctccccctctgtaccccctcatcattttgaagaaaaagagtggcctgaccctccgaatctttcttttctggaggacgctgggcgaaaagtagttgcctcagtgactgttcaagcagcacctcaagcgaccactctcagttctattcaggcatggatccagcaagctggatgagagggtgatatggatgcttggcagttccctgttagaatacacccacctgatcaacaggggaatattatagctatgtttgaggcttttccttttaaaatacttaaataatttaaacatgctattaatcaatatggaccaggttctccttttgtaatgggactgttaaggaatgttgctgtctctagtcagatgattcctactgactgggatgcttttactcgagctagtctgactctggctcagttcttacaatttaaaacttggtgggcagatgaagcttccattcagtctgctcgcaacaccaaggcccaacctcaaattaatataactgcagaccaacttttgggggtttgtggctgggcttgtttagatagatgcacaagtggccatgcaggatgatgccatagagcagcttagaggagtgtgcattagaggttgggaaaaaaatcacttcaggaggagaacaatacccttcttttagtgctgtcaagcaggggcctaaagaaccttatgcagattttatagccaggttacagaaatctcttaaaaaggtaattacagattcgcctgctaaggatatagtgttttggttattagctttcgacaatgccaatcctgagtgccaagctgctctgtgacctattagaggaaaagcacatttggttgactatattaaagcttgtgatggtatcgtaggtaatctgcataaagctactctgctggcccaggcaatggcaagaatgagagtgggcaaaggaaatactccatttcctggagtttgttgtgggaagcatggtcatactaagaaagaatgtagaaaaaaatcagtgagtcagactgccagttgggggaaaatagaaaactgctgagcctgaaatatgtcgaaaatgcaaaaaacgaaaacactgggctaatcagtgtcagtctaagtttgagacagatgggaacctgattttgggaaatgccatgaggtgcctgtcccaggccccattccaaaccagggaatttccagctcaggccactccctcaccccgtacaatgcctgtcccccgccacagccagtagtgccacagtagatttatgctgcacaaaagctgtgagccttctgcatggggaacccccacaaaaagtgccaacaggagtctgtggacccttgccagcagggacggtaggattacttctaggtagttctagtttaaatttaaaaggagtgcaagtacatacaggagtcattaattcaggttacaatggggaaatacaaattgttatatctacttctgttctctggaaagcagagccaggagagcatatagcacagctcctggttgtgctgtatgtggaagtggggaaaagtgaaactaaatgtacaggaggattttgaagcacaaataaataaaccaaagcagcttattgggtgaatcaaattactggtaaacatcctacctgtgaaataactattcagggcaaaaaatttaaaggattgttagatacacgatcagacatttcaatcatttctctacagcactggccgtctacatggccaattcaacccactcgatttaacacagttgaagttggtaaagcctctgaagtatatcaaagcagtgatattttgcatcatgaaggactcgatggacaatctgggactattcaaccaattgtaacttctgtacctgtaaatttatggggaagagatttattacagcaatggggagcacaaatgttaattccagaacaattatatagctctcagagtcagcatatgatgcaagagatggtgtatgtgcctggcatgggattaagaaaaaatttacaagggttaaagaaaccccttcaagtgaaaggacagaattctcatcagagttaggatatcatttttgatggaggccattgttaagcctccagaacctatgcctttaaaatggttaacagataagccagcttggttagaaaaatggcctctgagtaaagaaaaactggaggctttagaggacttagttactgaacaattagaaaaaggacacatagttccaacattttccccctggaattctccagtccttgttattaagaaaaaatcacataaatggagaatgttggcagatcttagagccgttaattcagttatacaacctactggggcattgcagcccaggttgccttctcctgctatgattccaaaaaattggcctttaatagtcatagatttaaaagactgtttcattactaactccttagctgagcaagactgtgaatggtttgcatttataattcctgcagtaaacaacacgcagcctgctaagcattttcactggaaagtgttgccacaaggcatgttaaacagtccaacaatttgtcagacttatgtaggacaagcaattgaacttactcataaaagatttgtcacagtgttaaattattcattatatggacaatattctttgtgctgcccccactcgggaaatattactccaatgttatgatcacttgcaaaacccgatttctcctgccagtttaattgtagctcctgacaaaattcagactactactccttacttctacttagggaccttagtaaatgacactaccattgtgccacagaaagtaaccatacgtaggcctcaattgaaaactttgagtgactttcaaaaattactaggggacattaattggacacgacctgctctaggcattcctatctatgccatgagtaatctattttctatccttacaggaaatcctagtctcactagccctcagcaattaacaacagagactgaggcagagatacagctgattgagaagcaagtgcataaggctcaaataaatagaatagatccagaaaagactttagacttattgatttttccaactcagcattcacctactggtggtgttgtccaagagcaggacttggtagaatggctttttcttccacatagtaattcatggactctaactccttatttagatcaaattgctactctgataggaaatgggagaactcaaattgttaaattgcatggatatgaccctggaaaaattattgtccctcttacaaaggcacaaatacaacaggcctttataaatactcttaattggcaaacccatttagctgatttcatgggtgttcttcataatcactttccgaaaacaaagttatttcaatttttgaaattaactaattggattctccctagaataactaaatttaaaccaattgaatgttctgaaaatgtttttacaggtaggtctagtaatggtaaagcttcttattccagatcaaaaaataaagttttccagacatcctatacttcagctcaaaaagcggagcttgtagctgtaattgaggtgctgactgcttttgagatgcctgtcaatgtaatttctgattctgcatacatggctcattccacacaattaattgaaatgctcagttatgatttcatacagatgaacaactgatgactttatttacccagttacaaactgcagttaggaatataatgcaccctttttacattactcatattagagcttatacaccccttccaggacctttaactacagggaatccagtggctaaccacttagttgccacggcattatctaatgctaaacactttcacactttgactcatgtaaatgcctctggtcttacacaaagatataatattacttggaaagaggctaaagccattattcaacaatgcccaacctgtcaaatgattcattctctgtcctttactgggggtgttaacccctgtggattgcaaccaaactgtctttgacaaatggatgtcactcatgttccttcttttagtaaattggcctatgtgcatgtatgtgtaggtaacaatttctcactttgtttggcctatctgtcaaatgggaatcttctgcctgtgttaaattgcatcttctgcaatgcttcacagtcatgggtattccagctttggttaaaatggacaatgccccaggatatactagtcaaactatggctacatttttctgtcaatggaatattaaacatatcactggcatcccgtataattcacaaggacaagccattgtgaaatgaatgaatatctccctaaaatgacaattgaataaacagaaagagggagacaatgactacgggactccacatatgcaattgaatctagcattattgtctttaaattttttgagcctgcctaaaggccagatgcaatcagcagctgaacagcatctacagaaaccggctgcagacagaagcagagcaactggtttggtggagagatccgataacagaaagttgggaaataggtaaaaataacatgggtagaggttatgcttgtgtttctccaggccaaaaccagcaactgatttggataccatcaagacacctgaaatcttgtcatgagccagatactgaggaagagattttgggaagaacccaaggaccccccagttgcagccatgtcaagactgacaataaggaagacatcagtcccagcaagcaacattcatcgggcacagccacccatgtggggccagatcaagaagttgacacagatggcggaagaaaatctgaagaaagcggatgaccagctacaatgagtaatctaatggtagctatgatggctgtgctcaccattgccatgagtattcccccagcacctgctgaaacaaaaaacattatacttattgggcatatattccttttccaccagtttcatggccagtgacatggttagaccccccagtggaggtatacactaatgatagcttttggatacctggttctacagatgatagaggcccatctcacccccaaaaggagggaacaattatgaatatttcgttgggatttgagcatttaactacttgcttgggaaaagccaacaggtgcttacctcccagtcatcaatcttggctggcaatagtgcctgaaggtaacatctctgtggcacaattacatatgctttctgaccttagtatttattacaatgattatgcccctgtaaccaaagtttaccgccctcaaaaacctatctgtatagtggattgaacatgttcagaaaaaaatgaagatatttacttgggaagattgtattgcagggcaagcaaaggtgttgtgtaatgattcatatggagtcactattgattggtcccctaaaggggcatttataaggctcacttctcaatctgtaggtaatggtcaccctgcatctaaagaaaatgatcagatggtagacactataaaaaatacaacaaaagttcctattatttggacatatggtgatatggtggaacctcgaccccaaatgatacgacctgctgtaggagctaaacataaggaattgtggaaaatattaatggcactgaaaaagataaaagatttgggaagggaaatatactaagccatcccaatataatcctaattacatgttagaattggctcacaatgattcagtctggatacatagttgtgtctgtcctccctttctgcttgtagtgagtgatttaaaacttgatctccctaatcatcatgtgactgtcaagaatgtagattgttttcttgtgtgaattcttccttgtataatactgatcattctatcttagtggtaagagcccgagaaggagtatggatacctgtaaagctttcccgtccttgagaagcctctccttctgtgcatattattactgaaattcttcaaaagattttgaggcactctcagggtttcattgctactttaatcattatgggattgattgctgtcacagctactgccacggtagctggagttgctttaccaacacagtacaaacagcagattatgtaaataattggcagaaaaattctactttgctgtggaattcccaaactaatatacaccagaaattaaccaatcagattaatgatctccgacaaactatcgtatggttgggagatcatgtagttagtttaaaatatagaatgcagttaacaatgtgattgaaatacttctgatttttgcattactcctcacctgtataatgaaacagagcatgagtgggaaagagttaagagacatttaaaggatcatactggaaatttatctttggatattgcaaaactgaaggaacacatatttcaagcctctcaggcacatctgacattaatgacaggaactaaagtgcttgaaggagctgcagatggattagcagctattcacccatacaagtggatcaagacacttggagactttgtgatttcaatgatgattgtgcctttaatctgtattgtttgtctttgtgtagtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctgtttgtggctctcagctctcaaggctgttttccccctgattcccactttgcactttatttctgtgtgtttgtcttcattcctctagcaccactgggttggggtctccttgaccaagctggtctcggcacatatgcatgtatgcccaggtcctgaaatcagccttgtggagcctgtgggtaggaaaagtcaaccctctgtgcatgtaggcctggaacctgaccaatactgtattttcctaccacgtttggtttcaaatgtggaaactgcccatacggacctactgcatttgtttttaaaaatcctctgtaagtggacctgcacagttcaggcccagattgttccaggatcaaccctacagtagaaatcaagtatctttttcattgtctcttgggatctgccttttcaccaataaaatatgagggctgttgggagcaggcccccccaaatctggccataaactgtccccaaaactggccataaacaaaatctctgcagcactataacatgttcataatggccataacgcccaagttggaaggttgtggatttacaggaatgagggcaaggaacacctggcctgcccagggtggaaaaccacttaaaggcattcttaagccacaaacaatagcatgagtgatctgtgccttaagaacatgctcctgctgcagttaactagcccaacatattcctttaattcagtccatcccttcgtttcccataagggatacttttagttaatttaatatctatagaaagaatgctaatgactggtttgctgttaataaatacgtgggtaaatctctgtttggggctctcaactctgaaggctgtgagacccctgatttcccacttgacacctctatatttctgtgtgtgtgtctttaattcctctagcactgctgggttagggtctccctgaccgagctggtctcagcaagtggagtccattgtgggggctcaaatccaggttgaagggtcaccggagcaacatttggaaaggaaaactagctgaaggacatgtgaatactcttaaagcaatctccttggtgagtaagaaggggcgctcggaagcgtcagggtaacaatgggacacgtttggggtctggtttgtttcaccttggaactttttcacacggatgatgaggaggaaggagagtttaatgaagtaacagaagagagtacagagcacatttatttaccagctaaagctaaagcagcaaaggagggagagattcatccttacccttctgcaccccctcatgattattttgaagaaaatgactttcaagatctttcttttccagaggacactgggcgaaaagtagttgccccagtgactgtttgagcagcacctcaagcgactgctcttagttctattcacgcaggaattcagcaagctagatgagagggtgatttagaggcttggcagttccctgttagaatacaccacccccagatcaacagggaaatattatagctacatttgagccttttccttttaaattactcaaagaatttaaacaagctataaatcagtatggaccaggttctccttttgtaatgggactgttaaagaatgttgctgtttccagttggatgattcctactgactgggatgctcttactcgagcttgtctaactcctgctcagttcttaaaatttaaaacttcgtgggcagatgaaactgccattcaggctgcttgcaatgcccaggcccaacctcaaattagtataactgcagaccaacttttgggggttggcaactgggctagtttagatgtccaaggggtcatgcaggatgatgccacagagcagcttaacagagtgtgcattaaagcttgggaaaaaaatcactataggtgtagaacaatacccttcctttagtgctataaaacagggaccaggagaactataccttgattttatagctcggttacaggagtcttcttaaaaagatgatgcagattcggctgctcagaatatagtgttgcagttattatatttcaacaatgctaatcccaattgccaggctgctctgcaacctgtcagagggaaagcacatttagttgattatatcaaggcctgtgatggtatcacaggtaatctgcataaagctactttgttggcacaggcaatggcaggactgagagtggacaaaggaaatactccatttcctggagcttgttttaactatgggaagcatggtcatactaaaaaagaatgtagaaaaaatcagcgagccaggctgccagataggggaaaaaagaaaactgctgagtctgaaatatgtccaaaatgtaaaaaaggaaaacattgggttaatcattgtcactcttaagtttgataaagtaggaaacccgattttgggaaataccatgaggggcccttcccgggccccattctaaaccggggcatttccagctcaggccattccctcacccctgtacaatgtctgtcacccaccaccgctggtagtgccgcagtagatttatattgcacaaaagctgtgagccttctgcctggggaacccccacaaaagatcccaacagaagtctgtagactcttgccagcggggacaataggattacttttaggaaagtctagtttaagtttaaaagaggcacaaggccaggcgcagtggctcacgcctgtaatcccagcactttgggaggccgaggcgggcggatcacaaggtcaggagatcgagaccatcctggctaacacagtgaaaccccgtctctactaaaaaatacaaaaaattaaccaggcgtcttggcgggtgcatgtggtcccagctacttgggaggctgaggcaggagaatggcatgaaccagggaggtggagcttgcagtgagctgagattgcgccactgcactccagcctgggtgacagaccgagactccgtctcaaaaaaaaaagggggggggcacaaatacatacaggagtcattgattcagattacaatggggaaatccacattgttatatctacttctgttcgctggaaagcagagctaggagagggcatagtacagctcctgattgtgctgtatgtggtaatgggaaaaagtgaaattaaatgaacaggaggatttggaagcacgaatgaacaaggcaaagcagcttattgggtaaatcaaattactgataaacgtcctacctgtgacataactattcagggaaagaaatttaaaggtttggcagatacaggagcggacatttcaatcatttctctacagcagtggccatccgtgtggccaattcaacccactaaatttaacatagttggaaacggtaaagcccctgaagtatatcagagtagttatattttgcattgtgaagggcctgatgaaaaacatgggactattcaacaaattataacttctgtacctataaatttatggggaaaagatttattacatcaatgaggagcacaagttctaattccagaacagttatatagacttcaaagtcaacatatgatgcatgaaatggcgtatgtccctggtatgggactagaaaaaaatttgcaaggtttgaaaagtttccaccaaagattaggatatcatttttgctggtggccattgttaagcctccagaacctatacctttaaaatggttaacagataagccaatttggatagaacaatggctgctaagtaaagagaaactggaggctttagagaaattagttactgaacaattagaaaatgggcacagagctccaacattttcccatgggaattcaccagggttttttgtttgtttgtttgtttgtttgtttcataattaagaaaaaatcaggtaaatggagaatgttaactgacttaagagccatcaattcagttatacaacctgtgggagcattacagacaggattgccgccttctgctataattccaaaaaattgccctttaatagtcatagatttaaaagactgtttctttactatccctttagctgagcaagactgtgaacggtttgcatttacaattcctgcagtaaacaacctgcagcctgctaagtgttatcattgcaaagtgttgccacagggcatgctaaacagtcccacaatttgcctgtggggcaagcaattgaacctactcgtaaaaaattttcacagtgttacgttattcactatatggatggtatactttgtgctgcccccactggagaaatattacttcaatgttatgatcacttgcaaaaatcgatttcttgcactggtttaattatagctcctgacaaaattcagactactacttcttaatcctacttggagaccttagtaaatgacactaccactgtgtcacagaaagtaaccattcatagggatcaactaaaaacattaaatgactttcaaaaattactaggggacattaattggatacgacctgctctaggcattcctacccatgccatgagtaacctgttttctatccttagaggaaatcctagtctcactagccctcggcaattaatgatggaggctgaggcagagttacaactgattgagaagcaagtccataaagctcaaataaattgaatagatccagagaagactctagatttgctaattttttcaactctgcattcacctactggtgttattgtctgagaacaggacttagtagagtggctttttcttccacatactaattcatggactctaactccttatttagatcaaatcactactatgatagggattgggagaactcagattgttaaattacatgaatatgatcctggaaaaattattgtccctctcatgaaggcacaaataaagcaagcttttataaatagtcttacttggcaaacccatttagctgactttgtgggtgttctcaataatcattttcctaaaatgaagctgtttcagtttttgaaattaactaattggattctccccaaaataactaaatttaaaccaattaaaagtgctgagaatgtttttacagaagggtctagtaatggtaaagcttcttattttggatcaaaatgtaaagtttttcagacgctctatacttcagctcaaaaagcagagcttgtagctgtaattgaggtattgactgcttttgatatgcctattaatgtgatttctgattcttcatacgtggttcattccacacagttaattgaaaatgctcagttacgatttcatacagaagaaaaactgatgactttatttacccaattgcaaacagcagttagaagtagaatgcaccgattttacatcactcacataagggctcatacacatcttccaggatctttgactgaagggaatcaaatggctgatcgcctagttgctactgcagtatctaatgctagacactttcacagtttaacccatgttaatgcctctggtctcaaacacagatacagcattacctggaaagaagctaaagctattatccagcgatgcccaacttgccaagtggtacattcctcatcttttacaggaggagttaatcctagaggactggaacctaactcttttggcaaatggatgtcacacatgttccctcgtttgggagactagcttatgtacatgtatgtgtggacaccttttctcactttgtctgggctacatgccaaacaggagagtcttctgcctgtgttaaatgtcacctttgcagtgttttgcagtgatgggcattccagcttccattaaaacagataatgccgcaggctatactagccaaactctagctacatttttctctatgtgggatattaaacacattactggcatcccatacaattctcaaggacaagccatagtggaaagaatgaatctctccctaaaacagcagtcgcaaaagcagaaagggggaaacagaaaatatggaaccctacagatgcaactgaacctaggattattaactttaaattttttgaagctgtccaaaggccagatgttatcagcagctgaatagcatctacagaaaccagctgcaaacacagaaacagaacaactgatttggtggagagatccaataacaaaaagttgggaaataggtaaaataataacttgaggtagaggttatgcttgtatttctccaggccaaaatcaacagctgatttggataccatcaagacacttgaaaccttatcatgagccagatcccaaggaagagattccaggaggatcccgaggaccccccccccccccgccattgcggccatgtcgaggctgatgctaaggaggatcccaactgtcatgagcaacacctgtcgagcacagccacccacctgggggcagatcaagaagctgtcacagatggtggaagaaaacctgaggaaagcaggacaaccagtaacaatgagtaatttagtggtagctgtgatagtgatgatcaccactgccatgagtattctttcaataagggctgacaaagagaacagttatacttactgggcatatttatcaatcttggctggcaatattgcctggatgcaatcactctgacacagttacacacgctttctgatctcaatatttaccataataaatctgctcctataaatgaggcataccaccttcaaaaacctatttgtaaacaaaatggaacctcaccagaaataatgaacatacttgttaaggaagatagcattgcagaacaggcagaggtgctgcacaatgattcctatggaatcattattgattggtctcctaagaggatgtttagcttgaattgcatctctgagtctgtgtgccactgccacagtatgctcagatgatagaaatgataagaagtatggcaaaagttcctattatctggaaccatggtgggatagtggcatctcaacctcaaatgatatggcccgctctagaagctaaacatagggatgtgtggaaactattaatagctcttaataagatcaaaacttgggaaaaaataaaaaagcatccagaaagacactctacaaacttgtctttggatattgcaaaattaaagacaaatatttaaagcatcccaggcacacctgaccttaatgacaggaactggagtgcttgaaggagttacagacaaattagcagctagtaacccattaaaatggataaaaacacttggaagtgctgtgatttcaatgatgattgtgcttttaatctgtgttgtttgtctttgtatagtcagcagatgtagatcctgactcctgctagaagtagctcaccgtgacaaagctgcccttgcttttatcaatttgcaactcagagaagggggacatgttgggagcaggccccccaaaatctggccataaactggccccaaaactggccacaaacaaaatctctgcagcattgtaacatgttcataatggcctttaggcccacactggaaggtggtgggtttacaggaatgagggcaaggaatacctggcccgctgagggcagaaaaccgcttaaaggcattcttaagccactgacagtagcatgagtgatctgtgccttaaggacatgctcctgctgcagttaactagcctaacatattcctttaatttggcccatcccttcatttcccataagggatacttttagttaatttaatatctatagaaacaatgctaatgactggtttactgttaataaatacatgggtaattctctgttcagggctctcagctctgaaggctgtgagacccctgatttcccacttggcacctctatatttctgtgtgcctgtctttaattcctctagtgctgctgggttagggtctccctgaccgagctggtcttggcaagggcttaatttatccctaagtccaatctagctgtttatttatatcctcataaactactaaaacacctgttgtgggttgtgcatggtggtcgtgcctgtaatcccagcactttggggggctgaggtggtgagttgagattgtgccactgcactccagcctgggcaacaagagtgaactctgtttcaaataaataaataaataaataaataaataaataaataaacacctgttgtgaagtcttagggaaatgtgcctggctctggcttctccctgcttgggttgttccaattatgccaagataagaggcagtgatttcaatgaaagaaaactatctcacagtctattttgtttctttctttctttttcttttttttttttttttttgagacggaatctcactctgtcacccaggctggagtgcaatggtatgatcttggctcactgcaacctctgcttccgaggttcaagcgattctcctgcctcagcctcccgagtagctgggattacaggtgcccgctaccacgcctggctaatttttgtacttttagtagagacgagttttcaccatagttggccaggctggtcttgagctcctgacttcaggtgatctccccaccgcagcctcccaaattgctgtggttacaggcgtgagccaccgctcgcccagctcagttttagtctccccttgagaaaaacagttttatagatatattctcactcagctgatcctttctcatttcttgaggaacatttctggtattagtttttaccacagtaaatctgctacagtgactgagcccccagccaatatgaactgtataggcacatccactgttttccactgtgcagtgtcccatgaaccaaagggtgaaaattgtgcctgagtgacgaatttgaaagcctaatctagtactccaaaagttttatactccattcatgtgatagaaaagatccctagtgagaatgtagagataatatgaaaaatgtagagataatgtgaaaaaaataataacaggtccattgttaaaaatttcccacacaaattttaaagtataaaatgcctggcaagaaaatgtttaaagggaaatgacacttgtggaattcaaatcactctcggagcacttacagcctctcttagtcggtacggtgagctagataccctaacaaacaatttgtttccttcctaaatttcaaatgatattagtgactgattttattataatagtcacaggcagtgtgagccagaattatttccataccttctgttaaaatttgtggcattccgatccttttttcccctggatctgcttttattgttgttctttttgttttggaaatggggagtgtgtgaaagtcaataaagctgttgaatttgtctcctgtacgtttagcatccaagccgctcaaaactgccccaggtgtgaaggagtgagaagggatttgcatttctgcctttctttttaactttccatgtatctgctgtcaaatcttcatatgctatttcccacacctcccatttggaaaattcctgtataaatccatcattttactaaatgcattgttttagaactgaactgacccagcactacatatgttgtagaatctggacaacttccagccaccttcttacctctgattcttgagtctggtattcagctggttggtgctgcatacaagacttggtttaaaccatggggggtgctttaaaccacacccatggcattgggttcactgctggaaacattaaagaatttaagattctactatgcgatttttgaattttttcaacttcatccaagcagacataggtaattgatgtgcagaaacatttcagaaattaggtcagcagacattcagttgtccagggttgccacccatgtgggctgtgctggatactcaagccatgtgtattcattaggtcctttggggcttgaccccttgttgagaagctggcacagcattagacaactataatgaaaaagaattaatgcatactatattgtgtcatgaatctgtgggtcacattattccaaaatatgtattttataattgtatttgactgtgagagaaattaatgtacccatggatgagtatatactgattaaaacaataagaaacagactataagtttattttttgattacgtgattttttaaaatgggaaagtcactggttacatcatataattttaaactttatatcacagaaggtagtaagaagttctagtatcatttgtttctcacagacgctgagttcttgctaaatacattatgatacaacttttaacaaaaacattactgcaaatacatagtaatgcaaatctcagttaaaaaataaatctctgaatactgtgatcaaaacactgacaatttcagagctgattctatagctcaaagaggtttgatgactagaaaacttaattgcaataaaagacacttccatatccctgttgacctctgtgtctcctctttcccctatctctgctcacaggcgccatatggaccatggttctcacggcagccctaaggcagtcacaggtagaggctccctctagggcactacaattcccatccttggagcgtgcggccagtcttgggcagctccagaccccagctgacctcacttactgttgccagggaaaggccctgtttgtggacttcttgctgcaaggggtggctcgcagtgcatgtgattcctcccatcaggcaaactggccatactctgcagatggtaaactgcatgtccagggagcataggccaagggtattcacatggagcttaagttgaagccctggccaagctcttagtgtctcccattcttgactggacaacagagcaatgaagggctccttcctgacagttcataaatgttccttcataccacagtgagattttgctactaacaccatgtcttcgttttctgaaaatgacctgtgtgtttcgtttcatagacttcacaatcaggagagaacagataattagggtgggttgggtcaggtgcagttctttccagagatgacactggggaccagatatgcctccttactcttcaaaatcaacctcatataaaacatcaatttcctgtctttagatgatctcaatatgtagtgtggagctgtttctccctggtcctactagtctcaacttggtttagcccttaaatatttattgaaatgattaccatatctttccagtgagtcccccaggccttccagattatccaaaagattaatcctcataaatacagaccatcaccttgaaataatggcttccatccaattctgtctggtttcagaagtgctggtgccttatcttttaggtcaagtgcagaccccctgccacaatttcaagacctcctacagcccatgcccaccctgtgtatcctagatccacagtgccggctgccagggggacctgggactcaaggaaggacacagcaacctttttaaagatgtggctaaaggaaattcctgattcagaaacaaaatgataaaagaaggaaacaacatcagggatgaagaaaaatagaaataataaaagcatggataaatatgataggctagccttcttgagtttttctaaactgtgtctgatgattgaagcaaaaatttctccacggtctgatatagttcttcatgcatgtaaattatgttgtaaattgagaaggagaaatgggcctatatggaggtgaagatcctgcacatcacatggcagaatgtggacaccagtgggctgcaacaagtgacgtgcataaaatgtcacacctgaagtaatgaagggtctagagaaacccatacattctaaaacagtatagataaaccaaactggaattaaaaaaaacattaccttgctgagagcagcagccggtgagaccctaacccagcagcactagaggaattagagacacacacacagaaatatagaggtgccaagtgggaaatcaggggtctcacagccttcagagctgagagtcctgaacaaatatttactcaggtatttattaacagcaagccagttattagcattgtttctatagatattaaattaactaaaagtatcccttatgggaaacgaagggatgggccacattaaaggaatatgttgggctagttaactgaaacaggagcatgtccttaaggtacagatcgctcatgctattgtttgtgacttaagaatgcctttaagtggttttctgccctgggtgggccagatgttccttgccctcattccagcaaacccaccaccttccagcgtgggcgttatggccattatgaacatgttacagtgctgcacagattttgtttatggtcagttttggggccagtttatggccagattttgggggggtggcctgttcccaacatgtctcccttctttgatttgcaaatcaataaaagcaaaggcagctgcgtcatggtgagctacttctcacaggagtcaggatctacatctgcagactatacaaagacaaatgacacagattaaaagcacaatcatcataaaaattacagagcttcccagtgtttttatccattttaatgggttaatagctgctaatctgtctgcagctcctttcagccctccagttcttggcattaaggccaggcgtgcctgggatgctttaaatatttgttcttttaattttgcaatatccaaaaacaagtttgtagagtgtccttttagatgcttttttattcttcccccaattttgatcttattaagagctattaatagtttccacaaatccttaatgtttagctcctacagcaggccatatcatttgaggttgaggtgccactatactgccatggttccatataataataactcttgctgtacttcttattatgtctaccatctgaccattttgttcagatcagctgaacatagtgtggccttggcacacagactgagaggtgcaatttatgctaaatatccccttaggggatcaatcaataatgattccataggaatcattgtgcagcacctctgtctgttctgcaatgcaatcttcctaaacaagtacattcattttttctggccaggttcaattttgtttacaaataggttttttagggcggtatacctcaattataggagcagatttattatggtaaatccagagatcagaaagcatgtgtaactgtgtcatagagtgattatatccaggcattattgccagccaagattgataaatatgcccaataagtatgattgttccctgtgtcagcccttactgaaggaatactcatggcagtggtgatcatcactatcatagctaccattaaattactcattgtgactggttgttccactttcctcaggttttcttttatcatcagtgacagcttcttgatctgtccccaggtgggtggcagagtttgactggtattgctcatgacagttgaagtcctcctcagcatcagtatcaacctggctgcaatggggggggtggtcctcgggatcctcctggaatctcttccttggcatctggcttatgataaggtttcaggtattttgatggtacctaaatcagctgttgaatttggcctggagaaacagaaggataacctctaccccaagttattattttacctgtttcccaactttttgttattgaatctctccaccaaatcagttgttctgctcctgtctttgcagctggtttctgtagatgctgttcagctcctgataacatctggcctttgggcaggctcaaaaaatttaaagttaataatgctagattcaattgtgtatggactgtcctgtaatccctatttctccctcttttttgtttttgtcatcagttgtttatctgtatgatatcataactgagcattttcaattaactctgtggaatgaaccatgtatgatgaatcagaaatcacattaataggcataacaaaagcagccaatatctcgattacagctacaagctttgctttttatagggcatctgaataactttacttttttgagccagaataagaagctttactattactagacccatctgtgaaacaatgaaaacacttagcaggctgcaggttgtttactgcaggaattatacatgcaaaccgcttacaggcttgctcagctaaagggatagtaaagaactgaactgatggctcttaagtcagttaacattctccatttacctgattttttcttaattacaaaaactggagaattccaaggggaaaattttggagctgtgtgcccattttctaattgttcagtaactcatttctccaaaacctccagtttctcttaacttagtggctactgttctatccaaattggcttatctgttaaccattttaagggtataggttctggaggcttaacaatggccaccagcaagaatgatatcctaatctttgatgggatctttgtctttccacttgaagcagttctttcaaatcttgcaaatttttttctagtcctatgccagggacataccccatttcatgcattgtatgttgactttgagggctatataattgttctggaattagaacttgtgctccccattgttctaataaatctctcccacatacatttataggtacagaagttataattggttgaatagtcccacgttgtccattgggcccttcacagtgcaaaatataactactttgatatacttcaggggctttaccaactccaactatgttaaatttagtgggttgaattggtcacgcggacagccagtgctgtagagaaatgattgaaatgtccactgctgtatctaccaaacctttaaatttctttccctgaatggttatttcacaggtaggacgtttatcagtgattttatttacacaataaactgctttgcgttgtttatttgtgcttccaaatcctcctgttcatttaatttcactttttctcattcccacatatagcacaatcaggagctgtgctatgtgctctcctggctctgctttccagggaacaaaagtagatataacaatgtgaatttccccattgtaatctgaatcaatgactcccgtatgtatttgtatcccttttaaacttagacctttctaaaagtaatcctattgtccctgctggcaagggtacacagaatcctgttgggaccttttgcgggggttccccaggcagaaggctcacagcttttgtgcagcataaatctactgcggcactaccagctgtggtgggtgacagacattgcacaggggtgagggaatggcctgagctggaaatgccccagtttagaatgaggcccaggatgggcccctcatggcatttcctcaaatcaggttcccatctttatcaaacttagagtgacactgattagcccaatgttttccttttttacattttggacatatttcagactagcagttttcttttttcccctatctggtggcctgatttgctgattatttctccattcttttttagtatgaatagcttgtttaaattctttgagtaatttaaaaagaaaaagctcaaatgtagctataatatttccctgttgaactagggagtgtattctaacagggaactgccaagcctctaaatcaccctctcgtctagcttgctgaatttctccctgaatagaactaaaagcggtcacttgaggcgctgctcagtcactggggcaactactttttacccagtgtcctccagaaaagaaagatctggagggtcattttcttcaaaataataatgagggggtgcagaatggtagggatgaacctctccctcctttgccgctttagctttagctggtaaataaacatgctttgtaacctcttctgttacttcgttatactctccttcctcctccacatcagtgtgaaaaagttccaaggtggaatgaaccagaccccacacttttcccattggtaccctgatgcttctgagctccccttcttactcaccacagggattgcttaattccacgttctccaaccatcgctccagcaatccttcaacctggattcgagcccccacgatggacaccacttgccaagaccagctcaattggggagaccctaacccagcagcactagagcaattaaagacacacacacagaaatatagaggtgtcaagtgggaaatcaggggtttctcagccttcagagctgagagccccgaacagagatttactcacatatttattaacagcaaaccagtcattagcattgtttctatagatgttaaattaactaaaagtatcccttatgggaaacaaagggatgggccaaattaaaggaataggttgggctagttaactacagcaggagcatgtccttaaggtacagatcactcatgctattgtttgtggcttaagactgcctttaagcagttttccaccctgggcgggccaggtgttccttgccctcattccggtaaacccacaaacttccagcgtgggcattatggccatcatgaacatgtcacagtgctgcagagattttgtttatggccagttttgtggccagtttatggccagattttggggggcctgttcccaacacccatcatataccagcagtgcacttagagaaatgcaccacctgaatgagctgtgtaacactaggaaagcacatctttagttggaacattactggtttcacttaaaaccaagtatcagacacattatatacacactttgttttctgtttttcatttctaatattcgtatattagcattaaagagagaaatacaatttgagtgcttgtcatcagtgaagaaagtgattggcgtaattgaaaagatgaaaagagcagacattctgagtgtcctcaatcgatcttattgatttttaaaggattctagggcttgaatgtctcaaactagtccaaaaaaagccaacagcaggacccatacaactataaatctcactagatacatcccctattccatgaacatgagaggagatgaacattatcagccttgcccaatttctcagcttacatttatttgggggtcaatccaataccgttatatgaattctttggaaattggaatatttgagcaaaaatgtttactttttgcacttgaaaatacaaaaagatatagacatagagtgcatctttattagagaataccgaaaatcccttcaagtccaagttttgaaatccccagttgactgtttggcagaatggctcattgtcaggtagaactcttttctagggcccaaactacattgcttagatacaatgcaaagagacatgggccaaccccacctttccagctcattcgttatcagcaaaaagcttcggcctgggctccagttatggttatagttggcttcacaggtgtgcgaactgtcatctgggtgatcacagggtgatgacagggctgctgcatgttgctctggaggtttttcactgcacagtgaactgcctgatcacagcagccttagacaaaactggataacatagttcttaatgttttcttcctcattgagcatcccctgatctgagaggctgtgaggcaagtttttacaagacaaagatattagctgagaggatcaagtagaacaaatgcattgttgctgaacaccaggggtttggcctaggtgtggttgctcactgcacagaaagccagtcactaagacgagtattgccagggaagaagagatttattgtggatgctgtcagtctaaccgtcaaatccgtctctctcccaactaaagttaggagtttatatagacaggaattaaggggagtaaggaatatgatcaacaggcagcaggtggttagatgagaggtctagcatctcattgtaaccacctgtgggaaaacaggaacgggagagaaggaagaggagtcaactggcaacagctctccttgtccagttgtggtgatctgtaaagtttcagttccatgaaactatgtgggagtcctaatgatcagtttattgagaaagaaactcagatgacaaatgttaaatttctcaacctttaagacttggaggtcaatcctatactttggatatttttgcctgcttaaatctgatgttgcattgtaattcccagggctggaggtaggtcctggtgggaggtgatcatggggatggaaccctcatatggcttagtgctgtcttcctgatactgaattctcccaagatctggtcatctaaaagaatctggcacattccccaactccctctctcttgctcctgctttgccttctgctatgactgaaagttgaggcttcaccagaagccgagtagatgccagcaccatgcttcctgcaaagcctgtagaacctgagccaattaaacttctttcctttataacctctttactttatattacccagtctcaggtatttctttacagcaatgcaagaatggtttgacagtcaatttctatgtttattcccctcacaaaaggcctccataaacatcaactgcataggaaaattgagctggtttcaagatcaaaaatttggcccatattaatagtggttgaaactttatgtttacaattattacttctgttcattttaccatctcctcttcctccatgcagcaggggcatgttgcaaatcacacactccaaaaaattaaacacaggacattccaaaaattagcattggtattgaaaacactcccccaaatcaggcttatttgccattcgtattttttctgtagtgaaattttcataccaatctttcaccaattttctttttgggatttttcttctattcttatccaaagctgttttacaagtacttttttcagtccataactcacctttccatttccttaattgtgtgctttaagaacacaagttttgaatttaacaaaatctaatttatcaaagtttaaagtgagtacatcgtttttattactttaagtgcattaaatttgtgtatattccatatttgtattgtccatagagaaatcatcacctaactgaaacctacaaaaattttctcagtttttcttctataagttttaactttgagctcttgtatttagatctatgatgagttgaggccttatatatgctttggggagtcaaagttaacaccacattttgaagatgtgtctttccccttggatttcattggcacatttgctgaaaatgtcccaagcacctcatggggtatggctgtggttctggactcatgtattcacaattgttttgaatattcacataaatttataatccactgtcaaattttaattcaggtggtgtttaattaatagaacaatttgaggaaaactgacatctcaaaaatagttttcttgcctattttggccctatttctgccatacacattttggaaaactttttccagtactaagaataaatattggaagctttattgaaattgtatcaaatttacagaaacatttaaagaaaacatattaataatggtcttcctaatcattgaaatttttactttatttttaatttttttgggtacatactaggtgtatacatctatggggtacatgatatattgatacaggtttgcaatgtctaataatcacatcagggtaaatgggatatccataacctcaagcatttatcctttgtgttacaaacaattcaattataccttaaaaatgtacaattattattgactgtagtaaccttgttgtgctatcaaatactaggtcttagtcattctacctttttgtgcccattaacattccccaattccccctcatcatgcccccactacctttcccagcctctggtaaacattcttctactctatctctagaagttcagttgttttcatctttagctccaataaataagtcagaacatgtgatgtctgtcttgctgtgcctggcttatttcacttaatgatctgtagttccatctataatgttgcaaatgacaggatctcattcttttttatggctgaatagtactccgttgtgtatacgtaccatattttatttatccattcatctgctgatggacacttggattgcttccaaatcttggctattgcgagtagtgctacagtaaacatggtgcagatttatcttcaatatactgatttcctttctttggggtatatacctaccagtggaattgctggattgtatggtaactctatttttagtttttgaggtacctacaaactgttctccatagtggttgtactaatatacacttccacagtgcacgagggttcccttttctccacatcctcttcagcatttgttgttacctgtcttttggacagaagatattttaactggggtgagatgatatctcattgtagttttgatttgcatttctctaatggatcaatgatgttgagtacattttcatatgcctgtttgccatttgtatgtcttctttcgagaaatgcctattcagatttttgtccagttttcagattaattttttttctatagaattgttatagttcctgatatagttatagttacagctcctgatatagctagtgatatagtttggatatttgtccctgcccaaatctcattttgagatgtaatcctcagcattaaaggtgggtcttggtggaaggtattttcgtcaagggggaggatccctcattaattgatgctgtcctttcatcaacgcccatatttctgccatatgcattttggaaaagtttttccagtgttaagaataaatattgggagttttattgaaatattaaatttatagaaactgctattattttaataatgagtcttcaaacattgaaattatttttaaatttttgtgggtacaaataggtgtatatgtttatgggggtacatgagatattttgatacagtcatgaaatgtatatgaacacatcagggtaaatggggtatccctgacctcaagcaaccctcacaagacctgagtactcacaagatctggttaagtgtgtggcacctccctccccctctctttgcccttgctcctgccatgtgagatacttattccccttttgccttccacaatggttggaagcttcctgacgcctccctacaagctgatcagatgttagcaccatgcttcctgtacagcctgcaaaactgtgagccaattaaacctcttctttataaattacccagtctcacgtatttctttatagtacttcaagaatggcctaatacagatggatagtttgcaaatattctttcccattctatgggttgtctcttcactttgttgtttcctttgcaatacagatttttaacttgatgtgatcccacttgtccatttttgctttggttgcctgtttgtcaggtattacacaaaaaatctttgcccactccaatgtcctggagagattccccaatgttttattttagctgtttcatagtttgaggtcttagatttaactttttaattaattttgatttttgtatatgttaagagataggggtctagtttcattcttctgcatacggatatccagctttcccagcaccagttattaaagacactatctttaccccaatgtatgttcttcataactttgtcaaaagtgagttcactgtagatgtatgaatttgtttctgggttgtctattctgttcctatgtgtctgtttttatgccagtatcatgctgttttggttactgtagctctgtagaataatttgaagtcaggtaatatgatccctccagtttgattccttttgctcaggataactctgactattctaggtcttttgtggtttccatataaattttaggattgtgttttctatttctttgaagaatgttaaagttttctggatattgcacagtttgtccattaacttgctgagcaacatcttttttttttcttttttcctgagacagggtctcactctgtcttccaggctggagtgcagtggcatgatcacagctcgatgcagtctcaatctcccaggctcaagtgatcctcccacctctctgcctcctgagtatctcggatgacaggtgcatgccaccacgcctggctaatttttatattttttgtagagacagttttgccatgttgcctgggctggtctcaaactcctgggctcaagcaacacacccacctcgacctcctaacatgctagaattacaaacatgagccactgagcccagccagagtattttctttctgttaggtacatgaaatgattcaggctcatcttctttttctcccaatctccgactaggaatcatccctggtccccttttttgtggatagtatttaggaaataataacttggcagttggtgtgtttactgttactgagctgtgactgcatttatgtcctctcggtagaatgaatcacaaaatatatgtatatgggcacacccaacaatttctctattgttcctatgtatttaaaagatatgagttctattctaatcccacactgcaggttttctagctctcctcattcctatttctacaaataccttctctaacagggagaaaccttgccatcatcattctcaacatatttgctcagtggtaccaatctcttaacaatgctgcccatctcctccccctgtcccttccacacctcaccctcagccctcttggtgccagcagacacatagccacaactcctctcatcccacaatgcaggtctaactcctccactctgggaagggaaggcaaaagagacacataaaaactcaaagaggggaatcaaaagaaagaggaagggaaggccacattgattttttaaaaaataataaatcatcttttgattgccctaataaacatctcttggtgatgatacagtttatggatatgactagactttttttttcaattttaggattttgcatctaaatctatgagactttggtctatagctttatgttttttgtttgtttgtttgttttattggttttggtatcaaggttgcactggcctgaaaaactgaattggaaaagttccaacttttttcttctagaagagtttataaaagcctggtatgctttatttattaaatatttggaataacttcagtggagccatctgtcctagagttttctttctaagcaagtttttgaatattccactcagatattgtttgcagttgtgacaaggtacaatgaatctctggtatgaccttgtttccagggcttttactgatggcatgttcatgaaaggaccaacccactggcacttcctaaggtctaatcatttctcctccatattgcaaaatgcaaaacaaaacaaaaatcctacttgttttcttctcaaattagcttttcagcctcctgccctatgcagcatgagatatctggaaatttcttgagaaattatgtgtttgaagcccctaatgtatccatttttttttaattgcagtcttgattgttctcctggtttctggtcccccccatgccttcccctgacccccagggtatggccctctgcctgaaccaagttcagtattcaggttcttccctatagccagaagtggaaagggtccccagagcaaagagctgcattctgtgcatgtgctttctgggatttaccactctctagaattttgctcctttagttctctttgcttctatagcaataagttgcatttaaatattttttgtaattttatagttgtcctcaatcagtccattctgctgccgactactataccttacccaatagcaaaatctattttttttttaaagtgtctgtcactcaggctggagtgcagtggcatgatctcagctcaatgaaacctccaactcccaggttcaagtgatcctcccacctcagcctctctagtagccgggactacagatgtgcgcaatcatgcctggctaatttttgtatttttagtagagacagggtttcatcatgttggccaggctggtctggaactcctgacctcaggtcttgcccacctcaacctcccaaagtactgggattacaggtgcaagccaccatgctcagcctatttgtgctttttcaaagccccatatttaagttatatctctatatacattttaaaaagttatatcacctatgaaaaatgtatttcactttggagagaaatagagttgggtacaataagtcactcacagcagaatgtcctggcttatgtgttggacatctgctagggcagaaaccaccagaaatctggacccactctcttctactaatcctcttaagctgcatacaaggcaagttgacttgcccccttgatccaccattctgagacgggtcacccaaaattagtctgccccaggattattcaaaaatcctgctggtgggctcctgtcctatggccccagattaagggtctctttcttcctggacatacaaaagcactcttgcttatggttccctttgctaaaaactcttcccttattttacatatggctaagcaatacatctttgacctagttatagtcattggctccagcgtggcatcttttcaagtgtcagaaaacagcagtcttgacaatgaactgaactggatataagcaaagtaaaatgctatttctcaataaaaacctttttttgcgtggtggctcacacctgtaatcccagcactttaggaggccgaggcgggcagatcacgacgtcaggagatcgagaccatggtgaaaccctgtctccactaaaaatacaaaaaattagtcaggtgtggtggcaggcgcctgtagtcccagctacttgggaggctgaggaaggagaatggtatgaacccaggaggcagagcttgcagtgagccgagatcatgccactgcattccagcctgggtggcagagcgagactctgtctcaaaaaaaaaaaaaaaaaaaaaaaagaaaaccttttctctacatgttcttaaattgctagatatcctgcaattcaacacctctggtctatattaaatttagattttaacctaaagtgtccacacattggatacagttaaaaatactttctcactatctgatgttcactaagaaggtacttcttattacatatactctataaaatataacctcatagtaaatgctttcctatagtttgtgcattttctgtggcctcttgacttcacacagaatgattttccacattcattacatccatagggtttctgtcttatatgagttctgtggtgaacaattagggcccacttctggtgaaaggttttcccacattcattacacccaaaaagtttctcccgtgtgtcttctcagatattctgtgaaactgtagtagtagcaaaaaaatgcatcccttctcaacttacggatgttgagccaggtttcaccctgtgtgaactctctgatgtttactgaggtgtggcattgagcaaaatgtttcctatattcattcaccaataagtgtttttcacttttagttcttaaacataatctatggcccaaatcccagaataatgttttcctgcattccatatcttcatattgttttttccctctttaagttctcttctctactgtgagaactgacttcagggcaaaggtgttctcattatcattatattaacagatttctctcaccctttatgttctctgctctacaaagttctgacttcacccagagtaatttccctcacttactacatttatagggtttcacctcaagtgtgttctgtgatgtacagttagttttgacttaataataattttccacaaacattacattcatagggtttctcccctgtgtatgttctatgatgtgcaatgagttttgacttcacacagaatgattttccacattcattacatccatagggtttctgtcttatatgagttctctggtgaacaattagggccaacttctgatggaaggttttcccacattcattacatccaaaaggtttctcccctgtgtgtcttctcagatgttctgtgaaactgtagtagcagcagaaaaattttccacattgaatacatgcataagatttcccatctgtgtgttcttagatgtttagtaagggttgacttctcggagaatgacttcccacattcattacattcataaggtttttctcctgtgtgaattctctgatgtttaatgaggtcggattttctgagaaaggtgttgccacatgcatagcattcatagggcttctcccctgtgtgttttctgatgcacagttagaactgacttaaacgaggttttcccacattcatgacattcatgatttctccccacgtgtgttctctgattttgagtaagggatgacttttcactgaaggatttctccattcatgacatctgtaaggtctctcccctgtgtgaattctttgatttctaatgaggtctgaattcttatagaaggtcttcccacatccgtgacattcatagggttttccctgtgtgtgttctctgatgtcttgtgtgggctgacttctgggtgaaggtttttccacattcatgacattcataaggtttttcccctggatgtgttctctgttgtaaatgaagggctaatttttcactgaaaaaggttccacattcattatattcaataatattgctaattgagtgggttctctgaattagagtgggatttaaattctggctgaatgggtaaacattctgatgttcaaagagaatggattcctcaaagatactttctccacattcattacattcatagtggttctctcttggatgtgtttgctgatgagtaataaaaaatgacatataacaggttttcccatgttcagtatatttgcatgttttctgtcctgtgtaagctctcttatgtacaaggaagagtgaattctcagggaaagctttcccacattcattgtattcaaaaggttgctcccaatttttaatcttctgatgccaaatgaggtcttcattcagccagaagctgttcccattgttattatattcagaaggttcctcttcaaaatgaattatttcatgctttcatcacagaaacattttccacctttgttaaactcattgaacttcattcttgaatagtttctactggtattaattaattctgaaatacagagtgacaagaaagattagttgacaaggatatgtaagagaactgaagttagcattatgtttgaaggctcagtttaagccattatctcctcacacctacattatgacaacaatgtgcacacttccagtcttatacctcttttcaactcaacacagcagcaacaaatcaaatttctaaaagttctaattcatagatagtcctataatccaggctccaattgtgtgtgttgttgttgtttttgagacagagtcttcctctgtcacccaggctggagtgtagtggcatgatctcagctctctgcaatctccgcttcctgggttcaagcgattctcatgcctcaacctcccaagtagctgggactacaggcatgcaccaccatgctcagctagtttttatgtttttagtagagacaggattttgcaatgttaaccaggctggtctcaaactcctggcctcaagcaattcacccacattggccttcaaaagggctaggattacagacatgagccactgcatctggcttaattgtttttctagctctgattcactaggaataaaagtatgcaacaataagagtgaaatcaatgagtgaacaagtcatcgttgccacaggatcaggcttatggttctattccggctatgggatttgccctttattccatcaactgtactatattatactgagtccaatgttccaagaacaaacactttttttttaacaaggtatcactgaagtagacatatctttacgtttagattcagattagaaccaagccattcttttacaagtctataatgaatgtaattcactctaggtaagttcatctgtttgtccctcataaattgctcattcccatcataattttatactgatttttttttcattgtcagcttacagtctaacaatgtttttaaaaagttgccttcccaaattttcccaccacttccagattcatttactaaaaaacatgaaaggaccatttgtataattcatttaagcacaaacatcagctggattgctataacaatattctttgttaaacactgaattttaaaatatttcatgcagttctgttttcgttcaccaactatgttcctggcagccattactttacctatgattttctctcagtgccctacatagatatttatatcatggtacctaataaataatgtttatcagaattacccagagagcattttcaaacacaaattttttcaggcttcacgctgaaatcattactgtttgaatgtttaattttaattttaaatgctttttatattttagagacagaatcttgctctgtcacccaggctgcagtgcaatggcacaaacacagctcactgcagcctcttcctgggttaaagcaagactctcagctcagctccccagtagctgagatcacaaaaatcagccaggcatgggaccgcatgtgtgtgccaccatgcctggctaattttttaagttttgatagagatagggtctccccgtgttgaccaagctggtctcaaattcctgggctcaagagattctcccacctcagcctcccaaattgctgggattacaggcatgaaccactgggcccaggctattttaaaataattctgtaaaaaaatgtgaatatggtagaatgctaacgaatgagcaactcaaaaaagcatgtatagaaaaatatatttaatattttatagaaggagggatgctcttgaatgggaagaccacacgagggagctttccaggggtgctgaaaaacactctatatattcatctcaatgatggatacatgagtgtctcatatatatatatacacacatatatatttaattttattaagctgtgacttaactatataatttatatcacaattaaaaaaaaagatgtgtgtatggaagtgatactgggagatgctgggtgattaagagccactggatatttgggtcatgtcaacatgttacttccaaaggtctagagcctctaaaatatgattcctgaagaacatttcaatggtcttattatctgaacttaccctttgtgatctgcctacctttaaattccatctggcactaactcacccagatgactctggcttcgaaatttttcctctaatatccatggctccttgcctgtctccaatttgaggatcacttctggtttaggaatgcaataccctgtgaatgatgcaataccctgtgaatgagaattatattacttctgacaaactgggtgggtttccctgaaggaggaagacagtataccccaaacagtacacacacacacacacacacacacacacctcatttaatcctgtcgtggggcagaggaaaatattctttctggtatccaaaagggatacattgtctctgacctctaaatttcaaagctaaatgttatattttacaaaatttccacaagtttctatcgataagaaaggacatgcattctggccttctacatgggaaacaattcctacctacctactgagacaaggtggctgtagttctccagcatcacattcctctacagggtcctctgagcagggtccagatgatgccactcctcttgagtgaagcccatagtcacatccctaaatgacactgatccctggaaaatcacagttctgctcagtctgatgcaataagaatcagctgatgtgagacaagatgtttagggactaattcttacaatttttgttgttgaaaattaaatagaaaatgttataaagggcctccatgatatatgttgttttatgttacacattgtgggtaaaagatcatagcagaaatatcctgttggtgaattaattacttaatgcaaaagtatttagtacctacatgtgcctagagctttcttagtttctgagtattccaatttgaatacaagagtcttccttacaagagaggaacataccttctcataaggaaacatacatacagagacatatctaccacaggacttaaaggactcacaccacagatatgtgcaacacagatggatcataaaagtgttctgggcaaattcatgtgagagtgtgtcaacatattagacttcactgaagtgataaaactttagttcctttgcaaacatataacaaaaacttaagaaaacgttaaaaacctgaaaaaatatgtggcaagtcaatggaattgcttaacaggataacagcatgtcttacctgtgatgagataaaggttgcagaggcatgggagatgagggagactaggaaatacttttggctttaatcctgttagtgttctccaaatatttatcactcttctaatccataaaaatgtttagcaactactagtttagtttatatttataaagtaaataaaatacaatctacatataaggaaagcttaattttgttttcattttttagataaaaatataaataggcatgctgatagtttcctcccatgccctaaaggactggcagtatatgacataaacacaataatcttgcacacttcctttaggccataggctccctgctctcccaactccaagtcattgatgcaaatagcagaagttgatggtgaactgaaaatacacacctgaatccctgtaacataattcagttttcactcaggaagcaatgccaccaaagtacagtggagactgtgctggagagcagcgttagaggtagattgtctatattacggggcagcagtggagatgtggaagagggaattcactaagcaaaggaagagaagaagggctacttccagagggcctgtataggggccttagaaggtctggaaattagaaccaggaggttgggtgttgggggaggtgagagtacagagtgacaataagacacatgcaggccatgcagctcttggaatgtcttcatgtcatggaagtgagcatgtccagtggaaggttacagagatgattctgaagcttgggagagacctaaggtctggagttcaagaccagcctggccaacatggtgaaaccccgtctctactaaaaatacaaaaaatagccatgcatggcagtggatgcctgtaatcccagctactcaggaggctgaggcaggagaacctcttgaatccgggaggtggaggttgcagtgagccaagatcgtaccactgaactccagcctgggtaacagggtgagactccatctcaaaaatatatatatgtcagagaagaaaaaaacagcgttccaaaatcaatgttaatatttgcctaactgtgaaaacaaaaaaaatactctgtgaacactactagaaaataaaataggccaggtgtggtggctcacacctgtaatcccagccctttggtaggccaaggcgggaggctcacgaggttaggagttcaagaccagcctggtcaacatggtgaaaccccttctttactaaaaatacaaaaattagccaggcgtgctggcaggtacctgtaatcccagctactcaggaggctaagacaggagaatcacttgaaaatccaggaggcagatgttgcagtgagccaagatcgcaccactgtactccagcctgggcaaaaagagtgaaactctgtcaaaaaaaaaagaaaaaagaaaaagaaaaagaaagaaagaaagaatacaaaatggatgtaaaatgcagaattgtacaaatctaaatgtataaaattgcacaaattatcataaaataaaaacttgaagaagagttaataatagtttgtaaaatataaataaatctaggagataaattccattctacaatgaattctagaagaaaaaaaagctaaagagagacttttgggggggggaatgagggcaatcaagagcactgtgtacgttatagcccatttatgcctgaggttacaattttattaatttttgcaatcagaccttgaaatgaccttaagcagtaagatataaataacccccacaggcttagcgttccaataatggaacactaggtataaatgggttagggaattcagaatggcaagcacaaacccaggacaggagaagcttggcaaagacctgaaaagaccctaaggttttacttctggctaatctctatgctcggttcaagcaagtagtgaagactaagatgaagttctttttattattattattattattattattatactttaagtttagggaacatgtgcacaatgtgcagattagttacatatgtatacatgtgccatgctggtgcactgcacccactaactcatcatctagcattaggtatatctcccaatgctatccctcaaccctccccccaacccacaacaggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcattattttttatggctgcatagtattccatggtgtatatgggccacattttcttaatgcagtctatcattgttggacatttgggttggttccaagtctttgctattgtgaataatgccgcaataaacatacgtgtgcatgtgtctttatagcagcatgatttataatccttttggtatatacccagtaatgggatggctgggtcaaatggtatttctagttgtagatccctgaggaattgccacactgacttccacaatggttgaactagtttacagtcccaccaacaatataaaagtgttcctatttctccacatcctctccagcacctgtcgtttcctgactttttaatgattgccattctaactggtgtgagatggtaactcactgtggttttgatttgcatttctctgatggccactgatggtgagcattttttcatgtgttttttggctgcataaatgtcttcttttgagaagtgtctgttcatgtccttcacccacattttgatagggttgtttgttttttttcttgtaaatttgtttgagttcattgtagaatctggatattaaccctttgtcagataactaggttgcgaaaattttctcccattttgcaggttgcctgttcactctgatggtagtttcttttgctgtgcagaaactctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagcttactacatacggctagccagttttcccagcaccatttattaaatagggaatcctttccccattgcttatttttctcaggtttttcaaagatcagatagttgtagatatgcagcgatattcctgagagctctgttctgttccgttgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagtttttccaattctgtgaagaaagtcattggtagcttgatggggatggcattgaatctgtaaattaccttgggcagtatggccattttcatgatattgattcttcctacccatgagcatggaatgttcttccatttgtttgtatcctgttttatttcactgagcagtggtttgtagttctccttgaagaggtccttcacatcccttgtaagttggattcctaggtattttgttctctttgaagcaattgtgaatgggagttcactcatgatttggctctctgtttgtctgttgttgatgtataagaatgcttgtgatttttgtacattgattttgtatcctgagactttgctgaagttgcttatcagcttaagattttgggctgcgacgatcgggttttctggatatacaatcatgtcatctgcaaacagggacaatttgacttcctcttttcctaattgaatacactttatttccttctcctgcctaattgccctggccagaacttccaacactatgttgaataggagtggtgagagagggcatccttgtcttgtgctgattttcaaagggaatgcttccagtttttgcccattcagtatgatattggctgtgggtttgtcatagatagctcttattattttgagatatgttccatcaatacctaatttattgagagtttttagcatgaagcattgttgaatttcgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaagtgagttagggaggattccctctttttctattgattggaatagtttcagaaggaatggtaacagttcttccttgtacccctggtagaattcagctgtgagtccacctggtcctggactctttttggttggtaaggtattaattattgccgcaatttcagctcgttattggcctattcagagattcaacttcttcctggtttagtcttgggagggtgtatgtgtagaggaatttatccatttcttctagattttctagtttatttgcgtagaggtgtttgtagtattctctgatggtagtttgtatttctgtgggattggtggtgatatcccctttatcattttttattgcatctatttgattcttctctctttttttctttattagtcttgctagcggtctatcaattttgttgatcctttcaaaaaaccagttcctggattcattaattttttgaagggttttttgtgtctctatttccttcagttctgctctgattttagttatttcttgccttctgctagcttttgaatgtgtttgctcttgctttcctagttcttttaattgtgatgttagggtgtcaattttggatctttcctgctttctcttgtgggcatgtagtgctataaatttccctctacacactgctttgaatgcatcccagagattctggtatgttgtgtctttgttctcattggtttcaaagaacatctttctttctgccttcattttgttatgtacccagtaatcattcaggggcaggttgttcagtttccatgtagttgagcggttttgagtgggattcttaaccctgagttctagtttgattgcactgtggtctgagagatagtctgttataatttctgttcttttacgcttgctgaggagagctttacttccaagtatgtggtcaattttggaataggtgtggtgtggtgctgaaaaaaatgtatattctgttgatttggggtggagagttctgtagatgtgtattaggtccacttggtgcagagctgagttcaattcctgggtatccttgttgactttctgtctcgttgatctgtctaatgttgacagtggggtgttaaagtctcccattattaatgtttgggagtctaagtctctttgtaggtcaatcaggacttgctttatgaatctgggtgctcctgtattgggtgcatatatatttaggatagttagctcttcttgttgaattgatccctttaccattatgtaatggccttctttgtctcttttgatctttgttggtttaaagtctgtttgatccgagactaggattgcaacccgtctttttttgcttttcatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcttagtctcaatggtctttacattttggcatgattttgcagtggctggtaccggttgttcctttccatgtttagcacttccttcaggagctcttttagggcaggcctggtggtgacaaaatctctgagcatttgcttgtctgtaaagtattttatttctccttcacttatgaagtttagtttggctggatatgaaattctgggttgaaaattattttctttaagaatgttgaatattggcccccactctcttctagcttgtagggtttctgccgagagatccgctgttagtctgatgggcttccctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccagtcagacgtagatttggtcttttcacatagtcccatatttcttggaggctttgctcatttctttttattcttttttctctaaacttcccttctcgcttcatttcattcatttcatcttccattgctgatacgctttcttccagttgatcgcatcggctcctgaggcttctgcattcttcacgtagttctccaggcttggtttccagctccatcagctcctttaagcacttctctgtattggttattctagttatacattcttcttaattttttaaaagttttcaacttctttgcctttggtttgaatgtcctcccatagcttggagtaatttgatcgtgtgaagccttcttctctcagctcgtcaaagtcattctccgtccagctttgttccattgctggtgaggaactgcattcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagtttttcttctaacagacaggaccctcatctgcaggtctgttggagtacctggccgtgtgaggtgtcagtctgcccctgctggggggtgcctcccagttaggctgctcaggggtcagggacccacttgaggaggcagtctgcccgttctcagatctccagctgcatgctgggagaaccactgctctcttcaaagctgtcagacagggacatttaagtctgcagatgttactgctgtctttttgtctgtgccctgccccagaggtgaagcctacagaggcaggcaggcctccttgagctgtggtgggctccacccagttagagcttcccagctgctttgtttacctaagcaagcctgggaaatggtgggcacccctcccccagcctcgctgccaccttgcagtttgatctcagaccgctgtgctagcaatcagtgagactccgtgggcataggaccctccgagccaggcgtgggatacagtctcctggtgctcagtgttttaagcccgtcggaaaagcgcagtattcggttgggagtgacccgattttccaggtgccatctgccacccctttctttgactaggaaagggaactccctgaccccttgtgcttcccaagtgaggcaatgcctcgccctgcttcggctcacgcacggtgtatgcacccactgacctgagcccactgtctggcactccctagtgagatgaacccggtacctcagatggaaatgcagaaatcacccatcttctgccttgctcacactgggagctgtagaccggagctgttcctattcagccatcttggctcctcccctcagtccagttgactaagatgaagttctaaatggaccaggctaagtgcttaaaaagtgccccaggacagagccaatttgcaaataataagaaaggggttttgttgtatttttgttttagttttttgttttttctttttcttttcctttttcttttttgtttggtggtggttgtttgaaacctggccttccaggaaaaatgcctgttaaaacactacctaaacacaagctaaagagagagaattcagtgaccacacataagactgcaaaaaaaagtttgaaaaattcataaaaacaaatggatactgaagacttcagtaattaagaacagcaaagtctagagaagaatgagaaagtgatttctaaagttactaaattataatattaaaatacccagtttcaacaggaacaagaaaatcacaaagcatacaaagaaactggaagtgttgtccaatcaaaggaaaaatagaaattgacagatatatcccagaggcaaaccaaacataacacttcttaaacaaagactttaaatcaactgtcttaaatatgctcaaaagctaaaagaaaacatacgagcaccagagagaaccatgaaacaacttataaaccaaatatcaataaagagattgaaattataaaaaagcaccaaatagacattctaaaactaaaaagtaccataattgaaataatgaattcaccagaggagttcaacagcagatttgggaatgccaaaaataatctgtgaatttaagtataagactattgaaattatcaagtttgagaatcagagcaaaaaagaattaagaaaaataaatggaacccaaaggacctatgggacaccatcaagctgaccagcaaaaacattatgggaaatgtagaagaatacaagagagacaaggaaatagagtatttgccgaaaagccaaaattaaactccctaaatttggtgaaagacacaaatctacacatccaggaagcacaataaactcaaaataaactcaaatacatccaccaagtcatgttataagcaaacagtcagaaaaaaaaaatgacagagaatcaaatgcaaaggagaagcaatttgtcatatacaaaagaacctcaaaaagatcatcagcagaaaccttggaggttagaaggcactggattgatatattcaaagtgctgaaagaaaaagctgtcagctgagaattctatgcatgggaaacatgcctgtcaataatgaggacattcccagatgaacacaagctaagggagtatgtttttactagatctactctgcaaggaatgctaaagggaatcctttgggttgaaatgtgattcacaacaaacaagggaactgttaaaagattataagccaagttttcatctggatttggtcttaaaagagaaattaggattaaataaataagaaaaatggcagagattggcagagtggacaaatttcttcaaataatgcatacaaaaatgtaattagaatgaataagatcgagtatttgatagtacaacagggtgactatagtcaacaattttttttattatactttaagttctggggtacacttgcagaacatgcaggtttgttacataggtatacatgtgccatggtggtttgctgcacccatcaacccatcatctacataaggtatttctgctaatgttatctctcccctaccccaccaccctccaacaggccctggtgtgagatgttcccttccctgtgtccatgtgttctcactgtcccacttatgagtgagaacatgcaatgtttggttttctgttcttgtgttagtttgctgagaatgatggtttccaccatcatccatgtcccagcaaaggacatgaactcatccttttttatggctgcatagtattccatggtgtatatgtaccacattttccttatccagtctatcattgatgggcatttaggttcattccaagtctttgctattgtgaatagtgccacaaaaaacatacatatgcaagtgtccttatagtagaatgatttataatcctttgggtatattcctagtaatgggattgctgggtcaaatggtatttctggttctagattcttgaggaatcaccacactgtcttccacaatggttgaaccaatttacactcccgccaacagtataaaatcgttcttatttctccacatcctctccagcatctgttgtttcctgactttttaatgctcgccattctaaatggtgggaggtggtatctcattgtggttttgatttgcatttctctaatgaccagcgatgatgagctttttttcgtatgtttgttggccacataaatgtcttcttttgagaagcgtctgttcatatccttcacccactttttgatggggttgtttttttcttgtaaatttgtttaagttctttgtagattctggatattaaacctatgtcagatggatagattgcaaaaattttatctcattctgtaggttacctgttcactctgatgatagtttcttttgctgtgcagaagctctttagtttaattagatcccatttgtcaattttggctcttgttgccattgcttttggtgttttagtcatgaagtctttgcccacgcctatgtcctcaatggtattgtctaggttttcttctagggtttttatggttttaggtcttacatttaagtctttaatccatcttgaattaatttttgtatacggtgtaaggagagggtccagtttcagttttctgcatatggctagccagttttcccaacaccatttattaaatagggaatcaatttcccattgcttgtttttgtcaggtctgccaaagatcagatggttgtagacgtgtggtgttatttctgaggcctctgttctattccattgatctatatatctgttttggtaccagtactatgctgttttggttactgtagcattgtagtatagtttgaagtcaggtagtgtgatgcctccagctttgttctttttgcttagaattgtcttggctatctgggctcttttttggttccatatgaaatttaaagtagttttttctaattctgtgaaggatgttaatggtaacttgatggggatagcattgaatctataaattactttgcagtatgcccattttcatgatactgattcttcctatccataagcatggaatgtttttccatttgtgtgtgtcctctcttatttccttgagcagtgttttgtagttctccttgaagaggtccttcacatcctgtgtaagctgtatttcaaggtatttaattttgtttgtagaaattgtgaatgggagttcactcatgatttggctctctgtttgtctattattggtgtataggaatggttgtgatttttgcacaatgattttgtatcctgagacttttctgaagttgcttatcagctttaggagattttgggctgatacgatggagttttctatatatacaatcatgtcatctgcaaacagagacaatttgacttcctcttttcctatctgaacaccctttatttctttctgttgcctgaatgccctggccagaacttccaatatcatgttgaataggagtggtaagagagggcatccttgtcttgtgctgattttcaaagggaatgcttccagtttttgcccattcagtatattggctgtgagtttgtcataaatagctcttattattttgagatacattccatcaatacctagtttttttgagagtttttagcatgaagcggtgtttaattttgtcaaaggccttttctgcacctattgagatattcatgtggtttttttcattggttctgtgtatgtgatggattatgtttattgatttgcctatattgaaccagccttgcatcccagggatgaagccaacttgattgtggtggataagctttttgatgtgctgctggatttggtttgacagtattttattgaggatttttgcatagatgttcttcagggatattggcctgaaattttctttttttgttgtgtccctgcaaggttttggtatcaggacgatgctggcctcataaaatgtgttagagaggattccctctttttctattacttggaatagtttcagagggaatggtatcagctcctctttgtacctctggtagtatctggctgtgaatccgtctggtcctagaccttttttggttggtaggctattactgcctcaatttcagaatttgttattggtctattcagggatttgacttcttcctgctttagacttgggagggtgtatgtgtccaagaatctatccatttcttctagattttctagtttatttgcatagaggtgtttatagtattatctgatggtagtttgtatttctgtgggatcagtagtgatagcccctttatcattttttattgcatctatttgattcttctctcttttcttctttattcttctggctattctattttgttgatcttttcaaaaaaccagctcctggattcattgattttttgaagggtttttcgtatctctatctccatcagttctgctctgatcttagttatttcctgtcttctgctagctttcgaatttgtttgctcttgcttctctagttcttttaattatgatgttagggtgtctattttacgtctttcctgctttctgttgtgggcatttagtgctaaaaatttccctctagacgctactttaaatgtgtcccagagattctggtacgttgtgtctttgttctcattggtttcaaataacttctttatttctgccttaatttcattatttacccagcagtcattcaggagcaggtagttcagttttcatgtaattgtgcagttttgagtgagattcttaatcctgatttctaatttgattgcactgtgttctgagagactgttaagatttccattcttttgcatttgctgaggagtgttttacttccaattatgtggtcaattttagaataaatatgttgtggtgctgagaataatatatattctgttgatttgggtgggagagttctgtagatgtgtcttaggtctgcttggtccagagctgagttaacattctgaatatccttgttaattttctgtcttgttgaactgtctaatattgagactgggctgttaaagtctcccactattattgtgtgggagtctaagtgtctttgtaggtctctaagaacttgctttatgaatctgggtgctcctgtattgagtgcatatatatttaggatagttagctcttcttgttgcattgatccctttaccattatgtaatgcccttctttgtctcttttgatcttcattgttttaaagcctgttttatcagagactaagattgtaacctctgttttttttgctttccatttgcttggtaaatattcctccatccctttattttgatgtgtgtctttgcacatgagatgggtctcctgaatacagcacactgatgggtgttgactctttatccaatttgccagtctgtgtcttttaattggggcatttagcccatttacatttaaggttaatattgttatatgtgaatttgatcctgtcattatgatgctagctggttattttgcccattagtagatgcaggtttttcatagtgtcaatggtctttacaatttggtatgttgttgcagtggctggtactggttgttccttttcacggttagtgcttccttcaggaactcttgtaaggcaggcctggtggtgacaaaatctctcagaatttgcttgtctgtaaaggattttatttctccttcgcttatgaagcttagtttggctggatatgaaattctgggttgaaaattcttttaagaatgttgaatattggcacccactcttttctggcttgtagggtttctgcagggagatctgctgttagtctgatgggcttccctttgtgggtgacctgacctttctctcttgctgcccttaaaattttttccttcatttcaaccttgctgaatctgatgattatgtgtcttggggttgctctcttcaaggagtatctttgtggtattctctgtatttcctgaatttgaatgttgacctctcttgctaggttgggaaagttctcctggataatatcctgaagggtgttttccaacttggttcaattctccccgtcactttcaggtacaccaatcaaacatagatttggtcttttcacatagttccatatttcttggaagctttgttcattcctttttgttcttttttctgtaatcttgtcttctcactttatttcattaatctgatcttcaatctcttatatcctttcttctgcttgattgagtcagctattgatacttgtgtatgcttcatgaagttctcgtgctgtgtttttcagctccatcaggtgatttatgttcttctctaaactggttattctagttagcaatacgtctaatcttttttcaatgttcttagcttccttgcattgggatagaacatgctcctttagcgtggagtagttagttattacctaccttctgaagcctacttctgtcaatttgtcaaactcattctccatccagttttcttcccttgctggcaaggagttgtgatcctttggaggagaataggcattctggtttttggaattttctgccttttgcactggtttctccccatcttcatggatttccttacctttggtgtttgatgttggtgaccttcagatggggtctctgagtggatgtcctttttgttgatgttgatgttattcctttctgtttgttagttttccttctaacagtcaggcccctctgctgcaagtctgctggagtttgctggagttccactccagaccctctttgcctgggtatcaccagcagaggctgccaaacagcaaagattgctgcctgttccttcctctggaagctttgtcccagagggtcacctgccagaggccagctggagctctcctgtatgaggtgtctgttggcccctactggaaggtgtctcccagtcaggagacatgggggtcagtgacccatttgaggaggcagtctgacctttagcagagcttgaacgctgtgctgggagatctgctgctctcttcagagccatcaggaagcaacctttaagtctgctgaaactgtgcccacagccgccccttcccccaggtgctctatcccagggagatggggcttttatctataagcccctgactggggatgctgccttttttgtcagagatgccctgcccagagaggaggaatctagagaggcagtctcagccttgctgagctgtggtgtgttccacccagttcaatcttccaggcagctttgtttacactgtgagggtaaaactgcctactcaagcctcagccatggcagatggccctcctcccaccaggttcgagtatcccaggttgagctcagactgctgggctggcagtgagaatttcaagccagtggatcttagcttgctgggctccgtgggggtaggacctgccgagccaggccactggctcctggcttcagccccctttccaggggagtgaatggttctgtctcactggtgttccaggcaccactggggtatgaaaaaaaagctcctgcagctagcttggtgtctgcccaaacggctgcccagttttgtgcttgaaacccaggccctggtggcataggcaccagagagaatctcctggtctgcaggttgtgaagagtgtgtgaaaagtgcagtatctgggccagagtgcaccattcctcatggctcagtccctaatggcttcccttggctaggagagggagttcccagacccattgcacttcctgggtgagacgacgccccatcctgcttcggctcaccctccatgggctgcactgactgtcccactggtcccagtgagatgacccaagtacctcagttgaaaatgcagaaatcacccgcattctgcgtcaatctctctgggagctgcagaccagagctgttcctatttggccatcttgacacaaatccccaaaataatttattgtacattttaaaataagagtataatttgattgtaacacaaagaaaggataagtgctgtagttgatggataccccactcactctgatgtgattttacacattgtaggcctatatcaaaatatctcatgtatataaatcacataaatatatatactcactatgtatccataaaaattataaacagaaaataaggggaacaaaagaaaaagatctaaccataagctgtctccaagaaactcatagtagatccaaagccagtaagctgaatgcgaaagggtgaagaaagatatttatgcaaataataaccaaaagagtgctgggtagctacactaatactagaaaaacaaaaaacaacaacaaaaaaaaacagactttaagtaaaaaactgttataagagacaaagaaggacattatacaactggaaaagtgttaataaaaaaaatcaattgcaaacatacgtagatcaaagaaaatagaaccaaacatataaagcaaacactgacagatttaaatgaagaaatgcagagttcggtaataatagttggacacttcattgctctgctttcattaatggatagaatatccagacagaagatcagtaagaaaacagagtatttgaataatggtataaaccaagtaggcctaagagaagtatgtggaatactctacctaccaatagcaaaatatgcattattctcaagtgcacaagaaacattgtacagggaagcccacagattagggcacaaaataaatctcagtaaatttaaaaagactgaaataataaaaatatatatatattttctgaccataataggataaagctagaaatcagtaatagaaaaaaatttttaacgtggatattaaagtttaatgatcaaataagaaagcacaaaggaaatttaaaaatacttagaaacaggtgaaaaagtaaagagactgtatcacaacttatgggatgcagccaagaatatgcctataaggagatttatagcaataaatgcctattttcaaaaagaaagaaatcaataactttacactttcagcaactagcaaagaaggatcaaactaaacccaaagctagcagaaggaaggatataatacatattacagcaaagataagtgaacagaaaatagaaaactacagagaaccaaaaaatccaaaagctgattccttaaatagaacaaaattcataagcttttagctagattgactaaagaaaaaaaattcaaaggactaaaatcagcaatgaaagtgacattacaaaaaaaaatgggttataagagaatactatgaacaactgtacactaataaattaagtaactcaatgaaatagacacatttcctagaagcacacacattactaaaactgactcaagaagaaacagaaaatctcaacatacttataacaagtaaagagatgtatcagtaattttttaaaaaactgcccaagggaaaaaaatccagcgtaagatggcttcactggtcaattctatcaaattaaagaagtaatactaatcttcctcaaacatttccaaaaattagaagggaatacttcctaactaattcccatgagttttataatgctggccagcattatcttgataccaaagccaaaaaaagacttcacaggaaaataaaattacaggctaatatcccttatgaatacagatgtaaaaaattataaaatactagcaaacaaaatttggcagcatattaaaaacattacatactatgaccaagttggatctatcccaggaatgcaagagtggttcaatataagaaaattaatcagtgtaagacaccacattaataaaacaaatgaataaacacgtgatcatatcaatgaggcagaaaaaaatacaaaacccaataccattcaaggataataaaagtcagaaaacagaggaaaggaagcaaagttcttcaacataataaagtgcatatataaaaaactcacaggtaacatactccatagtgaaagactgaaacatcccctctaagatcatgaacaggcaaagcatagtgctttcaccactgcaattcaacactgtattaaaagttctagccagagcaaataggcaagaaaaagaaataaaagacattcaaattgaaaggcagaagtaaaactactctatttgcagataacattatttagcaaataatccacaaaaaaactatgagctaacaaatggtttcggcgaagttgcagagtacaaaatcaacacataacaattaggttttctgtaaaaaaaaaaactccaacaatgaactatccaaaaggaaattcagaaaataatcccatttatgatagtatccagtagaataaaatacttaagtgttatggtctgaatgtttgtgcccttcacaacttcatatgttgaaatctaataccattgcaatagtatgaagaggcatggcctttaggaggtgattaggaagctctgccttccttcatgaatgagataagtgtccttataacttaatggacaaagtagtggcttcacaacctggagagacaggtttagatactgtgctgccaataagcagaaattttatttttgataagcttacataaagtaataatgtttttccaaaaataagactttgtcaaatggccccttttaacttctaaaattttttaatacatcaaatctgatttgaatatttaatatagcaagtatggataattccaggaagatggtgatctaagggatcaaaccagagctgaggagacaggtagcactggcaggtttaagagattagatacaggctgggcgcagtggctcatgcctgtaatcccaacactttgggaggccaaggcgggcagatcacctaaggttgggagttcgagaacagcctgaccaacatggagaaaccccgtctctactaaaaatacgaaagtatccagtcatggtggcacatgcctctaatcccagctacttcagaggctgaggtaggagaatcgcttgaacccagaaggtggaggttgcagtgagctgagatcatgccattgcactctggcctgggcaccaagagtgaaactccatctcaaaaaaaaaaaaaaaagattggatacaaacagggagaaggagcaaataaatattgtggataatgatatagcctggtttctcactattggagaaagaagttacaaagatggaaaacagaaaggctatggggttaagattgaaactgggaaatgtctatgtaaactcattgtttaaaaaatatgtatagacagaccaatacaaaaataagtgtacacatgtgtatttctgtgtatgtgtatgtacacatacatacatgtatttcctatctctgtcaattgagagggtctgaggcagtgacagcctctagcaatgagcacccagatcttggtttttaaattccatcctccactagaaagaacaatgtcctttggagaaatggctgatggcaaaggtagtgcaggaaaaggacaagatgggccaggcatatctgttgtgccacagagtaattactcaaaaattgatgtgggaagcaggctgaaaatggaataggtaattccaaaattccatcccaaactaaagcaacaattaagctggaaaaacaaaaaaaaccctctcagcatcaagcttttcagaattctccaatctaattaaaaacctagtaagcccagaacatttctggcgtggcttgctgatgcctgtgccaaagtggacagtatgcactttgttttcagagaactgtagttgtgtgttttgatctgtctatgcgggctctctgaagaagtggctcacaggcttgtctttgttttgcctgccttggaactttctcagggctagtcttccaggaagtgctagttgaaagcatttaaaggcaattatctggcctcagcagccagatgagaaaagcagcagatggactgataaaactgggagtggaaaaactgggaaggaaatacatgggggccggggtggggataaggggtttgaaaagctcctgcataaaccagggaattgaggtcatgtgcaaggccagggcaatatgcacgctcacaaaaaacctgagaggaacctaagctttcagtctggttgaccttcaggctcagtgtaagcaggaagtaaagctttacacagagatgtaaatggcctggcaaaccattacaagagcgccctaaaacagggcaaatatgcaaagaccagaatagttttttgttttgttttggctttgggcatttaaagaaatctctgtcagatcacaaactgaccactaaactaagggaacagaggtttctgtgaccatgtacaacaaagaactttacaaaaatagttttgaaaagtcacaaaataaacaaacaatgcaaaataaacagcaacaacaaattctggggaaaagaatctgatttctagaattaacacattttaatattcaaaatgttcagttttcaataaaaaattatgaggaatgcaaagaagataatatgacccacagacacacagaaaaaagaaatgaataaaacctgtcctcaaagacacctttgttattggtcttactagataaagaatttaaatcaactgttctaaatgtgcacaaaaagctaaatgaaaccagacaactaacagaaagcaggtgagcgatgccctgccaaatataaaatattaatatacagaacaaaattacaaaaatgtaattaggaatgtctggagctgacaagtacaaaaactaaatttttttaaaatcagtcaaaggatttaataaaagattggagctcaaagagaacaaagaatcagcaaaattgaagacactgatggagattactcattctgtggagcagagaaaaagaatggtgaaaaatggacagtgcctaagagatctatgagacaacatcaagcataccaacaagttaataacaagagttgctaatgaagaggagaaaagggaaccaaaaatatctgaagaaataatgtctgaagaccttctaaactgatgaaagacatgaatctctatgcccaagactctcaagaaactataattaggataagctcaaagaacttcaaactgagagaaataataaattgtcacaagacaaagaatctcaaaagtagcaagagataagggactaaccatgtacaaaggatctgaaataagattaacagccagacttttattaggaaccatgaaggccagaggcagtaggataatggcacctttcaagtgccaaaagaaaaaaaatatatatcaaaaattctacatttggcaaaactgcctttcaaaaatgaaagagaaattaaaacattcctagatcaacagaatctgagagaatttattagtactagatctgtcctacaagaaatgcaaaaggaagtccttaaggttgaaacaaaaggacattagacagtaactccaatcgaaacacacaaaaaattcaaatggtaaaagtaactactgtaagtaaatgcaaaagccagtcttattgtattcttggcttttatgttctctcttttttctatatgatttaaaagacaaatacataaaacaataattataaatctatggtaatgtgcacgctatttatgaaggcataaaatgagacaataagaagacaaaggacagggacaaagccgtataggaggagagtttttatataatattaaggcttagttagtattaatgcaagctagattgttataaattcaagatgctaattgcaattccaagtattaacactaggtaaataatgactacaaacaaatacaaaaggaattaaaatggcacattagaaaaaaacaaacacaaaagaaggcatacacagaaaaactgaaaacaaaaaagatgtaatacgtatggaaaacaaatagcaaaatggtataagtcctttatcagtttataatttactctaaatgtaaataaactaaactcccaactaaaagacagaaattggcaaaataggctgggcatggtggcttacacctgtaatcccagcactttgggaggctgaggtgggcggatcacgaggtcaggagtttgagaccagcctgaccaatacagtgaaaccccatctctactaaaaaaaaaaaaaaaatacaaaaattagccaggtgtagtggtgtacacctgtaatcccagctactcgggaggctgaggcagaagaactgcttgaacgctggaggcagaggttgcagagagtcaagatcgcaccactgcactccagcctgggtgatgcagtaagactctgtctcaaaaaaaaaataaaataaaataaataataaaaataaaaataaattggcaaaataaataaaaatatatgatccaggtatatattgtctacaagacactctctttagatacaaacacacaacacaataggttgaaattgaaatgacagaagaggatagtaacctaaagaatgccagggtggctatactgagacaaaagagactttaaatcaaaaattgttacaagagaaaaacactacatattgattaaaaaaaaaaaaaaactaagtctacaaagaagacatagtaacagaaatagaaataaatcatcctgaagtttacatagaatttcaagggatctcaactagccaaaataatcttgaaaacccatgcatgtatggtaaaatgattttcaacaaagttgtcaagaacagtcaatagggaaaggacaatttttctaacaaatagtgttggtaaaactggatagccacatgcaaaacaaaacaaaaacaaaaaaattaactcaaaatgaatcaaagacctaaatctaagaactaaaggtacaaaactcatggcagaacacataggagaatggattcgtgtggcaatgttttcttggatataataccaaaaaccacaggcaacagaaataaaaataaattggaccacatcaaacttaaaaattgtgcatcaaaggacacagttaactgaatgaaaagacaaccaacacaacaggaggaaatatttgcaattcatgtatctgatgaggaattaatataaaaaatatataaagaacccctacaactcaaaacaaacaaaataacctgattcaaagatggacaaaggatttgaacagacatttctccattaaagatatataaatggtcagcaagcttatgaaaatatgctcaacatcactgatcattagggaaatacaaatcaaaaccacagtgaaaaattaccatacacccattacaatggctgctatcaaaacaacaaaagaaaataacgagtgttggcaaggatatggagaaatcagaatcctgtacactgaggatgggactgtaaaatggtgcaccttctgtagaaaacaggtcggtgtttcctcaaggaattaaaaatagaattaccataggttccagccataccacttctgagtatataaccaaaagaactgaaagaaggatctcaaagaatagttgtaccccatgttcacagtagcattattcacaacagttaaaaggaggaaggaacccaaatgtccactgacagatgaatgaataaacaaaacatgggtacaatgaaatatcattcaacatcagaaaggagataaattctgacacatgctacaacactgaggaagcttgaggacattacgctaggtgaaataagccagtcacaataagacaaatactgtatgatttcacttatatgagatatagcaaaaatagtgaaactcatagaaacagaaagtaggatggtggttgccaggggcaaggaggaggggaaaatggggagttattgtttaatgggtagagaatttcaatttcccaagatgaaaaaattctggtgattagatgtacaatatgaatatacttaacactgcttctgaactgtacatccaaaaatagttaagattgctaaagcaaaaaactaacaataaataaagatgcctgctttggccacatatattcaacattgtactaaaaatttcagccagaggaattaggctaagtaaataaataaataaacccaaattagaaagaaagaaatgaaatagttttgtttgcagatgacatgatcttatatgcagaaaatactaaagaatccacaaagaaactactagaagtaggaaacaaattcagcaaaattacaagatacaagatcaacactcaaaaattatttgtgtactcattacaatgagcagtcaaaaagcaaattaacaattccacttacaatagcatttaaacaaaagaaattttaggcttgtgggccatcacagtctctactgcaaccagtcaactctgccctcgtagtgtgaaagtactcacaggctatacataaatacatgagtatggctgagtcccgataaaactttatagacactgaagtctgaatttcatataatttacgatagcatttaaatgaaaaactatttaataaatttaagcaaggatatgcaacacttgtacactgaaaactacaaaatattaatgaaggaaagaagacctagggaaaaaaaatcttatgttcattgattataagatttaatattaagataacactccccaaagtgttatcacccactctaatacttacccaatccaatacttatcaaaaactcaacatacttttttgcagaaatagaaaagctaactaaaaattcctatggattgcaaagcaccctgctgtggaaaactgtcggtttcacaataaattaaatgtaaaattaccatatcacccagcaatttcacttgtacgtatatacccaaaacaactgaaagcatgtattcaaacaaatatttgtacatgaatgctcataggagcactctccacaatagcgaaacacaggatgacccccaatgtccatcaacagatgaatggataaacaaaaggtgatatatccatataatagaatattgttcagtcataaaaagggacaaagtactgatatacaactacaacataaatgggtcttgaaaacattattctaagtgagagatcagacacaaattgtatgattccattcatatgccatatccaaaataggcaaatctataaagacagaaaggagattattggttgttaggggctgggagcacagcggggaaaagggagcaactgcttattaagttacaatactgcttattaagggtgatgtgtttccttttggtgtgatgaaaatattccagaaataaatggtggttatggttgtacaacattgtgaatgtactaaagtcactgaattctatactttaaaatggcttgtgaatttcatgtgatgtgtgttttaccacaattttttttttaggtagaatccctcgaaagttattgcaaatattccagttctgcccagtctctaaggctgtcacaaagcctgccacatcctaacaacccatgatcaccctagcctaccaggactgtttctttaaacaaccatgagtcctaatgctacacaattcattggatttttttttttttttttttttttcctgagacggagtctcactctgttgcccaggctggagcgcagtggcacaatctcggctcactgcaacctccacctcctgggttcaagtgatactcctgcctcagcctcctgactagctgggattacaggcacgcaccaccatgcccagctaatttttgtaattttagtagagacagggtttcaccatgttggtcaggctggtctcgaactcctgacctcatgatccacccgccttagccttccaaagtgctgggattacaggcgtgagccaatgtgcccggcctatttgaattttttaatcatatactttcttttgctatctgttaagttttcccctggactgcacatgaattactcactttgttgtactacttttttaagtacctgcaagactgtcatcagaagtttcacaatgtcacctaataaagcccaccgacaaactgttttatgttccagtttcacaactgtaagatcacaagatctgcattcacctatatgacatttttgtcttactcttcatcaactctctatcagaaatcagcaaacattttctgtaaagagtcacacagtaaatattttaggcttgtaggccattacagtctctgctgcaaccagtcaactctgcctttgtagtgtgaaagtaccaacaggcaatacataaatacatgagtatagctgagtcccaataaaaattcatagacaatgaagtctgaatttcatacaatttccaagcaaaataatactcttggtttttttccctcagccacctaaaagtataaaaaccatccttcatttgtggaccataaaaaaacagacagtaggctgcatttgacccatgaactgtaatgtgacctctcctctatattttccaggatgttatttctactttcatatgaatgtatagacattttttaaacctcaataattagttttaagcaaaactgtgaaaaaataaacaacttacctgggatgtgatcatattccactagtgttggcagagcagagaaaaccgagagggtgtagcttacaaacaagaaaagaacatgagaaatgtcacttgcctaaaaatgtccacctcccagctggcaaaacatctctaaaagggagatactcacacgtccatgcatgactctggcatggttatgtactgcttggacacattagttttcaaatgtgaaaacgtttggttttctactgacttataaacaacttatgctgtactctaacagagtatgcaaaccaatatattaaactaattaagcaagttaggaaaagccaaagaatggaacataatactttcattaaaactgatgctaaacaaaaatattcaggttttaatctttattataaaccagagaatcccaacaaggttttgaaaaaagtgatgtggtatttttcagcccagtttttttttgtttgcttttttgagacagagtcctgccctgtcacccaggctggagtgcaatggcacagtcttggctcactgtaacctctgcctcctgggttcaggtgattctcctgcctcagcctcccaagtagctgggactacaggtgcgcaccaccacgtcgggctaattttttgtatttttagtaaagacggggtttcaccatgttggtcaggctggtctcgaactcctgacctcgtgatctgccggcctcagcctcccaaagtgctgtgattacaggcgtgagccactgcgcccggcagagcccagtttttttggaaggaaaacgaacttgctctaacttggtttcaggttctcaaaaccatctttggattttaaaaagcaaacggattttttcttactctgttgtcaatgcagcaaacacctgcctgagtcctcaagcgactcagtgtctgttcttgactctgccacaacaaaatgtgtcaatgtcaacagtcacttaacatgttaagcttgtttcctgtccaccccaccccatcccatcttttaaataaagccgaaatagataacttacagacctttcttgcggctgcacctctgattctgtaagatcaagatgggggcatccgtacatctctagttgtgctgcaatatgccagcagctcaacatcgagaacgagcgagtaacgaatccaggcatggagggtgctgtcctccacttggctgctaagctcggccctccgcatgatgccttcacaactccccaagaagcggtgctgtctgctccttcggccttgccctcctctgccgccacatctgaatgggcacaaatctcccaccatcacccagcctgtgggagtctgaacaggacacaaatcgagcctctgctcctcccatccgtgctctagatctctaatgaggtctcggcccaacaggtccgatgtcctcctaggagggcccctgcaccctcacccctcctttcccttctcaccccacaacagatgttttgctccaagacagctgggcctaagcccttcagttcgaatcctcatccaagactgaaagctcctacatcttcctgtcactttagccacaagctgcaccgtctggaaatgcccactgctactagggacacaggcgaggccggacagtgccggaggacccggggtgcctccctccacgtgcgcggcctcacaggtcagtggaaacaagaaatcccccaatccacagccacgatgacttcaaaatacttcctgaaggcatcaggccatgaagctgcgacctgcgaggacacagcaagcggggtgacgctgagcagaggcttggtgtggagtccgcgcccgcagggtccctccccgccccgcgggtgcttcccgccacctcgctcgcctctgcgtcgcagtgacaacgcggggatgccgaccacaggtggttggaaggagacagcgagattctgaggggaaagaataaggagagaagcagcatcttttgggcagaaggcccgtttccgcacggtcctgccgaggcctccgggcatccttcacctcagggaagagaaaatccaaccttacttatcacaggcgcgggacctacgttcccttcgggagcagaagaaccaggacaggattaggacgcaggccaggcggcaaagccgctccctctctcccacctccaggacaagcggcacctccagtccaccctcgctccagccctcccgtactctacccccggcatcctctgccccgaagcagggagatgccgggagccctccctaccaggctgtaccggagaaaaacaaacctggagccacaccgcgcacatgcgcagaaagcccaaagcggctcccgcgaccggggccaaaaagtgcacactacatttcccacaagtcctcgcgccgctcccttagaaagtacacgctacatttcccacaagccctcgcgccgctccctgagaaagtgaagactacatttcccagaagtcctcgcgccgctcctttagaaacggcctgaggtttcagcgccgttcggtagttagttcccagatgcaccgagtgcaatactgcaattttattcgttagctgaaataaattatgagtatttaaattacacaggtttcttatgaattacatctccctgatgatttggctgtcctcaacacttcctcgtttggcagaattcaggagtggaatttctccagacacggtcggttcctgtggccccgctgcgccgcggcggcaccacctccacttgcgcctgtggctccacttgcttggttctggtccactggacgctcaccctgagaaaacacgctggacatgagcattaccagcctgtacactgttgtaaagataactcggaattgctcttcaaattttatttgttaaaccacgtaataccatcttttatgacaaacctgcattttccattcttcaggagtatgttggatctcttgatcaaaataactttttaaaatgttcactgacagaggtaacacaggagtggataactaaaaaacgtacgttctcacttataagtgggagctaagctatgagtacgcagaggcatacagagtgatacaatggactttagagactcagaagggggctggtgggaaggaggccggagatttaaaaaactacacatggccaggcgcagtggctcatgcctgtaatctcagcactttgggaggcggaggcgggagtcaggagttcaagacaagcctagccaacatggtgaaaccacgtctctactaaaaatacaaaattagctgggcgtggtggcacacatttgcagtctcagctatttgggaggctgaggcaggggaattgcttgaacccgagaggtggaggttgcagtgagccgaaatcgcgtcattgcactccggcctgggcaacaagagtgaaactcagtttcaaaaaacaaaacaaaacaaaaaactacacattaggtacagtgtacactactcgggtgacaggtgcactaagatctcaaaattcaccattttataattcatccataaccaaaaaccaattgtactccaacagctattgaagtttaagttaaaaataaaaaataaatgtccactgaccaaaacagaagcatttttctccatttctattcctttttttttttttttgagacggagtctcactctgttacccaggctggagtgcagtggcgcaatctcaactccctgcaacctctgcctcctgggttcaagcgaatctcctgcctcagtctcccgagtacctgggactacagacgtgcaccaccaagcctggctaatttttttgtatttttagtagaaacggggtttcaccatgttggccaggatggtctcgatctcttgacctcgtgatccgcccgcctcagcctcccaaagtgctgggattacaggagtgagccaccgcgcccggcttctattcccttctttaccaccactgatgataatcccacttgttcccatgctggaaaagcatttagtaccatccacgtaaaagagtcagtttattcaagggatgagatgtatttcagaagacatcatggcaagtacagtaatgattatcatttcaagtcacaatttattttcctgctcatgattttttttctttttctttttttttttttttttttgagggagtctcactgtcacccaggctggagtgcagtagcatgatcttggctcactgcaacctccgcctcctgggttcaagcgattctcctgcctcagcgtcccaagtagctggtactacaggcttgtaccaccacacctggctaatttttgtaattttagtagagacagggcttcactatgttggccaggctggttttgaactcctgaccttgtgatctgcccgccttggcctcccaaagtgctgggattacaggcatgagccacggcacccggcctaatgtttttccattttaagaacagtcttgacacttgtgaatattccatttttttttttttcagactgggtctcattctgtctcccaggctggagtgcagtggcatgatctcgggtcactgcaactgccgcctccaagattcaagtgattctcctgcctcagcctccccagtagctgggattacaggcacatgccaccatgtctggctaatttttcatattttcagtagagacaagttttcaccatattgaccaggctggtctcgaattcctgacctcaagtgatccacccgcctcagcctcccaaagtgctgggattacaggtgtgagccacctcacccagcctccattatttctttaatggttcaggttccattatgccatggattatttcagtaacattgtttgctctttcaatttgtataatcctatccctaaagagattgaaaactatgaacatgccactcccagcctccttgggacttgacacatcctcctgggatcatctcagatgggactgactgtgccggcaccatggaggtggtgctgatctttctatgcagcctgttggcccacattgtcctggccgatgcagttgagagggagaagcaaattgacccttttcattatgactaccagaccctgaggattagggggttggtatgtgctgtggtcctcttctccattgggatcctccttatcctaggttgcagatgcaagtgcagtttcaatcagaagcccaggaccccaggagaggaggaagcccaggtggagaacctcatcactgcaaatgcaacaaagctccagaaagcagagagctgaatgaagtgcagccttccagtgggaagcctctggaacctgaaggcagctgcttgaacttttagatgcaaatgttgatgcttaagaaaacagccacttcagcaacaaatctttccccaagagaagccaataacttgtgtgtccccccatgcccttccctgtcccttctaacaccattcctccacctgatgatccaactaatctcttgcctcaccactgcagcctgcaggctcctccaactcctgtgatgtgtctgtgtgtgtgtttgctgactgtaatgttcatggctacttgttcatggttattatagttagtgaactgtggactcactttcctgggcagaggctgagccatgcggccatctgctcctatctgccccccatcacctctcactcctgggggtctgcttttttccctggagagtctagctccttccctttagagcatgggcaggagtctccagttgtcttgggacctgggaaggtttgcatcactttcatcatctttctttatggagtctcttcactccttttacaagaacctcgcttccttatcccactccaacctcagtctgttctgaagatcagcaattagagatacaaagcaaagcaaggagtttgtaagcccagcattgccttcaggaggctactatacccttccacggttatttttctccctggggaagccccagggggctccatctgccctgcccttcacatagcacccagggattccaggtccggggctgctgctttttttctttttttttccagagtcccactctgtcacccaaaccagaatgcagtggcacgatctcagctcactgcaacctgggttcaagggattctcatgcctgggtctcccgagtagctgggattataggcaggcagcaccacactcagctaatttttgtatttttagtagagatgtggtttttcctggcctcaagcaatccacctaccttggcctcccaaaattctgggattacaggtgtcagccaccatgcccagcccaggcccagggcttctaatctgcccttggggaatgtagcccttacatatcttatcagcaataaccacaggggctctggtatcccacccatctccaaccttcctgcttctaagacttcaacctacagccgagtttttgtggacacaggcttccgtccttgaagttgagtctccagcaggtgatgactgaaggattcccattctgttgctgccagcacactggaatggacagagggagagtaaggggcctttgcttctccgcccatgtccccttggtcagcagagaactcctgcatcctttgctctgcctgtcagtggtcagagaggtgagtgaggtaggttagagacccagtaggctccatgcagcactgctgcagagggtacaggaagaggccaaaggtcataatgacagcgggagctcaaacaagatcccgcccttcctgtcctccatgtgcctgtggaaatcaaccaaccgagcctctgtgccagactgctgttttctgtatcacgatctgtctgaacaacagaaaaaaggaataaaatatttgtttcctagtgaaaaaaaaaaaaaaaacatgaacaaaaaacaagtaaacttcaatcaatggattatttttaaagtaaacaaaaattttggaatcttttcttgagaattaaaatatttcaagactttacataaacaactttctcaactgtgttagttacaggagccaatgagtttctaactacaaaggaaatgaagaatattgaatgccaaaaaaaatcaaacaatcctttaatcactcaattctaatcgtgtaaatgctgaagtaagagaacaattttatgacagttacttcaatgaaaatgcaaagaacatcagatgctatttggacctcatgatgcagaatgtgggtcggacggcccacaagttggaatcattcatgctgtacttcagcttggaccaagcatgtctgtgcctttatgcaaacatcaaccacaatttgtatttgtgttatcgccaccaaaagcagttcagaagcaaagggaaaatatcttctgccttgtgcttacttgtatccatggctctgctgtaaataggtgaggcatttagatcattgatcatctctgtgatcatagtgaagctattacttttgttgttgttgcagtagatttcatcctggctcttcaaaatttgattgcatctttgaaatcagaaaatacttctagcagtagtactttcaaattgtcatttgagctgaaagactgctcctgttatatagtgtggcagatagttacaacttccactgcaattactatatctcaatctgaattctttttattttttattttttttgaggcagtctcgctctgttgcccagttgacaccatcatacagtggtgcaatctcagctcactgcaacctccacctcccaagttcaagcaattctctttcctcagcctcccgagtagctggaattacaggtgctcaccaccatgccacgctaattttttgtaattttagtagagacaaggtttcaccatgttgcctaggctggtcttgaactactgagctcaggcaatccacccacctaggcctcccaaagtgcaaggattacaagtgtgtgtcaccgcactcggtcttgaattctttttaataaaaaaatttgtttaccactttatatagtattagttgaggaaatcatacatcttccatgtttagctgttactatgtgctggtgcctttctctatttttgcatactgcacaaaaagcttcaaaaggaatctttcctcatttaataaatctccacttttcaaacaattcatcgcaaagtatatgcttgaattttggtatttggcattcaaatatacacaaataaaaataggtaatagcaaccatgacaaaaattgagctgagtgaatttgataatctcacagctgccttagcgtgtctgtcactcataagtctgaactcaggactaacatcaaacaggggttgaaccattgaaagcattacaaacttgcaaactaataatcaattgaagtggccaggcatggtggctcacacctgtaatcccagcactttggaaggctgaggctggtggatcacaaggtcaggagattgagaccatcctggccaacacggtgacactctgtctgtactaaaaaaaatataaaaattagctggatgtggtggcacatgcttgtaaccctagctactccggaggctgaggcatgagaatcgcttgaacccgagagttagaggttgcagtgagccaaaattgcgccactacactccagcctggtgatagagtgagattccttctcaaaaaaaaaaaaaaagaaaagaaaaaaaatcaattgaagtagagttgcctttgaagtggcctgagacggctatcctatccttgtctggtatctgggaatgtgaattttgggaaggtttgggaacctggatttcagaagggttccctcctccctcactgatcaaatggctcactgtacctaaacaatatggtttctgcggaacacctgctttttttctgggaatctggaatcttgatttctgcacaatagacagtgtctacacgagcagccccccaataaaaagcccaggcactgagtctctaaggagcttctgtgacaacattttgcatttgttgtcacagcatgttgctggaggaattcagcacatcctatgtggctccactaggagaggatgcttggaagctggtaccaggtttcctctggacatggccctgtgacctctcccctttgctgaccttgctgtaataagttgtagccatactgtgactatatgccaagtcctgtcagtcctcctagcaatttgtttagcccagaagtgttcttgggaatccccaatacagttggcatcagaagcaaatttttttttacttctgactctgtcacccaggctggagtgcagtggcacaatcatagctcactgcagccttgagctcctgggcacaagtgatcctcctgcctcagctgggactacaggtatgtatcctcctgaatagctgggactacaagcacgtgccaccatcccgggctctttttttttttttctgtaaagatggggtcctgctatgttgcccaggtttatcttgagctcctggccttaagtgatcctcctgcctcagcctctctaagtgctgagattacaggtgtgagtcattgcacctggcccagaagtggaatttgctagaacagtcctgattcactaagatttggctccatcactgtttgggaaaaggaagaatgaaggggaatggtgataagccttggtgtctatcgagccctccatggtttgagagcagcagctgaactgccatctgctgttagaagccacagtgacctttggggttagaaatggatccaaccctggcttctttgagctgtgctggatgaagtgagggggaaagtatacatctggggattggctttgttttttattctcttctccaggtgggagggtaaaaaaacaacagtgacaaattataaaggtgagtgttaggtggccccaaaaatgttagaagttctcagggctggagcaaagctggggtgggagggtgggagggtgggagggtggggagggcaccaagactccatccagcctcttcttcagcccagctgctgccctgttgcaagagctgcctccttctttaccaccccctgtaccctcccccatctgctttccaacctgaatctttcccacagcagtaatgctaacctaactgcaaatgctggatttactgctatggatttagtttgcaacagaaaaaaaaatttaatggctttgtgttttgtggctattacatctagatgtattaatatgataaaattgatataaaatgttaaatgctttcaatttcataaattctagagggaacacacttatcaggaaaagctgcagcggaaagtgaaggtgatacaacttccttgctttttgcagctagtgggcagcttggaatttaaattctcaatactggaaacagaacaagtccccaaaattaacaatttttgctacagtttttgtctattggagccactggaaaaaaggagacaatatgaagagaggcaatcttgagctagagatacgctttggaatttacaaggcagtttttcatctctaatgagctcttgtaagatcatatagctgaccctcagaggctgatgattttctggccccatgtgtatagttttgagttgctcagcttggactctaaggtgaataatgtaaaaagagcccaacaaagccttgcttgtcacttggctaagaacacagctgtctggccctgcagcatctcagtctccagttactggaagaacatatattagatgttggggaaactataaggctacaggatgatgctgcatgttggcagggagaattgttcaaggtagaaactgtggggaacaaagaaagagattctcatctgtgtacctgctgctacatgctaatttgggagtaagaaaactgttaaggaataaaaaagccaagaactctgtcttcacagggctttcaggctagaagggaaactggccaccatacaaattgtatacaactccattagtacttaagaggtctgatttattgctttgaaacacaagtgcaggaagtttaaggtttatcagcagcctttccctttgcagaaattgtaaactaaaaatgaaatcctaagcccccaccaactgaaggacactccccttagccaaggggaccccagaaaaatcttacaattgagttcctggccatgatgggatgggaggtcagacatgtctcattataccccctcatgtttgtggtttagacacagcgactgaccagcattaatgttaaaatagagatcataagactggcagaacagactttttgtggcaatgagatatcaattataaacaagacctaaggccatgccaggcaagggttaggtcaagcactctaaacttaaagattaactatggtctaactgccacaaggtttttcttttttctctagcagctaaataaacactggccttgacataagcaaaataaaaacaattgtagctcatcaccagacactaattggctcccaactcctgtcccaagcaccataactacagctttgattagacaagagactgatttcagtaactttctcctgataagaagaccacccaccatgaactggttctggctggttttacagagattgcacacttgagtgcgttcgtgtcctgtaaagaccttttgactgatagggcctaattataatacattcaagtgttaggactccaccccaaagtgaacatgggtcatgtattacatgcatgttggttcaatacatgtgcctcaggaccaccttcatgcatattcatagctcctcctataacctgttgaagatgtatgtttagctaacttgtccagcataatgctcctaccccaacctatattccttcaaagtgcctgtccctagtccctggtcttagccagaggcattcttctcagcctgttgcaggctgtaaccccttataagaaataaagcctcctctccattccaaatagttaaatcttgtgaattgtttttgttttgttttgttttgttttgttttgttttgttttgttttgagatggagtttcactcttgtcacccaggctggaatgcaatggcacgatcttgtgtcactgcaacttctgcctcccaggttcaagcgattctcttgcctcagtctcctgagtagctgggaatacaagcacctgccaccatgcctggctaatttttgtatttttagtagaggtggggtttcatcatgttggccaggctggtctcaaaatcctgacttcaggtgatccacctgtctctgcctcccaaagtgctgggattacagctgtgagccaccgcacctggcctaaatcttgtgatttttaaattcaacagagtcaattaaatggttccttgatagagaaacatttaaggcagacattagcttttattgccccataacgcttcagtaagtttccctgaatatttgcatttacttgtcaatcaactcacagggactgaggcagaagtaaaacccacaattaccttacccctggcctgtgtgacaaagtaacaaatcttttatcacatatttgagaggcatctcagctaccaagaactttttttttaaccttttattttaggttcagggggatatgtgcaggtttgttatgtaggtaaactcgtatcacaggggtttgttgtacagattatttcatcacccaggtactaggcctagtacccaataattattttttctggtcctctccctcctcctactccaccctcatgtaggcccagtgtctgctgttcccctttgtgtccatgggttctcattatttagctcccacttataagtgagactgggcgattgctgacctgcatcactcttgggtggatctaacaggacataagtaaaagacccttggccacaaccactaccaaagtccctttttctgctgcctccaagttggggaggaaacataagccctaagatcaccccagagctgtggtgagaagcccaggagagaaaaaaacctgagtagttttaaactagaatatccatgtggctttttaaagatgtttgcaatttttttgctattctccctttgagatatgggggtctatgcccacccttaccagactggacactagtgctcacttgtcactgacacatgacatgaaagtgatgctgtgtaacttccaaagttatgtttaaaaaggccatgagcatctgcctggttcactcaggtcactcacctatggtgcccttgatcaccaagtcaaagctctgaatgtcctgagagtgctctgctacctggaatcccagggtaactgggaggtctcctataggtcctgaagccaagccccatgtcctctgcagacatgtgagtgaagtcacctccagatgatgccaaccctttgctgtggattcaactccggccaatgagtcttctctgcagtccccaaacaccaataaacagcaataagccatcttttctgtttcttcctagccctgtgaaccatgaacaaaataaaatggttgtttcatgcattattttacggtggtggttctttcttttaaaaaaattcacggtaaaagcgccaagaataacacacttgtaggacattcacaaggcacaaaataacatacattgaaatctaggtttccttctttccttcttccacagcctatcaggttctgcctctggaagtaataatggttaagtttctgcacatctttccagatttattaattaaacaatcatatagcactgacactgtgaggaagctttttaagggctttgcttatatttattcacttactcttcactcactgcggacactcaggtggcagcaggaaggaaagtgttttgctcaaccaaatgaaagtttgatctgctctttgaatgctgttccttcaatcagataattctattttcttcatatattaccaagtctttttattttctcccctaattgagcattcagagatgtgactctgttttctagtttttcttacgtttcaccactaaatcttaaatttcatatgagacagacagtgatgaaattcctgtcactggacatatatatgtatgtttatgatggtgccttacacatacacatttttctatctagcgattaaccattaaaactctatactcagagtgaggaaacattacacgttccttcccaaaccctgtcaactaccctgtcaattaaataatccctgaaaaaatggcaacatctatattaatgcggtttttatatctcatcaatgacccatttgataaaatagttctagaaacttgtaatgaaccagcagtgatggaaatttgtactgaactatttcatatctaaaagggtatctactttgttttagacatgacaactctctcatgttttagaattttccattgttgcatgtttaaagggcttgtcaattcccttccctttcctaattctcatgaccagatcataagaatgtgtgtgatcaggctggttgatgtgccacaacacatctttaatcctggaatttagggttatcagaagtctccatttaaaaaagtatcatatgctttcaaacaacccactgttgaacatatagtgcttcatttctcttaatgtctcagtgaatagccagccttttatgcatacatgaatagaggatctctcaacaaattcagagattcagaaataagtacataaacttagttgcatagagagaaaaaataggtaatatacataagtgataaaagaaggttttatataattactttttcaaactaaatttataatagtgctttttaaactaaatctggaacaaattttaaattatttaatctagaaatgtccagtgattcaggaacagtagaaatgggtgaggagagcatttcaactcaagcaaggaactccttttattctcaacacattagctttttccctcttcactctaaaatgttcactatcaaatataattgagaggtcttttttcctcatttaacatttatttcatacacagagaataatactgtgggtctgagattcagtttttgaaatgcaacatatactctaagtgacccttttacccatgtcaaaatagcagcagttggaccccataatgtggcatgtattcatttgaaaattctacagtgacctatcactgtgatcatgtgatgaagcatatcttgccttccattctaactgtcactctgtgagcttcgaggttcaagtttgacagcatttgtcaatttcggaatgtcatacaaagaacgctcaaatatggggaattttatgtactgttgctgagatatgttcactttcatcttccgatcatggtttcttcaaataggccagttcacttgtactcaaaatctcttcctcatttttttgtttcccccactccaattcgtctatggatttatgaacatattttatagtattattactgatttgtacttttgattcttccaccaagcgttttgtcttaaatattttcctatttttagaaaaatgtactgtttctaaacacttttgtacacaatgtttcataggatacagaaaaaacacaaccacactgtcttcatcagatgaggagaatcttgataccaaatacagtatgagacattccatgaaagggaaattatagaccaaagtcttctgagtataaaagtcaaaatctgaaaccaaatattagagtggtctaaatctggagatttttaggaaaagaaactgaaatttcatggtgggaaacataattttgcttagcttagaggttttgagggattgttttaaagaaaaatttaaaagataaataacattaaatggatataaaagttataaaataaaaatataaagttataaaaattaaaataaaaatatattcatatattaatataaaattgtaaaaatattataaaaggttataaaaatattataaaaggttacaaaattcttttgctgtcaagattgactgggattagatttgtttataaggtcttattaaaattagccataatattaaaaatacggctgggtgcggtggctcacgcctgtaatcccagcactttgggaggctgaggcaggcagatcaccaggtcaggagaaagagaccatcctggctaacaaagtgaaaccccgtctctactaaaaatataaacattagccgggcatggtggcgggcgcctgtagtcccagctacttgggaggctgaggcaggagaatggcgtgaacccgggaggcggagcttgcagtgagccgagattgcgttactgcattccagcctgagcaacagagcaagactctgtctcaaaaaaataaaaataaataaataaataaataaataaaaatattaaaaatacattaatatccaactaaattttttttaaaaaaataagcgtaagattttttccccatcgaacttaacaaaaagagtatgtattcccgtgtgccagagtgccagatcaccacatactattatgttgggtttgcatatttgatgatgtgtcgctaccaggatgccatccgggtctttgccaacagcctcctctacatccagaggaccaagagcatgttccagaggaccacatacaagtatgagatgattaacaagcagaatgagcagatgcatgcactgctggccattgccctcacggtgtaccccatgagtatcgatgagagcattcacctccagctgcagaagaaacacagggacaagatgctgcgcatgcagaaaggtgacccacaagtctatgaagaacttttcagttacttctgccccaagttcctgtcgcctgtagtgcccaactatgataatgtgcaccccaactaccacaaagagcccttcctgcagcagctgaaggtgttttctgatgaagtacagcagcaggcccagctttcaaccatccacagcttcctcaagctctacaccaccatgcctgtggccaagctggctggcttcctggacctcacagagcaggagttcaggatccagcttcttgtcttcaaacacaagatgaagaacctggtgtggaccagcggcatctcaatcctggatggtgaatttcagtcagcctcagaggttgacttctacattgataaggacatgatccacatcgcggacaccaaggtctccaggcgctatggggatttcttcatccgtcggatccaaaaattggaggagcttaatcgaaccctgaagaagatgggacagagaccctgatgacattcacacacattatttaggaacctgttttgatatattacaggcaggaagtgtttttgctaccgtgaaacctttacctagatcagccatcagcctgtctactcagttaacaagttaaggaccgacgtgtttcaagtggatatcagtaaaggatctttggagccagaaaaaaaaaaaaaagatttgttctcaatgagattacacacagtaataatttttaattctcaaatctgtttctttttaaaacttctgagatttgtatctcagaagttcaacctttactatatttttttacacattatttacagatcacacatcattaccctttgtttcttttctccttcaaaaggtaaatctttttacttggctagaatggtaactttgtacttcaacttttccatcagctcttttaacttttccctcatattctatttctgctgttataataccaaaatattgatcccaaaggtaaaaataaattctttctcaggggtaacatgattttttactcttaactttttgatatgtctgaattgttgcatgtaatcaggaaacttcccatgctattaggttggtgcacaagtaattgtggtttttgccattactttcaatggcaaaaactgcaattaccgcaccaacctaatactaggagccatatatccacctgctcaaggtgctagctttcatgtttacattcttctataatacaatgttcactcatgaccttgaatacattgtgcctgtgtctaattaaattcaagtatctttttcatcaggtttgacttccaagttatttaaaccgactttacttaggcacttcccattctcaagtatgccttagtccaggttgttcagatagttgctcagattaagccagtgagatgattggggtcacagatttaattcattaagccactaaagcatcagcccagatagccatattttcagttaatttcaattagctgctcatgaagggttggccagttgaatggaagttgattcttggcacagccttcaagtggcaattggtttaaaatgtcctgagttctgagccagcctgggggctgatacagtttggatatgcgtccctgcccaaatcttatggtggattgtaatcctcaatattggagacaactggttgagaggtgactgggtcatgagagtgtatgtctcataaatggtttagcatcatccccttgttgctgctcttgcaacagtgagatttggttgtttaaaagtgtgtgacacctcctcctaccttgctcctactctggccttgtgatgtgcatgctcccacttagccttctgttatgattctaagtttcctgaggcctccccagaagccacgcagatgtccgtatcatgcttcctgtaaagctttcagaacgctgagccaattaaatctcttttctatataaattacccagtctcaggaatttgttgttgttgttttatttggggggttttttgtttgttttgagacagagtctcactctcacccaggctggagtgcagtggcatgatctcggctcactgcaacctccatcttctgagttcaagcgattctcctgccttggcctcctgagtagctgggattacagacgcatgccaccatgcccagctaatttttgtatttttagtagagacagggtttcactatgttggtcaggctggtctcaaacttttgacctcgtgatctgcccaccttggcttcccaaagtgctgggattacaggcgtgagccaccgtgcccagccaggaatttctttacagcaatgtgagaatggccgaatacagaaaattagtactaaggagtggggcattagtataaaggtacctgaaaatgaggaagcacctttggaactgggtaatgggcagaggttgaaagagtctggagaacttggaagaagacaggaagatgagggaaagtttagaacttcttagaaattggttaaatggttgtgaccaaaatgctgatagtgatatagaaagtgaagtccaggctgatgaggtctcagatggaaatgaggaacttattggaaactagagcaaaggtcacgcatgttatgccttagcaaagagcttggctggattccatccaagtcctagggatctatggaagtttaaacttgagagtgatgtcctagagtatctggcaaaaaaaaatttctaagcaacaaagtgttcaagaagtggcatgggccaagcatggtggctcatgccagtaatcctagcactttgagaggccaaggcaggcagatagcttgagcccaagagttcaagaccagcctgggaaacatggcaaaatcccatctctgactaaaaatataaaaaaaaatacctggcctagtggcatgagcccatagtcccagctactcaggaggctgagatgggacaattacctaagcctgggaagtccagggtgcagtgatccatgtttatgccatggcacttcagcctgggtgacagagtgagaccttgtctcaaaaacaaaacaaaacaaacaaaacaaaacaaacaaacaaaaactggtgtgactgcttctaacagcctatgctgggatgtggaagcaaagaaataagttggaacttctatttaaaaggtaaccagcaaataaaagtttggaaaatttgcatcctggagcctggccatgcagtaggaaaaaaaaaaaaaaaaaccaaaaacccaaagcccatcgtcagaagaattcaagtgggctgctgagtaaccacctgctagagaaatttgataactaaaaagaaggcaagtgctgatagcccagacaataaaaagccttgaaggcattttagagatctcagaggcagcctatccaaacacaggatcagaggcccagggaagaatggttttggaggccaggcccaggcctacactgtcctgcacatcctcaggacactgctccctgcctcttggcaactccagatccagctgtggcttaaaggggccaggggtagcttgggctgctgctctgacaagtgtaagtcataagccttggtggcttccacatggtgttaagtctgctggtgcacagaatgcaagagtgaatgaggcttggcacctctacctagatttcagaggatgtgtggaaaagcttgggtgtccagtcagaagcttgctgcaggggtggagccctcacagagaacctctactagggtggtgtagaggaaaactgtggggttggagcccccacatagagtctgtactggggcatttgctagtggagccaccatcctccagaccccaaaatggaagatctactggcagcttgcaccctgcacatggaaaaactgcaagcactaaactccagcccatgagaacagctttgggggctgaagcttgcaaagccacagaggcagagctgcccaagacctcaggagcccattgcttgcaccaatggcctggatgtgggacatggagtcaaagaaaattattattgagctttaagatttaatgattgcactgctgagttttgaatatgtgtggagcccgtagccccctttttttggcctatttatcccttttggaatggggtttgtaacccaatgcttgtacttccattgtattttggaagtaactctaacttgttttttattttacaggtggaagagatttaccttgtctcagatgagactttggacttcagacttttaagacaatgctggaatgggctaagactttgggagactgttgggaaggcataactgtattctgaaatgtgagaaggacatgagatttgggagtggcaaggggtggaataatatagtttggatatgtgtcccttcccaaatctcatgttaaattgtcatccccagcattggaggtggggcctgatgggaggtgattggctcatgggggtagttttctcatgaatggtttagcaccatccccttggtgctgtccttgcaaaagtgagttctcatgagatctggttgcataaaagtgtggggcatcttgctctcactctctcttgcttctgctgctgctatatgggatgcctatttccccttcacattccaccatgattggaagattctggaagtctcccaagaagcagatgccactatgcttcctctacatcctgcagaatgatgaaccaattaaacctcttttctttatgaattacccagtttcaagtatttctttatatcaatgcaaggatggactaatacggggccaagcagaccatggtcccttaggatggtcaactgattataaggtggcttatactgcaaggtgaggtcagggattaaaacctagaggttgaaagattctttttttattactgtttcagctcttcttttgacttagccacctcttccagggcatcagattcctgaagcaactttggggtaggagcagttgagaaagcaagtgaaaatagccctttgttcagggttcagggaattatttcaaggtcttgggtcttcagagacctcagtccccagaaaaccaattaccttcttgtgccagatccatcactcatcagtgctgtgactctgggcagaccacttcaaatctctccatttcacttccctgagctgtcaaatatgggttgtagcccctgctctgcgcattcctccaggctgatgtaagcatcacaagaaataacagatattctccatgagctgtaaagcatcatacctatggaaaaaaagaagaaaatcccatcctccactcccctggagccacccacgtttcttctctgtattcaacaactaccaaggttctggcatattcttctagacatataatgattgaacactttaggtcacttatgaattgccagtcttctaaaggctttacctccatttcaccatttttagccttataacatacgccatattaacatttcaatacctcagaacagggaactgaggcacagagaggtctctataactttgtcaggtttgtgcatcttctaagtaggacttgaacccccatctttatgcaccaggcccagtgttcttggtcactccaatatttctatattgtctcatctcaatacaggtatttgcctacatagtcagtctgttggttatgagtgcaactcacactgcaggttcttgttaaaatccaactgagattcagggggtttcgctatgcagatggtgaacaatgggtcaaacatttaaactgtcaataaatgattactcatttctctatggtctttggcaggaagatgtcaaaaactgtctttttcatagtacatttcccagcatcttgcctccagggtatgacagtagatcttcagggatcaagggaatctactgtccacaccaagctgaggaagagaatactctgccactggcctcataactaggcgcaccccggaaagcagtcaactgaaagtactgtggaaattaaattgttaagttcattcaaggataacaattctagattattcagcgtcccatatttcagacaactctaaaattgctatgccatattatttcatgtgtgcaaatttaagtttattaagtcaatcactagtgctacaactacagaagatacatttacaacttcaaaattgtttcagttttaatagcatagaatatctcaatgtagtatttagatatttagctgcttgttaaacattaactaaaatgaaacacttcctgaacaatgctgccatattttttaaattaatggacattatatgaaactgttttgaattaacataaaaactgatgaagtagtacagaaagttctcatacacccttcccccacctcagcatcctttttgtaatcacatcttacatgagtgtggtaaatgttacaatgactgaaataatattgatacattcttattaatgaaagtctagagtttggcacagaggtagagatggacaatcttgatgtccagttttttcatagctgtatgtatccagtaattaatttcccatttggtaggagggcaacagttttatcaatatttgtatcgtatgttagtgtaggcgacattacttctccattagatgctggcttcatttcttgttgtacttgaaattagacttctcacagaccagcaaggggcctgcaaccattcacatactactgagggttgccatggttatgttggccctacaggagcttgacaaaccgtaggtggtcttcttatcgggagaaagttactgaaatcagtctcttgtccaatcaaagctgcagttatggtttgtggaacaggggttggaggttagtcagtatctggtgttgagctacaattattttaatattgcttgagggtcagtgcttatttagctgctagagaaaaattaacttgtggcagttagaacacagtttattctttaagtttagggtgcgtgacttaacccttacctgttgtggccttcagtcctgtttataattcggtatctcattgccacaaatagtccattatgtcagtcttatgatcgctaatttcacagtaatgctgggcagttgtgtctaaaccataaacatgagggagtataatgagatgtgtctgaacctcctcccatctcatcatggccagaaactcagttttaaggtatttctggggtctctttgaccaagggagggcctgttcagtcagtggcgggttagaattttatttttagtttacaactcccacaaaggcaaaggctgctgctaagcatctgcacttgtgtttcaaagcaacgcactttttttttttttttttttgagacagagtcaaaagacggggcacacagaaaagtcatgcaacatggtggtcctaccaccacctacagcctctcctcctcattaaagtggcctatggagggcttagcccagcaggcttagagcttctacagaatgggtatctgctccctgggaggatgttctcgggacatccttcaattgcctgcagggattttgggggttgttttcaaagcacaagtgtggtcccggctaagagcagcctatcagcactctcctcggatgtgttggtttccttgatgggccaaaagaaagtgagaagccgctgaaaacacatacacttatttgccttcccttttttatgttacccactccaccatcacatttcctcttcctctttttctccatccttcatatcttccatatcttctctgagatggaggacaagaagtcagcaagtttgtgtctcggtgagttatttcaaggtacataccactctctcctgaggctgatgacatctgcaatcatattttaaaagcactgtgaggattatattatgctgtgcacttcacacaggtctgttttttctcttgactttaggaacctagaaggggtacagtggttacgtcaaaaatcaaagttccccaaaactagcacagaggatacctgtggaaaagataacaccttttcctgccacatttatctttcaaattgatttagattagcagtggcacagtccttaattcaaaagggaaaagtggtgctgagggagatgcctctacattacagtttatcatggaaactgtcagttggtaagagatgcccacctaataccacctcaaccaagggtattacatgtctcccataatgtacattttcagatttttatctctaaatttcactggtaaagaaataaaccaggaaagcaaaatttctgtataagaaagaagcgtggtcttacattgacaaggtcttctttatttggagatgacttgtccaaaagtttctccaaaagctaggacgacacagagtgactatcagtgccctggaggttggtgattatggatcactcagggagctgtgcttaatgtggcgcgtggaggtggttggttcacatgcatggactgagttgacacagggccatcctccagggtggaggaaggatggcaaagaggagcagcaggaaagaaatgagaaaccaccaggagcctggaagaaggacaggtttcccctagaagcatcagagggaacctggccctgcctatggattttgcactactagctccgagaactgagacatttctgtttttttaaccccccagtttatggtccatgtgatttcaggcctaggaagctaatacactaagacaaatcaatatacctctattttgaatttgcattcatttctttcatgtatgcccctaatatttccacaattatgatgatttttgtgtttatctttctatattttatataccactagtgtcattttatgttaatttaatttccctggtcgtgaagacattataagtttataatgactgcataataatatatatatatatatacatatatattttttttttttgagacagagtctcactgtgtagcccaagctggagtgcactagagcaatctcagctcaccacgacatctgcttcagggctcaagcgattctcgtgcctcagcctccccagtagctgggactacagacaagcgccaccacgcctggctaatttttttttttttgagatgaagtctcgctcttgtcccccagactggagtgcaatgacaggatctcagctcatgcaacttccgcctccgggttcaagcaattctcctgcctcagccttctgagtagctgggattacaggtgcctgccaccatgcccagctaatttttgtatttttagtagagacagggtttcaccatgttggccaggctggtctcgaactcctgacctcacgtgatccgcccgccttggcctcccaataattttttgtattttagtagagacagggtttcaccatgtttcccagggtggtctcgaactcctgagctcaggcgatctgcccgcctcagcctcccaaaatgctgagattacaggtgtgagccactgcgcccggccacaatattatttttatcataggtactaatacatattgatttttagctaattcgaattgcttattaatatcaataaaaatatgcagatcttgttattgaagctctatggatctgtgagctcaggggagatgcctccgtgtgcagtgggaagcctcaggtgcaacatgcctggcatctcctgctcaagatagagtgcaggcagggagcttgctgggcatgtttgcaggagggagactagactgaggcatgagaaacaatctgtcacccacacccaccagtgctttcatgcctgagtcagaccagagcttttcagatgttactgtgcgcacccatcatctgagatcctgtaaagtgtgaattctgattccgtgggtctggaataggacctgactttgcatttctaaggggtcctttcccccaatttttcccatacatattttaatatcctcaaattcataagaatggtggaaaacaagaaggaaagctatgagcagacagaaaccaaagagtaatctcttgcagagagaactaaagacttttgacttaaaaatttcccagtccagggccgggcgccgtggctcatgcctataatcccagcactttgggaggccaaggcggctggatcacctgaggttaggagtttgagaccagcctgaccaacaagatgaaaccctgtctctactaagaatacaaaaactagccagctgtggtggcaggcgcctgtagtcctagctactcaggaggctgagacaggagaattgcttgaacccgggaggtggtggttgcagtgagctgagatcgtgccattgcactccagtctgggtgacggagcaagactccatctcaaaaaaaaaaaaaaaaaaaaaaaattcccagtccaggctggaagatggctagagaggacagctgagatgctgacagaggtgccactttaagaaacaaaccagaaatgaaagtaaacacaccccaaacctcgacctcccctctgactcctgttcaatctccccactggtgcctcctccagtctttgacagagtgtggaacatcctcaccctctcccattccttatctctgattcacaatttcccatcttgattctccagtctctctttcctaccgtctccttctcccctgtgacctcctcacttagtcagcaagttctctatgtccaaacagccatgggaagtttttcagatcttgtaagttgtcacttgcatccccttcctttagtgaatctctctaacccttcacttcagaaaaagccccaaggcttctgattctccagtactttctccttctactcccggggttctcctcacttgacagagaattcagtggatctatcaatcaggtgaatttgtcctccccagcactcaccagactgcttactatgtgctgatctcctgagcaaccaagtggggagagagaaacctggcttcatgagtatcctggcaagtggattcagggctgaatcgcccctgcttgtagataatgtatgcttatttcagctgcaatttgtatatgagataacccttcccttaagaactccctataaagtgagaattgtgcaccctgttcccactgaggaggcctacatagaaaactaaagactgagacatcaggcggctgccctgagggagaacctcactgtgtcattaggcagtgagtgggcaggggtcctggcctaggtggaagcaggagcctctgtgaaaaccacccctcctctagtcacagagaggatagccggtgggcctgccctgaggggacctctggggctctcagctggggaaatgaggaaacagacactgatcctggcctccgctcaggactcattgggctagcagctgagtcctccctgggaccctgcagagcctcaagccaggctgagcacaggcccacgcctcccagaaatgacacccagccacagggctgcaggaaagacccagcgaggctttggttggccaaaaatttgcatgaagggctcctgtttctccacggtctggagggtggataagaggcctgcagcatggctgcctcggcacagcactggggtatctggacagtggcatacaccctactcctcctcttcatcctcctccttcatgggacaggccaacatggtcctcggcatcctgatccctggctcactcatgatgcaactgtcccctcttctccttcctccaggatgtaatgagtttgttttcaggttccctctcccagccagggagtctcagccaagctcacctgcacactgagcagtaagcataggacctacaccactgcatggtagcatggacagggaagccccttggtgtgtgatgtggcttaagagtgatggaaaccatggcaagagggacgggatccctgatcactactcaggctccaggtctgaggctgaccactccttaaccacctctaacatccagtcccaggacaaagctgactgtatctgtggtgtatctcacagcactgcaatgccatgtgaatgaagcacagtgacccagatgaatggagatgtgggacaaaaactgttttctccactacgaaggctgccacacagctctcagaaaatgtctggtgtcataaattctaggaaatgttggcggattttttgttgttcctgttgtttccttttcaattttacaaggagtgacatagatgcattctgattcctgccaagagttccctgggaaccagtttgctacacagatcttcagtaatgctgcaaatattacaacagatcttgacacccctgctggtcattgtctctgcacgggggatgcaaggccattcactctcctcttcagatataaacactgggactcagctacatgccaccctcctaccacatcatggttcatcctaatgaccaccctttgaagataacacctttatctttttttgacaattttaaaaacaatttctatttttatcttaagattcagggggtacatgtgcagttttgttatgtgggtatactgtgtgatgctgaggcttggggaacgattgattctgttattcatgtagtgagcatagagcgcaacaggtagtttttcaacccttgccctatgtatgtttaacccagaaagtccaaatttggttttcacattttgaaactaatgtttcattcaatgtccccttttgcaactggtttctgagttgtttgtgtgtaatgttatgaatggcatgagattcggtttttggtgtggatctctggatgaaggctatcaccctttctaatctgtgcaatgccctgtgcccagttaatcatggagtgtgcatccaaaaagtacaaacacagagtgaccactgggactcaacaccttcaacctggtatcaatagaaggtctgtatctgcatcacagatgtgaatccacaacaaatccttcccatggctttgacccatttctctataccaggctctctcccaagagaatttcaacaaagaattgttttgaactcaagtcaaaaagatgcccttcaagcattgtttaagcagaactcctaccctggcataccaaccagagagcaactggccaaagaaatcggcagtctggagtctaggatacaggtgggcttgtatttccatttcatttccttggagtcaaagaaaaaagacaagctggactaagcagtctccaatcataccatgttaagaatgaactgaaaactaagacccctatctctgccttttaccaatcgtggaaaatgtggtctggtgtattcactgatggaggaaggaagttaaattgggcctttctcctggtaggaggaaattaaatcatatttgcatgctctagagaatataggtaatatggtcaccatgatcatgataagttgtcattgatacctggcaccaatattatagaatgctcagataataggtaatattgaggacggtgaggtcagggctgccataaagtcccgtttctcatcccatggtttttgtttcttttctactgttttgttttgagacagagtctcactctgtcacccaggctggagtgcagtgatgcaatctcagctcactgcaacctccacctcccaggttcaagccattctcatcccctaccctcccaagtagctgggattacaggtatgtgccacatctggctaatttttgtatttttagtagagatggggttttgccatgttggccaggctggtcttgaactcctggcctcaagtgatccccccaccttggcctcccaaagtgctggggttacaggagtgagccactgtgcctcgcctctactaagtgtttttatgtgggctttacacactggagagtttagtgcctgatcccattttggaatattttgagtggaaaaatggatataaaaataaaagtgtctgggagcggtggctcatgcctgtaatcccagcactttgggaggctgaggtgggtggatcatgaggccaggagttcaagaccagcctggccaagatggtgagaccccgtctctactaaaaacacaaaaattacccaggtatggtagtgggaccctgtggcagagaattgcttgaacccaggaggcagaggttgcagtgagctaagatcgcgccactgcactccagcctgggtaacagagcgagactgtctcaataaataaataaataaataaataataaaataaaataaaaccattctgtttctccagttaagaaatagctggaaagatcacaatcacaccaggagaagtgtatccagactgtcaacaactaagtaaaagggactctgttgaagaaaagcctacggtcagggttttatatcaaatgctataatcctgagtaagccctgggatacagggatctgagtttcaggcaggccaagtgaagacgtatttccttttctttatgcacccagtccaggtgtcagagtgctacatcaaatccaagaatgaaagtgtggcccgggctgggggcagtggttcatgttggtaatcccagcgcttttggaggttgaggcaggagttcgagaccagcctggccaacatggtgaaacctcgttactaaaaatacaaaaattagccaggcgtggtggtatctgcctgtaatcccaactactcgggaggctgagacaggagaatcacttgaacccaggaggtggaggttgcagtgagcccagatcgcaccattgcactccagcctgggcaataagagtgaaaatctgtctcaaaaaaaaaaaaaaaaaaaaaaaaagtgtgtccacgggaagacatggagattggctggagcactggcaaccagcccactggaattgatggtgccgaaggaaagcacaagaaaccatgtagaatgaggttggatccgccagggtgttcactaatgtatttgttgcccccacatttccagccatgtttaagacttctttcctgatcatatttgaagtgacatattgagagaatagatgaaacagttttacaaactgcctgggacataagagcaggtcaacaggtattgcttgtcttttaggatagaatccttattgtgagttatcaagtccccacatgaaacactaagaaatgattaaaagcacattcctggctgagcatggtggctcacgcctgtaatctcagcactttaggaggccgaggcaggtggatcacccaaggtcaggagttcaagaccagcctggccaacatggtgaaaccccgtctctacacaaaatacaaaaattagccagggcatgatggtgcatgcctgtaatcccagctactcaggaggctaaggcaggagaattgcttgaacccgggaggcagaggttgcagtgagccgagaccgcaccattgtacttcagcctgggcattgcagcgacactctgtctcaaaacaaacaaacaaaaatctgcattcctctatgccctccagtaagaaggaggcagccacagggtttgattatgacagtcacagtctattcagagttaggtttttggctcataggagtctccttatctagtactgtgtctggaatgaatgaactctggggtatatacgaatgattccaggctcagcagtaagtactggtaattagtgagctcctctttaagtgaattttgatcagaggtcccttcacatggattgtgtgttatgaaatgcctttgattatggggagatgacagagagccaaggaaagtcagtcagtccttgaccaaagcctttgtgagacctaaagagtgagagggaggcagaaagagcaagtgagcatgagacaaaaacaactgtagggtggggaagaggtgaaggaagagtggacacacacccatcggccagctctggctttaggatgctagccagtgtctcctaacccagggacctttcctttggagaccacagatgggacagagaaggaagtgattcttggtgttgagctcaaatagatacttaaaattatgtagactaaatcggataaaacttgaatcttcttttcccacttagatttggtttcaaaaccagataggacacctgaggctgagctggctgcagtgtggacgctcctcgggaggacagcagctccaaggacacgagaagcctcagccctgggccccaggtgagtccccagcagtgccagtgcacttcctcagtgcatctctttgaagtagaaacgtctctttaggctgtttccaaatttgttgcagagaatgctgatgtctcttccacagcacgccagtgttggagatgtgaccaccatccccacctcatgggaaggtagtttggaagaagggaaggccattgatcttccagtcctggtgtggcaggcagtgcagagtcctcttcttccagcactgcaagggtttaatccaaggtccaggatcagtgcatgaacacctcaggggcctgggagggagtaagcatggtgagaacaatatttgaaaatgtctgtcttagggttgatgtgaagatggcctgaaagccctcttttcttgtgttttcctacagaatgcttaaccaaaggagggagacaaaagtgatgccatcactaaaccacagacaggtgtcctccttcaagcttttcagaggaaccgattccctggaactgccatcaaggaagagctggcaaaacaaacaggcattccagaatccagaatctaggtaagttttctgtctgtggtgcacaatttgtcccataaatttggaagtggtattgcccgctgagatggtactagataaatgggagctggtatcttcaaagaagttgagagttctttgttatgagggtgctgtcatgtgtcttattcgtcttatgtcatatgtgccttatgtcttatgtgacctttatctccatcccaggcttctaggcactagacaccagtatagaccttgcccctcaactaacccccaggtgtgataatctaatagtctatggtctccacttttgtgggaaaatcttgccattctagcaaatcaatgtggcatccattcacgggccagtgcaatacttcccttaactcgtccatattttgcagactaaatgtacagacagaatcaccgagataaagcccaacagatgtcacttctgcctcacagatgagggaatgaagctggaacctcttacgtcttctgacatccttgtttccctttctcttagatgtgggctcagaactgaagagctcagcccccaggccagagcagaggcagccccgtgaattccctggcagccccagccacagaactcaccctactgctcagctgcagcacagcaacctgtgcattgcgcaagcagctctgcgcacaggcctccctccaactcccccagcagccattggtcatctgtaccagcccttcctccactaagcaggtctgtggaggctgtgtgagccaggcaccaagggccatcctgcaccagtccacctgagttgtgccaggagatctctcctctcaggacccatgtgtcaacaggaccaactcttggaggggtactctcacccacttagtctcgtttctggaatgtgtaccaaggaaattgccagaatgacaaggacagtgacagcactagcctgggagttctgcccttcaaggacactactcagcctccttctggtcatcctgagcaaggatcgcaacaacaaggtctgcaagacacagcccaccttaggcaatggtggccatgagcagccccagggtgtggtggtcaaattgccacctggggacagggtgctgctccacaacgtgctcacatggacacacctgcagcagcctagggcatggccaagcaaggggccacccctttcctttgagctttttttttttttgagacagagtttcgctctttctcccaggctggagtgcaatggcaccatctcggctcactgcaacctccacctcctgggttcaactgattctcctgcctcagcctcccgagtagctgggattacaggcacccaccaccatgtcctgctaaattttgtatttttagtagagacagggttttaccatgttggccaagctggtctcaaactcctgacctcaggcgatccacccaccttggcctcccaaagtgctgggactacaggcgtgagccattgtgcctggcctcacctcatcccttttagatgaactcctgacaacctcagagtttcagaaatcaccatcatcagttaggattaggacaggagaaccctccatggcctgcagccaggaagagtttcaggctctgctcgatgccctgcagagctcactagggcttcgggtttaggagggagaaggagtctttctcaccatcccatctggctcctcctcacgatgaagtagtagtgtgacccacaggaggataaacaaggggagacaccatgtcctgggacaagactaatgcaagaggaaactgaccacttggaaacccaaaaggagcatcttttctctgccttgtggacaccactttagtctctggcctcacttcatggcctacgtgattgtttctaagctccacactgtcctgcaggcaccacggacaccaggcagtggatacctttgctgaatcctaaggagccaaagtgtttttataatgaacacgacctccttcctgtgatcgtcacatcctgggcagtctggacaatgcacaaactagaactgaaccaaggtgaaaataggtaaaagagacacatccacacttcactacctttgatgagttcacagggtgagcctgaagacaggctaatgcagagaaaatgggggtgctatatttcatcttgatgtcggttcaccacaaagggtttgcatcttagttcttactggaggagatgggaactagaagttatctcactatctatctaccaatgattgataacaccagcttagatgcataatactgataatgaatagtgttcacatgtaatcctccctttaaacatgtagacagagaacatgacaaggaaatgcaaaacagcaactccatgaaatcactgaacaaagcaggatattcatcttctgacactgttagcattatgtatatatttacatgtaccttgctgccctttttgttataaataaattttttggcaagtttaagcctcttggttgtctttgtctgtgtctcctctcttccattcaagtggtacccatggattaccaagctatgtctgcttccattggtgccttaaaactatccttaaaaaggaaatgtgatttatcaagatggctgtctttcccacaattatttcattcatttgtgctgtctctttccatgtgaacctgtgggaccagagtcaggatgccttgctctagttcatagcttgaatctgcagatgccagtctgttattactacacacagacacagatgcattttgctttacggtttctctagggtgtgcatactccaaacccactgtttacttccagatgatcggcacaggataattttcctcagatttttttttttttttttttttgagacggagtctcgctctgtcatccaggctggagtgcagtggcaccatctcagctcactgcaagctccgcctcccaggttcacgccattctcctgcctcagcctcccgagtagctcgggctacaggtgcctgccaccacgcctggctttttgtatttttagtagagacggggtttcaccgtgttagccaggatggtctcgatctcctgacctcatgatctgcctgcctcatcctcccagagtgctgggattacaggcatgagccacagcacccagccttttgtttttcaaagagacgaagtctcactctgtcacccaggctggagtgcagtggcaccaccgtagctcactgcagccttgaattcccgggctcaatccaaccttcagattaactattaactggggtattataaatctctctcccagccccacctcacatacacataggctgcatgcaaacacacacacacagtcataatagtctcacagtttcccctgaaaataatctgacaaatgtcttaagcagcattgggaccatgccattaggtgttgagtttgattttttcagtagcctcccaacatattcctcatgtgcagagatgagagtgtagcatggccaaatgccaaatttccaagagacattttgtcttcatccatttgtgtgaaccatgtactataacaaaccacctgagactaggtcgtttataagcaatagaaatttacctctcacatctctggaggcagggaagtccaagatgaaagtgccaagatgaaaggtgagtatccagtagggacaaggtctcggcttccaaggcagcccctccttgctgtttcctcttgaggggagtgacactgggccctcacatgtcagaaaggagaggggcaaaaagggcctagtgtgttctctccagctggctcctaagatcactaatcattcatgaggtggagttctcatgaccttaccacctcccaaaggccaaacctttgcaagctgttgcactgaggattcagtttcaacatgacttgctttttgttttgttttgttttgagatggagtcttgctctcttgcccaagctggagtgcagtggcgccaacttggctcactgcaacatccgcctcctggattcaagtgattctcctgccttagcctcctgagtagctgggattacaggtgcccacaacacccagctaatttttgtatttttagtagagacggggtttcaccatattggccaggctgatcttgaactcctgacctcaagtgatcctcccgccccagcctcccaaaatgctgggacttgtgcttggcctcccaaagtgctgggatttgttcttggcttctcaaagtgctgcgatttgttgagccactgcacctggcctcaacatgacttttggaggggacacaaacactcaaagcacagtggatgtcacagtcactctccctatgataatggtaatgtcatatattctgtggctcaggtgcaggccatcaggccccgtgattccaaaattcaccctgtggcatgttggcaagtatcagtgccaggccatgctcaggcacactggcgagggttttgtattgggagagcagaagagttacttcctctggtaatctggggagaactggtacctttttctcttctcatcagcacctggaccatgggccaccatgcatgtgcatcttgacattcttaggggtcaggaaatcatgtgtagtggcagcaagtgaaggcgcagcacagggtgcaggtactacccctcctgaatgcctccttaggcaactggagtgccacactcacctctctcagttgtctcctgcctttccacaaacctcacaataggccatctgcatgcacaacccaggggtgtgcaataacaaacaatagtctatagggatgttccatgcagccagtgataatcagagagctccagccagtcctttggaaagtggggctcaagtgctgatcagtttgtgtgcagtgtggtcactacctttacaggtgggagcctcagagaccacctgccaaacaggctgagcccaagtcaagtcatgcagggatacagccaatgggagagcactcttgtcctgcacacaagagcattttaggatgggaagagatgtgacactcacctcccctaagaaaagtgcattacagcacaggccaagtgcaaacctgccagcaactggtggttctgtccaagaagcctttgccataatatggaacctgtcagttagccaagagcagttagttaaaattggactagacgaccctggctttggatgggccatcctgtttatgccagtggttgtaactgcttccttttcaccctgatggtgaagatgggattccccactctgatgctatagaaaggttgaacactgaatacccgacactggacagataagatctaggtgagtttgtcagtcacaccaactctcagaaaggtgaggaggacaccacatgccgggcagagccacaaagggttccacttgggagcaaagtggaaaagaaggggttgtagtgagcagctgtactatccagagagtacagtgaccactgtttgctgtgggaggatgtgaggggtttggtgaataattccaagagctggtagggaagcagatcttactgcttaggaataagcaggaactgtgcctggcccccctgacagggaggactgtctgctaaggtacctcacctgtggaagcagagtggggatggaaacgagtttaggtcatttgaggtccttttggcttcagatgtcaagagaaccaagaatactagtccttaatttcaggtcacagttaccataatttaaaatatatcaaggatgtataaaagcaattcaaatgttcattaacggtgatttacaggttcagtcagaaacacacgactaacaaaagaacaccttagtacagaaacaagatgttcctcagggttggttggttatttacttatttatttacttaatacacttcattttttagagcagctttagggttacagaaaaattgagcaaaaagtacagagaattctcatataaacctttaaccctcccatcctccacaggctccccaattattaacatcttgcatcattatggttcatttgttacaattgatgagccaatagtggtacactgttattaactgaagtccagagttgacactagggtttactctgtgttttccgttcactgttttccattctctgcattttgacaaattacagtaccctacagagtactttcactgtcctaaaaatcacctacctgccatccctcctttcccctcaactctcagcaaccactggtcctttgactcgctcgatagttttgcctctcccagaatgtcatataattgcaatcatacaacatagaaagccttttcagattggttttcacttaacaataagcatttagggttcctatatgtcttttaatgacttgatgtctaattcttttttatcatatacctgaggactacattctacaaccctgctataattgcttattaatgtcagcaggtttttgttatttagaattttctacaaagacaatcatgttatttgagaacaaagacagttgtatttcctccttccaaatttatgtgcattttatttcctttttttttggtatcactgcattagatagcacttccagtacaatgctgaaaagcagtggtgttccttgccatgttcctgatcttagtaggaaagcatttagttggaaacatcaaggatgatgctagatgtagggttttttgtagtagttctttatcaaattgagtaagttctcctgtattccttctgtgttgagaggttttatcatgaatggatattggattttgtcaaatgctttttctgtacctattgatatgatcatatttaatctttgaactgctaatgcatgcaatggattgcactgaatatcaaatgttgaacaaggcttgcattcctgatttgctaacattttaaggatttctgcatctgtgttcactggaaatattgatctgtagttttcctttcttgtaatgtttttgcctggctttggtattagggtaatcctggcctcacaaaatgatttgggaagtgttatccctgcttttattttctgaaagagacagtacagacttggtatcatttctaccttaagtatctcgaaaaatgcacatcagtgaatccatttggtcccggcactttttttggaaggttttattattattaattttattgagatggagtctcactctgtcacccaggctggagtacagtggcacaatcttggctcactgcaacctccacctcccaggttcaagtgattcttctgcctcagcctcctgagtagcttggactatacacgcatgccaccacgcccggctaactttttgtatttttagccaccgcgcctggtcttggaaggttattaattactgcttcaatttatttaatagatatatatgcctactgagatctaccttttatgagctttgagagaatgcatcttgcaaggaattgatccattttagctaagttatcaaatttatggacagagttgtccatatttctttctaatccttttggtgaccataggatcagctatgatggcctctttcacttttggtattagcagtatttgtcttctgttttttcttaatctagctagaggtttatcaattttacccaccttttcaaagaacagttttgggttttattgattttctcttttcaatttcactgatttttactctaatttttttccaggttactttggatttaatttgctcttctttttctagttttccaaagtggaagcttagattacttgtgtaatctagggtcaccagactgtaaaatcttagattatttgtatgatctgatcatgtaatgtagtgtacaatcttcacactgtcaataaaagccccatgccagcttgattctggctcttctccagcctcaaccctcctcttcatattctcaaaagtctctgaaggcccagatccctgtctgggtacaatgagcaatgaaatgacagtccaacagccctgggcagcaactgggctgtatgtgtgggcctctttccagggccctgtcttggagagcagctgcttaaagaaaatttggactatcacttacgctgaaggctggagtgttcacatatgtaccccaggcagttcatggcatgggatgagccacaggtagtaagagaaagggagtaacatggaggcaggcctagatcttcacacgtacaggatagattttttttcagataatctgttattttgatttataacttttaaatggataaacattagctctgtgggtctctatttaaattgtttcaggacacgacaaacacctgggatgggcctgatgaagtaaccactactaaattaggatacctacttcctattcacaattacgttaaataccattatgcatatgaaacacacgatttatatcacataccacttgtacatatgtaagtcctatgaacttcagggataattcacagatgtgcttaatgctgttgccctgattattcaatttatctatgctttacaaaaagcttcatagtcaagtggatgccagggacagggatgcagaaagggtgtggttattaatacaacaagggaactacttgaggctaaatcctgattcctttgtaatcctgaaacagtacagatctcagactccttttccattctgtaaactaattgtgttgatggttactcaaatgtaaaagtaccagtttgttataaccacacacacacacatacacgtacacacacagagtgcacgcaaaccatagcaaaatctgagtaagtctgcatctactagcaaggtaacatcgatttcttggacttgaccatatactatgattatatattatccttagaggaagcttggtgaagggtacacgggaattctctgtactcattacaacttcttgtgaggttattttaattattacttcttaaaaaattcttaaagctttacattccacaatgtacatctataaattattgttagataccttaaaaactattatggcatcaaactcaaaacagaacttgtcatattttatttctaagcaaaattttcactttagatttcttaaattgacaattttctcctcagtgtaaatgctaacataatcctatttgtagttttgccaaaaactttcacaaattcaaaaaaatctgtgaggttttatgccagtattaaccatctgatattcaacagaatatcacttcctaacaaaagccatcctatagttgttgtagtctatgggtttatcccctactgttactttggagtaacataaggcgagtttgtggatagttattgaacattcaggatgtcaacaggcccttctccacagtgtgaagactctgaggcattatggaggctgacttgtggctggaaatttctaatatccaattcattcataaggtttttctcctatgtgtgttctctgatgtacaatgagatttgacttttgagagaaggttttcctgcatgtgttacattcatagggcttttcccctgtatgtgatctctgatgtttagcaaggtctgatttacggtaaaagatttttccacattcattacactgacaagatttctctcctgtgtgagccctgtgatgtactgtgagtgatgatttgtgactgaaggatttcccacattcattgcattcatagggtttctcccccgtgtgctttctctcatgtaaaataagtcctgacttcacacagaaagattttccacattcgttacatttataaggcttttcttgtgtatgggttctctgatgtacaattagagctgacttatggcagaaagcttttccacactcattacattcatagggtttctcccctatgtgaattctctgatgctgagtgagttgtgacttctggcagaaggtttttccacattcattacattcatagggtttctcccctgtatgtgttctattatgttttgttaggtatgatttattgtaaaagatttttccacattcatgacattcatagggtttctcccccgtgtgtgttctataatgttgagagagggttgacttatggctaaagaatttcccacattcaggacatgcaaagggtttctcccctgtgtgcgttctctgatgtattgtgaggtctgacttcaagcagaaggttttcccacattcataacattcataaggtttcaaccctgtatgaattatctgatgcctggtgagtactgacttgtggtagaaagttttcccacatgcattacattcataaggtttatctcctatgtgagttctctgatgctgtgtaagatgtgacttttgacaaaaggatttcccacactcaagacattcaaaaggtttctcacctgtgtgagttctctggtgtactgtaaggtgtgaattcatacagaaggattttccacattcataacattcatagggtttctgccctgtgtgtgttctctgatgtttagtgaggtcagatttctggtaaaaagttttcccacatgcattacactgatagggtttctcccctgtatgtgttctctggtgtaatgtgagggctgacttatggctaaaggctttcccacattcattgcattcaaaaggtttctcccctgtgtgtgatctctgatgtttagtgaggtttgacttctcccagaaagtttttccacattgattacattgaaagtgtttctctcctgtgtgcaccctctgatgtcgagtgagatgtgacttctcccagaaagctttcccacattcattacattcaaagtgtttctctcctttatcacctttctgaagctgtgacagacacaatttcctcctgaaattattcccactttcaccacaatcatagtgtttcacaggtaccccatcatgtttagaaagggtggacttcacacataagaacttctcacaatcactaaattcatagtgactgtcctttgatggaggtatctgatggaacaagagggatgaactatcacagaaagttctcccaaattcattatagtcacagttattctcttctgcattctctctcttccgtgtattgaatactgccttttcaaggagggtttcctgacatatactgtattcaaaattgtggtctaaagtttgaatcttctcatgctgcaaagtgttctcacgatgactcagagtgttcctatttttcaaaacttcatttttctctcgagtatgagtttcatcatgcttaatattgagtaacaatttcccacatgcattaaattcgtcagacttttttcctaaatagtttatcttactgataaccaattctgaaacagtgttgaaactcattccacgtgagtcatactgacagaacatttttctggaaggaaaagaacttacgtccatgttaaatggtattcctattacattaccttgttccttagtcagcatttcattattgatgaatacaacttcccacaaatgtttagattgattttcttggctcctctctttcaggtgatcagctgtccagacttctacaaacaaacaaaattaatcttaccatataaataccaaaacatctcttagggaatgaaatctctacacaaatgccctatgttgtagctgactctggttttttggccaatttccagagatgaacataattgcaagtgcatatttttttgtatttcatgagtttggagtgaaaaaacaaaaacaaaaaccagaaacaaaaggcctaggctagtggaaaaacagagaggaaattaactatctgaatgcacacacttggtttctaatgtaagaagaataatagcaactgcttacatctgcatttccccatgcatctccccaagaactataaaggtcagcataagtggagcaaataatattatctataacaacccatgactttagcataactaggagatggagaatattactcatttcaaatcaccactatgcaatagatattcaaatacagcaaaaagtgacagcccatgcctacaaagagagtcagccagagactgtggtgatcacatggaatagaggagacagacagcccagagaggatgaaacacaaaactactcccagaaagggaaagttttactatgagtgagaaaatgctcagaagatgtctgaattcacatagattaaagctcaggctactgggaaatccaagagaagagacttggattgtatgtaaactaaagaggcaaagggtaatcaaactcaggaatgaagttgtaaagaggacagagtaatcacagaaaataagacttgtaattcaagtcttattaaagacttattaaagacattccttattaaggaatctgtcatggactaaactgtgccccccaaaaatgtgtatgttaaaaccccaacctccagtgtgactgtatttgaagatggggactttaaggagattaactaaggtttaatggggtcataagggtaagactaatacaatggcattcatgtccttataagaagaggaggagactggaaagcacatgcatgaactctctttctccccctgcccaccacacccgaccactggtcatatgcacagagaaaaggctgtgtaaggacaccagaagaaaatgccatctgcaaaccaaggagtgagaactcaccagaaaccaacgctgttgtcaccttgactttagaattacagcttccacaattgtgagaaaatttatttaagctacccagtctgttgaattttgttacagcagcctgagtaaagtaaaaaagagccaaaggggaaactacacttgactgaaacttgaataaacagcattgtaaaggagaatgaaacagaaaaaagagaagaaacaataattttaaaagagtaagaaaaaagaaaattggatcagaaagaaagttctggataaagctggtctacaattaaataaataaaattataatatagtatatatgttattgcagtccttaaagaagaaaaaagaaaacaatggaataaatctaatattagaaagtataatctaagaaaactgtccaaaactaaaagacctgatccatgatggttcctattcaaaagaaccatcatgaacctgggaaaactgttcagcaacagttttctctaaaacatatcttaataaaactactagatgttaaaattgaagaaaaagtactctggacaaaaagaccaagtctcagcaaacttttactttgataatgagtcttgaaatcaggtaatgttatacatatgactcagcttttatttttcaaagttttagttattgtagttcctgtgtatttccacataaggtttagaattacatactcaattactacaagaaatcctgctaattactacatggaattatattattttaaatctataagtcattttaatgacaaaacatgtcagcaatattgagctttctgacataagcagggagttccacttgtttaggtcttcaatttctctctgcagtggattattgtttctagtgtggtctttcacatcttttgccagacatagctgtaaaaaaaaatttttgatactattgcaaatagaacttttaaaaattgcaatttccaattgatcatttcttatagaagattcatttttacatatttttctcctgtcacctagctacacttaataattctagtcattctttttcccatatcttgggagactccattagatttcctacgtagataatcatatcttttgtgaataaagacatttctacttcttttccactctagtctcctttctttttcttccttggttatactagatagcatatattatactatcaggtatgagtgtacatccttgtcatgtttctgatattggaaagaaatcattccatttttcacaattatatacaatgtcaattgtacattttctatagatgacttttattaaagaaagttatcttctattcttcatttgagagttttaatcagaaatggatgctaaattttgtcaaatgctttctcgcatatgttgaaatggtcatacgggtttgactttttttctctttttttcattttaatacagggcagagatgactacataattgatggggccagtgcaaaataaaaatgtgaggtcagttactcagaatgtataaaaagaagtatagtaaaaagtaaaataaattatgcttttttcctttaacatattttactacttgtaaaatgtaataggtataatagtaacataaaacaacataaatttacaaatcacaaaaaacagttttgttgtaataaactttaaataatacaataattactaatagtttgttaatatgataccttgattgatcataagattttctggcactctttttgcaaattcatttattaagtcatcgaaatttatatttttagcaacttcattttcaatatataattgaaagtaacatgtattcttggcaaatgcaagataagtaatttttgctaatttttaattttgagaaggttgatttttcagctgatgcaatcattagggacctgttggttctttatacattgtgacaatatgggctaaatttctgatttctgatatattactgcacaataaaagttaaaaaaatacaagttttggtatatatagacaaagactggagtagcacttctctgcaattaattcttcatgaatgttagttttgtacaaaactgaattcaattttacatataaatttatacaatggcattttaatgtttcctctgacatttcctacatcttgtacaagaaaccaaaaatggcttcatgatttgcatataattggaaacacctgtttatgcagtatattgctgtattttcaaatgcaaaaaaaaccctatttttaaagttgacttctttgttaatacttgattcatccaaaattttaaatgaaaataatgttctctcccatcaaatgaaattcctatttctaagcctgtggatatttgctttgcaatgttgcagcagttcttaacaccagagaatctacactccaaagaattctagtaactgcctagtgtgccttaacacaatgtccacaagtatgcttttattttctaatactttactgaccatgatgactgcctgaaagctggaggttactgtcccagtactcagcccagaaaattagtatttcctaagaatggcagagggacagacttaggggagagacaaaccagcctcacgctgtgggtcctctctgggttgcaaatgttcatgagtttgctgctgctgcaaccaatgcagacaaaggtcatggccttggccacccacacacaattccagaacactcccaggccatactacacagaccaacagcttagtagggcactgcctctcaagtatcctgtctacttgcacacatagtccagtgtccatcagacttcacatacaaatcacgagttcaaagataaaactgtgaagaacttcaagatggcaacagcagggcattaagtgaagtacaggatcccttcttacaagagtgtagcaacgtgtgactgcacaggtcacctagccatgaagttggccgagatacagggaattacactgactgcttttcaaatgttgaaaaagcctgccagggattaaccacacttggtcatgaggtattaataaccttgttatataccactggtttctaatcactagtgtttttgaatttatgttcatgaaggacactggtctacagctttctttccttgcaatgtctctgtctggttttgttattagggcaatgctggactcaaagaatgatttaggaagtattccctcttcttgaattttctggaaaagtctttataaattggtactattaattgtttgctggaattcactactgaagcatctagggacctggggttttctttgtggaaaggttatctatttgttttggagcaagccgtaatagctgtttatttgaatgaaactgttcatttcatcaaaatcgtcaaactgataatttacaggtatagtattccctcacttccttcataatatctatagaatcttcagtgatacatcattcttatttttgatattgataatctgttccacctagaagtttatccattttatcgatcttctcaatgaaacagcttttggtttcaccgattttctcaactgtttttctggttctacagattatattgttctccattttgttttttattatttcctttcttctactattatatggatttgtcttcttttctacattctcaaagtggaattagctaagaccattgatttagacctttcttcttatccaacacaagttaaacttcatacatgtgtatattacatatatacatatgtatattacatatatacatatgtataaatgcatacacatgaaattccctctatgtgaaatttacacattatatatttaatatatattacacataatacattatatcccatatatgacaaacgtcatatatgcatttacatattgtggaaacttcatatatgcatttacatatggtggatatatatgcacacaatacaaacacacacaatgcttatttgtgtcgcataagaaagatctcaaatcaatgacctcaggtgcttctaccttaaaaagctacaaaaaagcaaattaaacccaaaagtaagtagcaaaaaggactaaggatcaaaatggaaaacaatgaaatcaatgagtattgtatgtattttatatttcctatgaatttcctatatgtaaatttcccataaattccattttcattaacccaaagttcaaaacactttctaatttcctcttcgaattcttctttgaagcatccattacatagacttatattcagtttccaactattagggatttaatagatacttctgttattgatgtttaatttaactaaatttaaaccccttatggtgggagaaaatactctatatgacttcaatccttttatatttattaagatttgctttacaatcaggatgtgatttacctttgttaatatattcgttcatctgcccttgaaaagaatgtatattccactgttttatttggggaggagtgtgcagaagaatattttataaatgtcaattaagttatttagggttaagtctattatatctttgctccttttccatttcctgttttattaattattaaaaggatgctaaagcctctgattataactgtggatctatttctccttccagatctatcagattttgcttcaaatattttgcaaatctgttactaagtttaggattgttaaatcctcttgatgaaatgatctctatcaatatgaaaaaaaatctttatcactggtattcctggctctgaaagctacttcatctggctgtcacagcactgcagccttgtgaataattttaccattctacatcttttcccattctttttgtttatctatttgtctttgaatctaacatgtttcctttataggcagcatgattggatcttatttttatttatcttatccagaaatctctgcctttaaatggggtgttatataccatttatattttctgtgatcatcaatgtttataaaagctttaatcagtgtacttttcagtaacagtatatatatgaatcttccaatagtatatactttacttctttttcatagccttttcaggctgtgattgtcatgtattttcaatatatgttataaaccccacaatacatttgatgttatttttgtataaagtcaatatcctttttagagacttacataaagaaaaatatcttgtatacatatccaagtagtcaacatttcctgttcttcatccccctgagtagatccagatttccatcagacatcagaacatgtcttgtgatgcaggtctgctggagaggaaatctttcagctttgtttaactggaatgtccttatttcttcactgtttcttatagctatttttaccaagtatataactctacattgagatttttgcttttaaaaccaaaaataatgttctactattttctctgttgcctcatttaaggagaaatctgttatcatccttgcctttgttcctccataaaacatgtcctttatctctggctgctttgaggacttcattttaacactgatttagagcattctggttatgattcatgtggcttggtgtagttttcttcatgcctcttgtgctcagggtttgacgagcttcttagatcggtaggttcccaacacatttggaaattttttcattattctcaaaatactgttttctgttcttttcccactttccttttagagactccaattccatgtgtgttaagagactacctgaagtcctgaagttctcctaaagctcacatgggcttgtttttttttttttttttttttttttgagacacagtctcactgtcaccaggctggagtgcagtggtgcaatctcagcctcactgcaacttctgcctcccatgttcaggtgattctcctgcctcagcctcctgagtagctgggactacaggtgcctgccaccacacccggctaatttttgtatttttagtagagacagggttttgccacgttcgccaagatagtctggatcccttgatctcgtgatccacccaccttggcttctcaaagtgctgggattacaggcatgagccactgcaactggcccaagggcttgcttatttttcaaatatgctttttctctgtttcatttgtatggcttctattactgtgtttttaagttcaataatcttattcttctgcaatctttgaactgccattaattcttgctctatgtgatattcttttttttttttttttttttttggggggagacagggtctcactccatcacccaggctgcagtgcagaggtgcaatcttggctcactgaaacacccacctcccaaggctcaagtgatcctcccacctcagcctcccaagtagctaggacaacaggcatgcaccaccacacccagctaatttttttgttgtttcatttttggtacagatgaggtttcatcatgttgcccaggctggtctcgaactcctgagctcaggagatccacctgccttggcctcccaaagtgctggcattacaggtgtgagacaccaatgactggccatgtatttttcatctcaagcattatagttttcatttctggaaatctgatttctatcttttctgttacactgaattttgatttgtttttttttttttaatcttctgtgtctctacttaagttttagaacatatggaaccaaattatagcactgttttcaatgaacctgtcagttaattctaatatctatggcaattctgagtccatttcaatttcctggttagtctctttgagaaagctcatgttttcccatatgtctgtaagtctggaaatatttcaatggatggaagactgagagttttacttggttggatgctgggtacttttggcttcctataagtatttttgtgctttgttctaggatgcacttaagtcacttggaaacaatgtgacactttcaggtcttgcttttatgatttcttaggcaaatctggagcagtgctcagtttggggcacattactcctcaccacggagaaaagacctttctgaacactctacccaatactctgaattatgagtttttccacgctggctggcaggatcagtccttctccaggccctatgtgagtactgtgtactgttccctctgattcttttcaaaagttatttcactcatttcctcatatacatgagctgattagtactttgctgaacattcatggaggcccctttacagatctccaggcctctctctgtgtgcatctatctcctgcaagccaccagtgctcctcaacccccacagcttcaaattctaggaaagaactgccaaaaggccttgagccagcttcctccaccaccccaattaaaatatccagcccagtcatggcagtctgagaatagtggagtacaatgcctacctaggtcattgagaagagattccaaaagaaaccaagaagaccagagactactgccccaatccagatccctgatcataaagcacagtatcacccacccagagaaaagcaaaacactgctgtagcctccagatcccgaataatggagcaggactctcacctagggccagctgtaaggacagagagttccaaaactctcctccagaaaactcactttgttcagaacagagtttgggtgagtgcaagcctaagatcaccctcaaaaagaatggaaattcaatgataaccaattaagaagagggtagcagttctatgacagcaacaagctaaaccacagaccaactgaaagtttactggagagagcaagggaaagagatgcctaagaagagacatccagggcaattagatgtcttcctatctaccagaaacactcatacaaatacatacacagattttccacagtcatgatttttaaatttatgttttctaggaggtgactttcagaatggcaacataaaaagcaaactcaaagcctcaaagacagccctctagaaggaacccaaatttaacaagagcaaactaagagcaacatatggtccaggacagtgttgaaaacaatagagcaatatgtcagcaatcagtagcggctatcagcaaagtgtaacagcaacagaggcagacaggctaacacagcaatcacagaaagattcactcaaagagagcactgttaacaccactgccatgctaaagatagtgtgcatttctaaggcagggccctctgacaagcatcatcagtgagaacccaatgggagtgaaaaagcttctctcaaatagtagtcaagttgcctaaataaataagaaacaacaacaagccctagagagaatagaggaatcagtatctagagaaagtacaaagtattctctacaatgtctattcttcaacaaaaaaattacaacacatacaaagaaacaggagactgtcatctatatacaggaaaaatggcaggcaacagcaactgcccttgagaagatccagatatcagacttagctgacctcaaagcacttattttaaatatgttcaggccaggtgcagtggctcacgcctgtaatcccaatactttgggaggttgaggcaggtggatcacctgaggtcaggagttcaagaccaacctggccaacatggtaaaaccctgtctctactaaaaatacaaaaattagctgggtgtggtggccagcacttgtaatcccagctactctggaggctgaggcaagagaatggcttgaacctgggaggcagaggttgcagtgagctgacatcatgcctctgaactccagcctgggtgacacagcaagactgtatcaaaattaaaaataaaaataaaaataaatatgttcataaggaaacactatttagaaaagggaggtatgatgatgtctcatcaaacagaaaaatattagtaagaagacagaaaagaatacaatgaaaattctggattcaaaaattataactgcaatggaaaactcactagaatgactcaacaaaagacttggccaggtggggtggctcacgcctgtaatcccagcactctgggaggccaaggcaagcaaatcacctgacgtctaggagttcgagaccagcctgaccaacatggtgaaaccccggggtctctactaaaaatacaaaaaagttagctgagtgtggtagtgcacatacctataatcccagctactctggaggctgaggcaggagaatcgcttgaccccatgaggcagaggttgcagcgagatgagatagtgccactgcactccagcttgggcaacaagagtgaaatttcatctcaaaaaaaaaaaaagaaagaaaagagaggttgtagctggcaaaataatcagtaaacttgaagatggatcaatagagattaagtaatctgaagaacagagagaaataagagtgaggaaaaatgaagaaaccctcaaaaaatgaggaataccattaactacaccaatatattcataatagaagtaccagaaggaggggaaaaatatcaagtagcagaaaaaatattcaaacgaatggctatgctcaccttgcaacacatacactaaaactggaacaataccaagaagattagcacagtagctacacaagaaagacagagaagttcatgaagtgctgcattaaatttaaaaaaaaaaaaaaaaaaagaggccaaaaacttgcaaatctgttgacgaagagaaaatcctgaaagcatcaagagaaatacaactcctcacatgaagggaatgtcctaagattaacatatgacttctcttcagagacagtagaggccagaaggaggcaggatgacatattcagtgtactgaaaaaaaatttttgttaataacttgtcacctaaaatagcagaactatttgcaaaacagagggtgaaaatttaaaatcctcaaattaaaaaacaaatagaaaccaaaaaaacttgagaatccattgctagtagactaacaataaaagaaagaaaagaagttctttagggtgaaaacaagtgactccaaacactagatcaaatccacaattattgtgggtaaaggcaatgatacgagagagtaaaaaaggcacactttttctcctttcttttcctacccaatttaataagcaaatatgtataagtcaatgtttataattgtattgttggacctataacatatagaaatgcaatatatttaacaataaggcaggctaggcatggtggctcacgccagtaatcccaacactttgggaggctgaagcaggagaatcacttaaacccaggagttcaagatcagcttaggcaacatactgagaccctatctctaaaaaaaaatgtgtttaattacccgggcatagtggcacacacctatagtctcagctactcaggaggctgaggtgggagtattgtttgagtccaggaggttgaggctgcaatgagctgcgattctaccactgcactccagcctcaaggactcagagagaccctgtttcaaaaaaaagaaatacattgataaacaaggaaacaaataataaagcaaaaaaaaaaaaagaataaagcaaaaaaaataagcagagcagctgggtgtggtggctcatgcctgtaatcccagcacttcgggaggccaaggcgggcagatcatctgtggtcaggggttcgtgaccagcctagctaacatgatgaaaccccatctctactaaaaacacaaaaattagctgggtgtggtggcgcatgcctgtaatcctagcaactcgggaggctgagacagaagaatcacttgaacccaggagacaggggttacagtgagcccagatcgtgccactgcactccagcctgggcaacaaagcgagactccatctcagggggaaaaaaaataggtacagatctgtactggagtaaggaaattacactagatgttaagtctgaatccacacaaacaaatgaattaaagcagaaatgaagaataaggttagtataccaaactctacaaatagatacttcctatctttctttcagcttctttaaaagacatcaacacatgaacacagggaggggaacaacacacactggggcctattgaggggttgggggcaaggggaagaaacttaagaggatgggtcaaccaccatggcacacatatacctatgtaacaaacctccatgttctgcacatgtatcacagaacttaaagtaaaaaaaaaaaaaaaagacatcaaatgacataaagttacaattacaggttgagtatctcttatctgaaatgcttggcatcaaaagtgtttctgactttagagttttttccaaattttggaatatttacattatacttactggttgagcttcccaaatccagaaatctaaaatctgaaatgctccaacaagcatttcctttgagcatgttgagcatgttggcactcagtttcagattttggagcatttgagattttcagatttgggatgctcagcctgtataacaatgtattgttgggttttaaatatatatgcaatatatataaaaataacaaatggagaagaggaaatagagctatatataggtaatgtttctgtattttactagagttaaggtagtagaaatctgaagtagattttgataaggtaagatttattaggtaagttctagagcaaccactaggtaaataaattttcaaagagacatagtaattttaaaaattaaaacgttatactaaaatatattcatttcacgttgtgtacacataaacaaacatagagagtggaatgagagacactggagacttggaggggtggggaggtgggtgaaggataagaaattacctgatgggtgcaatgtatactattatgctgatggccacactaaaagcccagacttcatctctatgtgatatgtctgggtaacaaaactgcacttgtaccctcaaaacctataaaaataataaaatatattcatgtcatgtaaaagaaagcagaaataaaaggaatagagtatcaaaaaagcacgagaccgaaaacaaaaatggcagaggtaaatccaactacagatgctccttgacttatgatcaagttacatcctgataatagtcaaattagttgaaaatattgtttttccacttaaaatgggaacacattctagtaaagtcagaaaaaatagttaagttgaacctttgtaaatcctgaaaatacaaaggggtttcaaacccaataaacccattgaaaagttaaaaaatcataagtcaaaccattgtaagtcaggaaccatctgtatagcaataacgacaggaaaaagggaatgatttgaaaatccaatcaaaaagcaacaattctcaggttgttgaaagtgtgaaagtccaaacatgtgctatctataagagatagatacaaacaggttgaaaatttgaaaacagaaaaagatatatcaggcacatggcaccaataaggctggagtagctatcctaatatcacacaaaatacactttaacacaaaaattttactaaggataaagaggggaattttattaatataacaataaaagggtcaatcgataaaggagacataacaattctaagcatatatactactaacagagcctcaaagtacgcgtagcaaaaactgacagaattaaaagaaaaaatacacaagtctatgatactaattgcaaactgtaataacccattttcaataatggttaggacaactgggcacaatataaacatggaaacagaagatatagatgacactctaaagcaaccagatctaagagatatagacagaacattccacttgaaaacagtggaacaggtattctttaaaagtacacatgaaacattccccagaataaatttaaaacgattctctgaccacagtggaaattacaaatcagtaagacaaaggaattttgagaatgcacaaacatgcacaaattatataatacattccaaagttaaaaaaaaagtcaaagaagcaataagaaggcaaattagaaaaaatgctatgaggtaaaaatgaagacatactcaaacttatggaacacagataaagcaatgcttagagagagatttgtagctgtaataaccatattaaaaaagatctcaaatcaataaactaattttccaccttaaaacactggacaggagcagcaatacaaactcaaagcaagaagaaggcaggaaggaaagcagaaagattatagagtaaaaattagtgaactagagaacagaaaaatagcagattcctggaaaagatcaacaaaatatacaaacctctaattagactgacaatggaaaaaaaaaaaaagaagattcaaattactaaatgtagggattaacgatgtattactagtactcttacagaaataaaaataattacaaagaatggtatgaacaatgtatgtcaacaaattatttaacttcaacaaaatggaaaaatccataaaacaaaaacgactaaaaccaactcaagaagaaaaagaaaaatctgaaatgacctacacaagtaaaaagattgaagttgtaaatttaaaactcgccattacaggtgggatgcagtggctcatgcctgtaatcctacaactttgggaggccaaggcaggcagatcacttgaactcaggagtttgagaccagcccaggcaacatggtgaaaccccctctctataaaaaaattacaaaaaattagctgcatgtggtggcatatgcctgtagtcccagctacttgggaggctgaggtgggaaaattgcctgagcctgggaagtcaggctgcagtgagccatgactgcaccactgcactccagcctgggcaatatagtgaggctctgtctcaaaaaagacaaaaaacaaacaagaaaacttcccattacaaaaacaaaaacaaaacccaggtccatatggttcactggagaattttatcaaacatttaaaaagaagtatcaattactcaaaaactccaagaaaataagaagaaacacttgccagctcattctatgatcccattactaccctggtaccaaaatcagacatgaaaaaactacaaatgcatgtgtcatgattacagacctataaatcctcaacaaaatactagcaaatttcatctagtagtatataaaaaggattacatacaatgatcaaaggggatttatactagtaaggcaagtttggtttatcatttgaaaatcaactaatacatcacataagcagaaaagaaacaataaccacatgatcatctcagtatacagagaaaaagcatttaacacaatccaatgcccatcttctctataaaaacaatcaacaaaccaggaatacagttaaacttcctgagcctgattaaaggcatctacaaaaagtccaccactaacatcatactaaataatgaaaggtacaatgattttactctaagaacaaaaacaagataagaatgccttcttgccagttacacatcacacagcagattgtagtcaacacaagcaaggggaaggggaattcagattgaaaaaaaaaagtggaactatatgtatttgcagttgactgctcatgcatatagagaatcttaaagaatctactaaaacactattaaaactaataaaagagttcaacaatgttgtagggtgcaagttcactaacaacaaacaaatcataaatgaaattttaaaaagaattccggccaggcataatggctcaagcctgtaatcccagcactttggaatgccgaggtggctggatcacctgatgtcaggaggttgagaccagcccggccaacatggtgaaaccctgtctctactaaaaatacaaaaaagttagccaggcatgatggcatgtgcctgtagtcctagctacttgggaggctgagacagcagaatcgcttgaatcccagaagcagaggttgcagtgagccaagatcgcgccattgcactccaccctgggcaataagagcaaaactctgtttcaataaataaataaataagtaaattccatttacaatagcatcaaaaagaataaaatacttgtaactttaatcaaggaaatacagagcttgtagtctgaaaaccacaaaacaatgatggaagtaattaaagacagcctaaataaatggaaaggcactgaattgcattcatatggttaagatggcaataactgccaaattaatatctaaattcaacacaatccttaccaaaatcccatctgcctttttgaggaaactaacaagctggtctaaaatttcatgtggaaatttagggagctgaatataatcaaaacaatctttaaaaagaagtagaaagttagaagacatacacttctcaatttgaaaatttgctacaaaattacaataatcaagatggcatgatagtggcatagaggtaaacatgtgaaataaaattgagaattcataaataaacactacaatatattatgttcagttaattttcaacaatgatgccaagaaaacttaatgctgaaaaatcccctttttggctggtcgtggtagctcacgcctgtaatcctagcaatttgggaggctgaggcaggcagatcacaaggtcaggagttcgagcctggccaatatggtgaaatcccatctctactaaaaatacaaaaaaaattagccaagtgtggtggcacatgcctgtaatcctagctacttgggaggctgaggcaggagaaatgcttgaacctggggggcagaagttgcagtgagccaagatcatgccactgcactccagcctgggtgacggagtgagactccgtctcaaaaaaaaaagagaaaaaagaaaaatcaccttttcaagaaatgatgctgagacaactgaatatttgtatgaaaaacaaccaaaattattcctttcctcacaccatatacaaaaactaactgaaaatggatcacaggtctacatttaaaagccattacttaaagaaaatataggagtggatcttcatgccctagggatagacaaagcccttttagataaagtaccaaaaatacaagcaacaaaagaaaaaacaaattagacttcatggaatgaaaaactcttttgctaccaagtacaaagtaaagacaacaaaatgccaacccacaaatgggagaaaaatactggctaataatatatgtaattagcaacttgtacacagaatatgtaaaacactcttacaactcaacaataaaaggacacataacacaactacataatgaaaaaaggaattgatttttctctattaagcttctatcctccaacttggctataaagacttaacagttttgggagttctttagaattttctccttaggcaatcatgcctgtacaaacacagaaagttttatttcttcctttcccatctgtatgcctcttattttgttgtcttatggcattacctacaatttccaatgagatgttgagtaagagtgaagagacaggacatcttgtttccttatcttagggagaaagtatccagtgtctcaccactaagtatgatcttagcagtaggtttcctgcagattttttttttttatcaagttgaggaagttcttctctattcctagtttgctgagttttatcatgaatgggtgttgaatgcttcttgtccatcaattgacatgatacagttttcttctgtagcctgttgacgtggcaggttacagaagttgattttttttttttttttttttgagacagagtcttgctctgtcaccaagtctgaagtgcagtgatgcaatctcagctcactgcaacctctgcgttccaggttctaagcgattctcctgcctcagccttcagaggagctgggaatacaggcgtgcttcaccacgcccagcttatttggtatttttaatagagacagggttttaccacgttggccaggctggtctcgaactcctcacatcaggtgatccattcacctcagcatcccaaagtgctgggattacaggcgtaatccactgcacccagccagattaattgattttcaaactctgaccagccttgagtggtcatggcatctaattatttttataagatgttgtattctacttggatttttgcatctacattcataagggatattagtgtgcggtttttcttcttcacaaggtcttcatatgcttttaggattagagaaaaaatagccttttaaaaaagtgttaggaaggttccctttgcatctcttttctgaaagacactgtagagaactggtatatttcttccttaaatattgcacagaaatcaccaatgaaaccaaaagagtctgataatttattttctttctttcttttctgaaagctttatggattcaatttatttaactgatattggtccatttgaatggtttatttcttctgtgtaagtcttggcagtttgtgtatttcaaggaattacccatttcacctaagtcatgggttaagaagaagccaggaataaaggcatcctgtaccaaaaccatctaattgcattacaaatgcaaaaaatagtatcaatgaaggacccccttcaatgcaggaggaagtcttgaccttaattgctttggaaagagatagaagtctgtgagactaaaggcaggtctgcacataagtactatattttagttgataaaattataaaattattttccacatgggtatgattaacaattctggcagtgctatacatgtatacagggaaagaataatgaaggtaaatggaaggccaggcatggtggctctcacctttaatcccagcactttgggaggccgaggtgggtggactacctaaaagatcaggagttcgtgaccagcctgtacaacatggcaaaatcccatctctactaaaaacacaaaaattggctgggcatggtggtaagcacctgtagccccagctacttgggaagctgaagcaggagaaatacctgaacccaggaggcagaagttgccatgagccaagatcacaccactgcactccaacctgggtgacagagcgagactctctctcaaaaaaaaaaaaaaggaaagaaactaaatagatgatggatagttagagccagatttcttactgttgggtatggcaatttacactgaagcaagggaagaaagctaaaatgatccatgtggtaataaagagttgaaggtttaagtataaacacatgtttagcttaagagagatacagatggttacatgtagaactatataagtaagtatattacatggtttatgcacatgtgtgtttccctgttctgtcagctgagacagccacaccctactgctgtaagcacaccattagcccctatcttggtttctaataccattctcaaataaaaggaaacagggttacctgaagaaatggtgactgatttcagaaaggaaatatataagataagcctggaccatcttgcagtgacagaaagaaagtgctctaaaaaacaacagcaacaaaattcataaatctccacttcttacgtgtgagttgtgcagagtaacattgttccgatgtgtacaatatggaaaataggaagaagatgtaactttatagtggacaaactgtatgtttgccaagacatttaaggccaacatcaaaagtcataaaacatggtgacagtatgcatgcttgatataatgtgacaaaaaaggtactttactactgtggcctttttccccaaaatctataattccagtcttatcttgagaaaaacattagatacattccaataagtggaatttatatatacctcaccaggattcctccaaactgtcaaggtcatccaaaacaaggaaagtctgggaaaccaccatagccaagaggagcctaaagagacataacaactaaatgtaatatggtgccctggaagggatcctggaacaaagaaggacattaggtaaaaatcagcagacactaaataaaaatatggactttagtcaataatcatgtaccaatgttggttcaacagctgttgcaaacataccaccctaatatgttaataacagcagaaactgggttaatggcaattctctctactacctccccaatttttctgtaagtcatgaaataaagtgaatgttttaaatagacaaaggagatacataaatagccaacaggtgcataaaaagatgttcaacatcagtccgggagcagtggctcacacctgtaatcccagcactttaggaggccaaggcgggtggatcatgaggtcaggagttcaagaccagcctggccaacatggtgaaaccccatctccacaaaaaatacaaaaattagccaggcgtggtggtgggcacctgtaatcccagctactcaggaggctgaggcagagaattgcttgaacccaggagacagaggctgcagtgagctgagatcgtgccactgtaccccagcctgggcaacagagcgagattccatctcaaaaagaaaaaaaaaaagacattcaacatcattagccattaggaaatgcaaaaaaccacaatgagatacctctttacaactactggattggtataataaataataacaataatattaataaaaagtgttggcaaactggagaaactggaaaattcatgcattgctggcaggactgtaaagtactgtggctactatgagaaacaatcaggcagttcccaagaaagttaaacacagagacaccatataaccagcattctacttctaagtatatatctgaaatgactgaaaatacatgtccatgtgaaaacttatacatgaacaattacagcagaattattcataatagtcaagaagtagaactaaaaccaaatgtccatccactgacaaatggatacataaaatgtagtatacctatataccatgttatatggtaataaaaaacaagtgaaatattgatacatgctacaacatggatgaaccttgaatatgttatgctaagaaaaagcagccaggcagaaaaggtcacatgcagtcccatttttatgaaacatccagattaggcaaatccacacagacagaaaattcaattttggttgccaagggctacaggaaaggggaaagagaaagtaattgctaatggatattggctttgtttcagggatgatgacaatgttctaagaaacattgtcggctgggtgcagtgcctcacgcctataatcctggcactttgagaggcctatgcaggcagatcacttgaggtcaggagttccagaccagcctggccaacacagtgaaaccctgtctctactaaaaatacaaaaaattatctgggcatagtggtgcatgcctgcaatcccagctactcgggaggctgtggcaggagaatcgcttgaacccaggaggtggaagctgcagtgagccgagatcacgccactgcactccagcctgagagacaagagtaagattctgcctcaaaaaaacaattgtcggctgggtgcggtggcttacgcctgtaatctcagcactttgggaggctgaggtgcgtggataatctgaggtcaggagttttgagaccagcctggccaacatggtgaaaatataaaatcagctgggtgtgggggcatgcaactgtaatcccagctactcaggaggctgtgtaatcccagctactcaggagactaaggcaggagaattggcttgaatccgggaggcagaggttgcagtgagctgagaccatgccactgcactccagcctgggtgacagagtgaaactccatattaaaaaaaaataaaaaaatttgtcaggaaggttgcacaatcctgcaaatacactaacagtgattgatttatacacataaaattggtgaagagtacagtatgtgaattatatctcatataattctccagaaaattgtttcttatatacctgttttgtggtgtataaataacacaactgatatgcattgttcttacagccaaccacctcactaatttttttagtaatttaaatcacttctatgtaacatttacttttgcttgtacagataatcaaatcgtctgcacacaaaatgaaaatttgacttcccaacctttatgttttattatttttttcttgtctgtgtaatggacagtagatcctctatgtgattctgtaaaactggtgatacaagagatccagcatctctcatatagaaagtgtgctatgatttttcaacaaatagtgtacaatatgtttttgtccattacatttattttattttttgagatggagtctcgctctgtcgccaggctggagtgtcgtggcaccatttcggctcactgcaacctccgcctcccggattcaagcaattctcctgcctcagcctcctgagtagctgggactacaggtgcgcaccatcatgcccggctaattttttgtattttagtagagacggggtttcaccatgttggccaggatggtctccatctcctgacctcgtgatctgcacacctcagcctcccaaagtgctgggattacaggcatgaaccaacgcacccagcctgtctattatctttattaaagattaagaagctgaattatttatagttggtaagcaatttacaaaactttttatttgaagaaaattgttcattttttctctttttttttttttttttttttttttttttgaggcaaggtctcactctgtcacccaggctggagtcaaatggtgccatcacagcttactgcagccttgacctcctgggcttaagcgatcctcccacctcagcttcccaagtagctgggaccacaggcacgcaccaccacacctggctaatgtctttactttttgtagagatggggtttcaccatgttgcccaggttggtctcaaactcctgagctcaagtgatccacccaccttggcctcccaaagtgttgaaattacaggcatttgccaccgcacccagcctggaggcaattcttgaattgacatgcagctggaagaaataatgagaagattctgtatacccctcacccagttttctccatggtaacaatttgcagaactacagtccaatatcaaccaaaaactgacattgattcattcaatcaatcttattcagatttcacaagtttcacatgcattagttgtgtatatttagttctataaattttgccacaggtatagatttttgtgaaaatcacaacactggggatacagaacagtcccatcaccaggatcccacacatggtaactacagccatctcccaccctctctgccttcctaacgctggcaaccacgaatctgttctccatctctatgctgtcatttcaaaactgttacacaaataacagatcatgaggtattatgataaacagcctaactgcatttgtgataattggctaatagatttcaaatcccacccatctcccctcttaccctacatttgggcaagccaataataaagcctaggtggtccctccctcaatgccagtaggaaactgaaaccacacaaactccatcctttttgtgtgtgctcaccctaccccaaattcctaatgacaagcagccattcttctcccttctttctcaatccacatttagacctgcttaggagccttctctggtctccctagaaacctgtgtgtataagtaataaactcttttttacactcttgatatcattaccagttttgatacctaaaccaagcgtagggggcaggagggttcatcccaactctatggggtggaccagaacaaacatgtaaatttttgagattgggttttttaaaactcagcttaatctcttgagattcatccataatgttacatgtattagtcattcattccattttaatactgggtaacacttcatggtatggacacactacacattatttatccattcaagaacatctggattattcgggtttgggctatgacccataaaactgctataaaatttttttgatggaacattaagtttttatttctcaaggataaatgtctaacagtgtaactagtggttcacatgctaagtttgtttttagttttaaatggaactgacaaactattttctagaatgactgtagcattttacttaccatcaaaaatgtatgaataattcagtttctctaaatcttcaccagcacttgtattatcacttttataaggcaggtcaaataagagcatgataaaaacatctttcattatgacgtgtctgggtataagtctctttgcatttatcctcctatgagtttgctgagcttcttggatgaatatattagttttcttcaacaaattatgggcgtttctgcgaattcttcaaaaaatttttctttccctttctattctctcatattgatactcccgtttgtgtatgctggtgcacctaatgatatccgtttcccaaggttttgttcatttttcattattttactggctcttcctcaaattacacaatatacattgatctgcaccagacaacccagtttctgccaactaaaatggcagttattattgtgttgcctattgatagtcctgtgcatgggtcacatttttcctgtttctttgcatatctcattttgttgttgttctcgaatggacaactggtccattcacttaacagtgttgagtgacataatcaaatggtggagtacacagctcccaactgtccccacacagaaacaccaaaaaaaaaaaaagaactataaaaaccaaccttgttagaactctggaaaataattaaaggtttacagtaaccaagtgaatgctaaatcaggaaaaaggcgacttcaaatggtgggaaagttttgtggcatttttactttacaagagaccctcattaatatcaggagctcatatctccgcagaaatcaattgaaggcctgaagacagatggatgacatatataaattcctgaaagaaaaacactatcatctgagaattctctagctggtaaaactgtccttcaaaatgaaagagaaatgaagataatcccagataaacaaatgctgagtttgttactactaggcctgctatacagggaacactaaaaggtgtctttcaagatgaaataaaaagaaactagactcaaatctggaggaaaaaataaagacttccaataaagttaactatatagacaaatataaaagccagggtcattatgtttgctttgtaactccatttttttacttcctgcaggacttaaaagacaaatggataagaactaaatataaatttacattatgggcacacaatgtataaagacataatctgtgacaacataaaggggatgagtaaggtgctaggtagaagcaaggttttcatatgatattgaagttatgagggaatcaatttaaactagattgtcatgaatttagaaagtgaaagtaatcctcatgtttaattacaaagacaatatcttaaaaatgtacacagaaggaaatgagaagggaataatatataatataaaataataaaaatataaaaatcaggccaggtgtggtcggctcatgcctgtaatctcaagcactttgggaggccgaaatgggtggatcacttgaagccaggagttcaagacgagcctggccaacatggcaaaacaccatctctactaaagacacaaaaattagctgggtgtggtggcacgtgcctgtagtcccagctacttgggaggctgcggcatgagaattgcttgaacccaggaggaggaggttgcagtgaaccaagatcataccactacactctggcctgggcaacagagcaagactttggtcttgaaaaaaaaaaaaaaaaatgaaacacaaagaaggcagtaataaagggaatatgggaccaaagaaggtatacaatatacagaaaacaaaatgcaatatggcagaagtgtttccttgttggtgattactttaaatgataattgcttgaactcaccaatcagaagacagaggctggcagaatggatttgattgatttatttattttttagacagggtcttgctctgtcacccaggctggagtgcagtgacacaaacaggactcaatgcacccttgacttcctgggctcaagggatcctcctgcctcagcctcccaagtagctggaaccacagcgcacaccaccacacccaactatttttttttttttaattttttttgtagaaacggagtctcactttgtagaccaggctggtctccaaggcctgggctcaagagatcctcccaaagtgctgggattacaggtgtcaaccacccagcttcagaatagatttttttaaaatatgatcaaactacacattgtctaaaacaaactgacttaaaatccaaagacacaaataaattaaaactgaaaggctgataaaagatattccatgaaaatagccaccaaaagagaactggggtggctatactaatttcactcaaaatagattaagtcataagctgttacaagagacaaagaaggatactatatatgaataaagggtcgttccatcaataagatataaaaattataactatatatgtaccaagcagcatcctgaaacatgtaaagcaaacacagaatgcaagggagaaactgacagttcttacagttaatagttttagactgaggctgggcatggtagatagcacctgtaatcccagaggtttgggaagccaaggtggatcacttgatgccaggagtccaagaccagcatgagcaacatagtgagaccctgtttccaccaaaaaaaaaaaaaaaaaagatagctgggcatagtgggcatggtggtatacagctatagccccctcaggaggatgagtggggaggatcacttgagcctgggagttcgaggctacagtgagccataattgtgccactgcactccagtctgggcaacagagtgagactcttttaaaaaaaaaatacaaatgcaaatgaataaatgaatgaatgaatgatgcgtatgaatacagatacaaagctacacaaacacatacacacacacacaaataccagtaaaatatatttaatggtatattaagaggagtatacaccatgaccaagtgaccaagggggacttatcctggaaatgcctgtgtggttcaacataagaaaatcaatgtttttaaaaaaaaaaagaaaagaaaatgaatgtaatacacttcattaataaaacaagtaaaaaaaggacacgatcatctcagttgatgcagtaaaggcagttgacaaaatccaacccctttcaggacaaatacattcagaaaacacaaaacagaatagaacttcttcaacatgataaagggcacatatagaaaattcacagctttacatcatattcactgatgaaagaaagctttcctcttaacatcaggaagaagacaaaaatacccacttttgccagtgctatttaacactgcagtagaagttccagccaaacaagaaaaagaaagagaggcatccattgcaaaggaagacataaaactatgcctactcacaggtgacataatcctaaagatagatcataaagaaactacaagaaagatactatagctaatgaatgaattctgcaaagttgcaggatacatcaacacacaaaaatccgttgtgttgctacacacctgcaaagaacaatctgaaaagaaaattaagaaaacaattctacctatagcaccatctaaaagaataaaatactatctagaaataaagttaaccaagaaggtgcaagacttgtatactaaaaactacaaaatactgatgaaaaatattaaagaaggcataaataaaggaaacagtatctcatgttcacagtttgagagatgtcatatttttaaaaggctaataccatccaaaatgatctacagatttaacacaatccctatcaaaattccatcagcatttttaccaaaataaaaagctgatccttaaagtcacgtggaattataagggccctgaatagcgaaaacaatttttaaaaagaagaacaaagtcagaggactcaaaacgtccaatttcacaacttattagaaagctacaataatccaaacagtgggtcatgtcataggtgtagacatacagacaaacggaatacaagtgagagcccaaaaatacactgcctatggtcaactgatttttgacaagggcgtcaattctattcactgggagaaagaaaagccttttctttcagttaatgcaggccaaatattgtcacgctactgacatgagatacaacagtcatactcacagacaaaatagattagaggttaccacaggctggtgggaatgggaatgagtagttactgcttaatggtgatagagtttctgtttgaaatgatgacaaatgaccaaaaaaatgatgctgggttaactggatttccacatgaaaataaagttagaaaataaagttagatccctactttgactatacacaaaaatgaactgaaaataagagctaaaacaataaaatgtttagaagaaatgttcagaagaaaacataaggaaaactttgggtttggtgatggattcttaactatgacataaaatggataagcaacaaaagaaagagtaggtacggccgggtgcggtggctcacgcctgtaatcccagcactttgggaggtcaaggtgggtgatcacctgaggtcaggagttcaagacaagcctggccaacatggtgaaaccccgtctctactaaagccacaaaaattagctgggcactgtggcatgcgcctgtagtcccagctactcgggaagctgaggcaggagaatcacttgaacacaggaggcagaggctgtggtgagccgagatcgtgccactgcactctggcctgggtgacggtgagactctgtctcaaaaacaaatatctgtgtatatatacacattaaaaataattcagtggtaccccaaaaagctaaaagaaatacactttgataaaacaattctactcctaggtttatatccaaaagaaatgaaaacaggaactttgagcagataatgatataccagtgttcactgaagcattattcacaacagccaaaaggtgtacgacccaagtgtacatcaacagatgaatggattaaacagccagaaaagaaagtcttgatacttgttacaatacagatgaaagctgaaagcatcatgctaagtgaaataaggcagacacaaaaggccaaatgttgtcacactactgacatgaaatattcacaacattcaaaactcacagagacaaactagataagaggttaccataggctgttgggaggggggaatgagtagttactgcttaatggcaatacagtttctgtttgaaataatgcaaatgttttagaaattgtggttatggctatacaacattgtgagtgtaatgccactagactgtacacttaaaaactgttaaaatggcaaatttcatgttatatatattttactacacacaaaacaatatattgtcaaaatgctccagcatcatttgctgaatacctgactgaatttcttttgcatttttgtcaacagtttgtcaaatgtcttagcttcagctgccataacaaaataccagacagtatggcttaaacaacagaagtttatttcctcacggttccaaatgctggaagtctgagatcaggatgccagcatggccagggcctggtgagggcctcttcccagcttgcagttggccactgcatgttcacatcgcctttcctctacgcacatggagagtgaggaagctctcacttcctcttcctgtaaggcactaacctcatcgtgagggccccaccctcatgacctaatctaaccctaattacctcccaagggctccacatctccaaacaccaccacactagggttgagggctccaacatatgaattttggggagacatgaacatacagtctataacagcataatcaatgttgaagttttctattcttttccattgttctatgtgtatgttctatcaatgtgtatattcaaccaacatcctgtcctcttgattattatagctattaatatatacatacagtagtcactccttatccaagggcgatacattccaagacgcccagtggaagcctgaagcctcagatagtattgagccctataaatactgttttttcctaaatatacaaacctaagataaagtttaatttataacttagggacagggagagattaacaacatcataaaatagaaaagttataacaatatgctggcatcgctactcttgcactttagggccattattaagtaaaataagggttacttggacacatatagtgacagtaaataatcaagacaattactaagtaattaactcatgggtagcatatacagcctgggtatgctggacacagggttgattcatgtcctggaacaggacagtgcaaaatttcatcatgctactcacaacagtgtgcaatttaaaacttaggcattacttatttctgaagtttcctatttaatatttttgaaccacagttgacctcaggtaacagaaactgcagaaagcaaaaccacagaaaaggggagactaatgtaataagccttaacactggatacaataattcctcctactattctttttctcaaaacttctgagaaaaaatttctcaaaattgtttcatattttatatatatatatatatatatatggttcctttgaccatttatggaaattttggaataagcttatttaaagctgagaaaaaccttactggaatcttgacaggaatgccattaaactgtaggtcaatttggagagaactggcctacttacaaagttgagtttcccaatctatcaagagaccacgtatcttcatttatttcagtgttcttttatttctttcatcagaattttgtaattttcagcacaaaggtcctatacatattttgttcaatttataacaaagtatttaattttctatggaataagtggtattatgtttttaatttagatttgtatatgttcattgttagtggaaagaaattgattatatgtgttcatcttggatcctgaaactttttggaaatcattcattcattctgggaggttttcattttgttttcttttctttttttttgtttttgagacggagtttcactcttgttgcccaggctggcgtgcaatggtgtgagctcggctcatcacaatctccgcctcctgggttcaagcaattctcctgcctcccaagtagctgggattactggcatgcgccaccacacccagctaattttgtatttttagtagagatggggtttctccatattggtcaggctgctcttaaactcctgacctcaggtgatccactcgccacggcctcccaaagtactgggattataggcatgagccaccaggcctggcctgaggtttttattttctaagattccttgtaatattctacatatacagtcatgtcatgtgtaaatgtaaacagttttatttcttctctatgtgtatgccttctctttcattttcttgcctcattgtgcttgaaagaagttacagtactacaatgaataagagtggtgagagcaaacatccttgccttgttcccagttttacagagaaaacatttcatcttaccagcaaatatatctgctatagatattttgtgcatgttcatttatcaaactgaggaagatcctcttaatgtcttgtatagagattttttatcatggatgcatactgcattttgtcaaatgctttctctatattaactgatgttatatcatttttcttctttagcctatggtgggttaattacattgattgatttctgaatgttgaaccaggcttgcttgtataactcaagtaaatcccacttgtttatagtgtatactttttacatgactattttctatttgctagtgttttggtaaagatttttgctactaaatgtatggggagtataggtctgtagttttattatttttgtactgtctgtatggttttgacatcaaaataattttttaaatgtgttaagaaatgttccctcttggccaggcgcagtggctcatgcctgtaatcccagcacttcgggaggctgaggtgggcggaccacaaggtcaggagtttgaaaccagcctggccaataaggtgaaacaccgtctttactaaaaatacaaaaattagccgagcatggtcgcatgcgcctgtagtcacagctactcaggaagctgaagcaggataatcacttgaacctgggaggcagaggttgcagtgagccgagattgcaccactgcactccagcctgggtgacaaaacaagactccatctaaataaataaataaataaataaataaataaataaataaaataaagaaatgttcctgcttctattttttgaggacattgtgtaaaatcatcattaattcttgtgtaaatgtttggtagaattctctagtgagaacaactctctagtacacagaaattggttttttggaggttttttatttaaaatttaaagtatttgattcaaattaagtcaacttttatgaaaacctatgggtcattcaaattatctatatcaccctaattgagttgtaatagtttttggtttctgaaaaactgctacatttcttctatgttgtcatttttctttttttttttggagacagagttttgctctgttgcccaggctagaatgcaatggtgcaatctcagctcactgcaacctcccactccctgggttcaagccattctcctgcctcagcctcctgagtagctgggattacaggcgtgcaccaccacaccaggctaatttttgtatttttagaagagacggagtttcaccatgttggccagggtggttgcaaactcttgacctcaggtgatccgcctgccttggcctcccaaagccctgggataacaggcatgagccaccacacctggcctatgttgtcatatttatgaacataaagttgttgacaagattcccttattatactgttaaatggatggtggagtgatattccctgtttcattccagatattgatgatttgtcatctcattttatatttttaatcaatattgctagatgtttaccaattttattcttttccacagaaccctatgtttcattagttttctctactttttcctattttcaattttactgatttctgcttccagtgttattttcttccttctacttaacagaggttttattttgctctttgctagtttcttaaggtagaaagtcaattatgggtttgcaacctatcatcttctctaatgttagcatttggcactataaatttctctatcagcactgctttagctacctcccacatatattgatatggtatggtctcattttcattaagtctatgcatttctactattaaatttgaggccccttcttcactccagatgttatttagaagtctgatgtttaatttctaaattattatatatttccctattgtcattctattactgatttgtagtttggtttcattatggccagaaaacatacatactcagaatgatttcaattcttttaaatctgccaaggcttatttatggcccaggatatggtctatctttctgaatattccatggacacttgagaaaaaaattgtattttgctgttgttgggcactattctttttccttttttttgagacagaatctcactctgtaacccaagttacagtgtagtagcacaatcttggctcactggaacctttgcctcccagttcaagagattctcctgcctcagtttcctaagtaggtgggactacaggcatgcgccaccatgcctggctaatttttgtatttttagtagagacaggatttcaccatattatccaggctactcttgaactcctgacctcaagcaatctgcccgcctcggcttctcaaagtgctggaattacaggcgtgagacaccgcacctggccttgttgagcactattctataatgatgcttcagtcctgttggctgatgttgctgtcctgttcttctatatctgctagtaatcatatggctagtaattctatcaattgctaagagggaagtgatgaattttccaactacaattaaaatgtgcttttctcttttcaactcaatcagttttgttttgtgtactttgaggtttgctagagacacatttaggatcattgcatttttgttggattgatccttttatcattatataatgttctttttgtctaatagttttctttgctctttgctctagagtctactgtattttgtttttgattaatgtttgtacagtttatctttttatatactttatcaacctatgttgttcactatgagtttcctaagaaaacatttttaggatgggtggagcaagatggtggaatagagaacgccaccgatcatacacactcccccgcaggaagactaacattggcaactatctacacaaaataagcagtttcacaggaaccaaaagtcaggtgagcacttacagagcatggttttcacttcatatggctgaaagagaacagtttggaagttcctgaaaaaactaaaagtagagctatcatataatccagcaatcccactcctagatatatacccaaaagaaaagaaatcagaacatcaatgagatatctctgctcccatgtttactgcagcactgttcacaagagctaagatttggaatcaactgaagtgtccattcacagataaatagataaagaaaatgtggtacatatacacaatggagtaccattcacccataaaaaagaatgagagatcctgtcatatgcaacaacctagacagaaatggaggcacagaatgttaaaattttgcatgttctcacttatttgtgaaaggtaaaaattaaaacaactgaactcatggagatgaggtagaaagtaaaaggacagtaactagaggctgggaaaggtggtggggtggggttgggggaaggtgaggatggttaaagggtacaaaaaaatagttagaaagaatgaataagacctaatatttgctagcccaacagggtgactacagtcaaaaataatttaattgtacattttaaagtgactaaaagagtgtaactggattgtttataacacaaaagataaatacttgagggaatagatacccaatttaccctaatgtgattattacacgttgtgtgcctgtatcaaaacatctcctgtaccccaaaaataaatacacctactatgtactcacaaaaattaaaaattttagatcatgttttatgttttttccactctgccaatttatattttaattagtgtactttgattatttacatttaaggtaaatattgctctgttaggctgctatttgttttcttttctgttttctattcatctgttccttttttcttattttctgattagttacctaaatattattttagattccatctgggtttatttatagtgtttctaagtgtaccacattttatagttttctcagtagttgttctaggtattaaaatgtacatatgtaagttatcacagtctatcaagcattttaccacttcaagtgaaatgtaccaagtttcattccacttaggcccctttaccctccccacttttaaaatataattgtcttaagtgtttcccctacatacagagcattttgctccaaccatcaaaaatgattctagaaactcacgagaaaaatatatttatccccatttttgccaacctccaatcttctttctttcctgcatcccaagccttcttgttatttcctttctatttagagaacttttagtcaatttttaaaggtaggtttgctagcaacattttctcttagcttccctatctaataatgcctttagttcccctttattcatgaatatagtttcaaaagatacagaatttttatttaatagtgctttcccctcagtacttgagaaaatatactacttcctgcctgccaccacagtttcagaagagaaacccacagtcattccctgcagggaatgtgttgtttctctctggctactttgaaattttttttgtctttagttttcaaaaatttaattatagtgtgagtttgccatggacttaacttattggatgttacttcagactcgggaatgtgcagttttatatcttttgctaaatttgagaaggaccagccattacttcttcatatactttaaacacctccttcacttccttctgatgttacaaatgttagttcttttgttattgccccactttccaaatactgaaagaatcaaacctcatcccattccctcctgccttccggctttgtctaagctaccacaatcactcataaggaaaactaccacaggactttaatgagctctctatgccctatgccctgcccaatattttctctacagaggtgagaaagatcttacagagatataaatcagatgttgctcatctgctgaaaatctaccactaaacagattttaaccaaataaggcttatgataggctcacctttggactctagctgcctccctcacctcacctcctgcccttcctccaatcaagccctcccttcagccactgtgactttttggtcattcctgaaaaccaccaagcacattcctgtccaaggctagcagctgctattacccctgctgaaaagaggcagaatcctcatggctcacacagtcatttcattcaaatttctactctaatgttgacctcagtaaggtttcccctgactgttccttaaagtaatctaaacttgctttaatttctttcatagtctttaaaaccacagaacacttaatatacataaacataagtatacataatatacttagagacataattttgttttttttttatatttatttacttatttttgagacagagtctcgctctgtcgcccaggctagagtgcagtggtgcaatctcagctcactgcaacctctgccttctgggttcaagtgattctcctgcctcagcctcccaagtagctgggattacaggcacctgccaccacgcccagctaattttgtatttttagtacagatggagtttcaccatgttggctaggctgttctcaaactcctgacctcaagtgatctgctcacctcgacctgtgctgggattacaggtgtgagctaccatgcctggcctaatttttttcattatcatatcctcagcacacaccaagtgctcaaaaattatttgctgagtttaaaaatgagtgaataaaaaattctgacagaagaataaacacaaaacaatggaggttaaggtgggacactgaaagtgctttgagaaaaataaccaagaaaaacaacagtaaagttgaggtgggcaaagactgaactattggcaggtgtaagaatggtaaaccttcaaaaaatgattctaaaaggaaaaattttttgtgagtagtatctggaggtttgatttagcaatcagtattctccatcacttccagaggttaggacccctatggagatgttcttgaaaaatgttccaaagttgccaaaccctgaattaactactgggaaacaacaaatcccctgatgtgaatctgtgcagtacatattaacccacctggaaagctctggcttgggaattcttcctccagtctccatggttcttctccttgttccagcctgaagatcacctctggtttgtgagcacaataccctgttaacaggaaataatttaggatttggaccaagcagtctagacttcaggcctttgaagcaggaagaagcttctggggctgcttcaagttgccagtggaacattttcactggagaggtgaacacaagtatcttctggtgctcaatcaacactgactcctgaagcctaacctaagcctaaataatgtcattaaactagacagactgcctatatgttttataatcaaaataaacgaatgctatttagaatgatacagtgaacagaccttacccactgagacaaggttgctgtagttctccagcatcacatctctatacagagccctctgactagggtccaggtgctgccactcctcctgggtgaagcccacagtcacatctttaaatgatactgacccctggaacttctgatctacctgaaatgttcagaattaggtggcatgaaaaaagaagtatgggctaatccttaccatgattattattcacagaatatttgttttgctttatacttttagggaaaaaagaaatcataacagaaatattctgccattaatgcattaagatattaattcatgcaaaaaaattatcaagttcccacaatgtacctggaactatcatcactcctggcaacactaagattaataaaaatcttcctgtgttcaaagaacacacagagtggtaagaaaatatacatggtaacatgttgcaagtactaaggtgaaagtacaaacccaacagactaacgttaggagcaaagttagctctgctttgagtttcactgaggaagtatagctgttggttgaattatgaagaacactctattacgtccttcataagcacggggccatgatacaagcaaaggtgagggcctccaacacactgcagacatcaacaaaagggcagacagcacaggaaatggcctgctgctgtcttgagaagaaaagccaaggaaatgggttacagagtaattttacaccaatggtctctaaagtatttgatcatttaccattttcaagaatattactgagaactacagatttatatttacaaatcacagaaataaattgtcagtacatttattatgaattctaatttaattctcatttagatttaaaaatgtagaaagcctgacattttcttcatcgcagtacatattctgggttctaatcctttaattcaaagacaataatagggatgtgtagaaaatggaaagatcttggaactattatacttgaaacctctgtggagtacataggagaagacatccagttggattgttctggatatcctctagggcacatcttttagggatcactgctgtgaaaaagggagagccaaagatgagatgtgagcatatactgcaattatgtgaccaggttttgtttacagaaccaattctattgagaacagcaaaggacaaaacaacatttacataaactactgtagaagaaaccaggatgcaaatagggcatgaataataggagacagagcatcaaaatgtggtcactaattcattaagaaaaaaaatgtttcctctggctatccccatgaacagctgctcagatactagggccacaatgtaaaccaggaaagttagggcaaaataggttggacacggtattctagcaagaaatgtcctaaatatattaaatttgaagcacaggctgggtgcagtgcctcacgcctgtaatctcagcactttgggaggccgaggcgggtggatcacctgaggacaggagttcgagaccagcctgaccaaaatggtgaaacctcatctctactaaaaatacaaaaaattagccaggcgtggtggcaggcacctgtaatcccagctactcaggaggctgagacaggagaatccctttaacctgggaggcagacattgcagtcagccgaggtcggcaccactgcactccagcctgggtaacaagagcaaaactccatctcaaaaaaaaaaaaaatgaagcataatatgaagatcaagaatgaaacaaggactacagagacatttataatacagtggtgctcaaagccatcaagagaaaatcagaaggatgtcagaaaactggggaaagaaaataatcaagaatggaatcagaggctaagcacagtggctcacatctgtaatcctagtactttgggaggtaaaggcaggcagctcacttgaggtcaggagttcaagactagcctggccaacatggagaagccctgtctctactaaaaatacaaaaaaattagccaggcgtgggggcaggtgcctgtaatcccagttgctggagaggctgagacaggagaatcactcgaacccaggaggtggaggttgcagtgagctaagatcgcaccactgcactgcagcctgggcaactctgtctcaaaaaaaaaggtaagaaattcctcccaaatttatatataggttcaattcaaccccaaagaaagtctcagcaagttattttaagaatactaacaatatttgtatggaaatgcaaggaactaggaagagccaggatttgctgaagaaaaaatgtgttaaacccactactagacactaagatgtttcaccaagtgaggtactggcacaaccaaccaacagaacacagtccaaaaaaacacacagacatatatgtacacataattgatgaaaatatcacaatgtaaaactggggaaaggatggtgttttcaaaaataattctacactaactgtatgaaaaacaggaatctgacatccacctcatacaaaagtagacacccattccaatgaaagagaggtaaatgtgaatgccaaaacaataaatattttaaaagataacaaaagagattatcttcatgacctcaaagtaggtaaagtcatctaaaatagcacacaccatcaacaaataaacttaataaactaatctagggattggtaaactttttctgtaaaaaatcagacattaaatatttagccaggcatggtggctcacacctgtaatcccagcattttgggaagccaaggcaggcgaatcacttgaggccaggagtttgagaccagcctggccaagtgaaaccccatctctattaaaatacaaaattagccaggtgtgatggcatgtgcctgtaatttcagctactggggaggcttagccaggagaatccctggagccctgaaggcagaggctgcagtgagccaagatcgcaccactgcactctagcctgagtgacagagtgagacattctccaaaaaaaaaaaaaaaaatcagacatcattatatttggggctttgcaggccaaaaggttcctgtcacaattagtcaactctgccactgaagccacagattaaatgtaaatgagtgaatgagcagggaggtgtcaggattgtgagggggacaagacggcagctgcaggagggctggcaatgttttttttgacgtatgtattcattatttgcgccatggatttgtaataattcattaagttctatatttaaaatgtaggggtttttccatctatctgctacacatgtagaaataagattcattaaaaattaaaatatgtaatcccagcactttgggaggccgaggcaggcagatcatgaagtcaggagactgagaccagcctggccaacatggtgaaaccctgtctctactaaaaatacaaaaattagctgggcatggtggcgcatgcctataattccagctacttgggaggctgaggcaggagaatcacttgaaccagggaatcggaggttgcagtgagccgagattgcatcactgtgctacagcctggcgacagagcaagactctgtatccaaaaaaaaaaaaaaaaattaaaatacactttaatttattggccgggcacagtggctcacgcctgtaatcccagcactttgggaggccgaggagggcagatcacgacgtcaagatatcgagatcatcctggccaacatggtgaaaccccgtctctactaaatctacaaaaattagccaggtatggtggtgcacgcctgtagtcccagctactcgggaggctgaggcaagagaattgcttgaacccaggaggcagaagtttcagtgagccaagatcgtgccactgtactccagccaggcaacagagcgagactctgtctcaaaaaaataaaaaaataaaaaatttaaaattaaaatacattttaacttactgatcaaacagtacatccaaaagaaaattggaacctgtataaaataaaaattaaaaaagcagtttgactcaataggctgcactcatttcagggctaacactggaaggttattcactatgggtccctatgttataaccaaaaaaggtatctgccaggaagtctttgtgtcttcagaggagtcagtttgtctgtatccatatccagtgtcttcctttctgccatggttgttggaaacataagaaacacatgaagctcaacttattgactctaacttggccctgctattgatctgttactttatattttctgggaagttcaatttttatctattactaatttctcatcttaacatattgactcttggccaggcacggtggctcacacttgtaatcccaacactttgggaggccgaggcgggcggattgcctgagctcaggagtttgcgaccagccagggcaacacggtgaacacatctctattaaaatgcaaaaaattagccaggcgtggcggcctgcgcctgtagtcccagccaatcgggaggctgaggcaggtgaattgcttgaacccaggaggcagaggttgcaaggttgcagtgaacagagatggagacactgcgctccagcctgggcgacagagcgagactccatgtcacaaacaaaacaaaacaaaaaaaccatactgactcttacaaatctcacaaagtccaccgcaaaataaagtagggaattaataaacaacttaccttgttcattttgttctgttcttggaaagacggagacaactctgaagatacagctgagttggaaaaagaggaatggggtcatgaaagatttggcctgcctggcaactcccggattcttctgccctaagaagccatacacacccactaggtaaaatgctccgtctgggagaatatcaatgtcctctgacacttcggaatagggggtagaaatggtgaaagaacaccctaatacaactccaacataaccatgtagctcttgggcacaagatttttcatcaggtgaaagtaaatatttgcttcctaaggatttcaatctccctcagtcttcacaaaaaatgtataatgacaatattggccaaacaagttaacaatacatttaatgaaaaaacattaacactaaaaccattgtaaagaataggactaggctatcgattttcccagtaatgttacttaacctctgatgagttagtccacagaaaaccataagcgtcagtgcttcaaagaaaaaatccgttttaatttcttcatctaactttgttgctatttctcaaaaggatgttttaaacttgctttgatgtgtgtagaaaagtagtactggcttaggggtcaggagaagtgacttttagttctccctactaacaaactttgatcctgaacaagtcagtaaccttgacaaacaaaaaacaaaaaaattattttttcttctaacaaatgaggcaaaattaggtaattctggttttttgtttgtttgtttgtttttgagacggagtttcgttcttgttgcccagtctggagtgcaatggtgcaatctcagctacctgcaacctccgcctcccgggttcaagcatttctctgcctcagtagctgggattacagtcataggccaccacgcatggctacttttagtatttttagtagagacggggatttgccatgttggtcaggctggtctcgaattcctgacctcaggtgatccaccctcctcggcctcccaaagtgcaggattacaggagagagccaccgcgctaggccaaaattatgtaattcttgaagatccttcctgagtgcaagatcaagttaggacagaggaacagcaaataacaagatggggtgatggacatgactggagggcagttcgaaacctaaagaggatgaacgcagaacgggcaacagagtccgtatgtcgggcgggcgactgcacccgccctttcctacccaggtagggccgcgccctagcacatgggcgtaaacacgctcaaccagagaactgcccctcccgcaaggctcagcgctcggaccgcgcaagcgcacatgccctcctccgcggcccctacaaacagggcaacgcacagggcgtagcccgctccctacagaggctgcgccttagaggaactggcgtagcgtcctggtagacatgctgcagccccgccgtccccggcttctccgtgaggtccccgggactcctcgccaccacctggcactggcccccggctgcctgctcctggagtcgcgcggggccccctctccgtccctgcccaacccgcggaggcttacctcactctctcttcgggttgcattcgccataagagagccggtagacccctgaaatcccgggaccgcctcccacgcaaaacgtgagacaaacaaaaggaaaggcggaaacgcagaaacgcagaggtagccagtggatgaggcatgcgcagagcccacgctcaaagcctggcgctgttggcgcccaacctggaaactacctttcccgtgaggacgcgagagcagcccttcgggattggcagagaggtgccccgctaggcagtggacagatgcggtctgagttggtgtgggaactgcccgcagccctggctctcccggggcgacccaaagggatgcactgcaggggaggtctgtgtgcagcaagtgtgcaggttagacacagacgcctcaaggaaaggacagctgtgtgtcagtttcactttaaatgttaggaagtagatcttattgatacagtttaaaagactttgacactatcagcgattctttgagagcagggatgggggggatgggggaggtgccacaggaaagctacttcatcaaaatcgttaacgcaataaacggaaattgaaaagtcagaaaatagacataatccgaaagaagaaaataaatgtcacatgatttcccctgtgacattaaaattgcttgactaaatggaaatacatttagtctatctgtacctttcttaggaagacaaaattcctaaaagaatatcaacaaatttttttatgtattttttctctttgatctttagtgtattgtgtactttacaaaagcattgtcaactttatccagagtaagtaaaaaactaaatgaacagccattatacgttttaaaaagcttgaaaaaatgcctgagaaatatctatatctatctatatatataatattgctctattcaaagtagtttggcacctgctccatggaaataagacaccatgattgagagtattctttaatgtgtagtaaatacagcatttcaaaacagtgagggaaagaatggagtattccaaagagcatgtcattcctaacaatttggaatatagagatatatatagatcacacgtgataaaattcacatgtatacagtattgaaacatttaaacgagtataaatttttgaaaattgacatgtgggccaggcacagtggcccacacctgtaatcccagcagtttgggaggtggaggcaggaggaccacttgatccttagagtccaagaccagcctgggcgttatagtgggacccctgtctctacaaaaaattaaaaataacaattagctgggcatgtaggcaggcgcctgtgatcccagctactcaggaggctgaggttggacgatcacttgagccccaggttgcagtaagccatcatggcaccactgcactccagcctgggtgacaaagtgagactttgtctcaaaaaaaaccaaaaagggatgtgataccaaagacagaaactataaatttaatatcagttacattttataatagagaaaaataagcagctccattccagcaaaactttttaagtccattatgagaattgaaagaaatgcaaatatggccgggcatggcagctcacgcctgtagtcccagcattttgggaggctgaggcgggcagatcatgaggtcaagacattgagaacatcctgcccaaaatggtgaaaccccttctgtactaaaaatacaaaaattagctggacgtggtggtgcgcacctgtagtcccagctagtcaggaggctgaggcaggagaatcgcttgaacccgggaggtggaggttgcagtgagccaagatcgcactactacactccagcctggtgacagagtgagactgcatctcaaaaaagaaaaaaagaaaaaaggaaatgcaaatatttgagtaaaaatatgtgaaacatattgaaatttacatttttaaatttatgctttatatactgaaaagttcactttatttgttgcataattttatgagttttgacaaacgcacagatttgtgtaaccaccaccacaagcaagatacaaaattatttcacctgtcaataaaattcctccatgctaccttttgaaagtcagattctctaaccactcttagcctcttgcagccactatctagtctttgggcctgtatgtttgccttttttagaatattatataaatggaatcatacaatatgcagtctttgaatctggtatcttttacttaacacaatgcaattgagatccttccgtgttgttttgtgtaccaatacttctgtttttcttgctgttagaaacaagtgcctggtgccgcagagaaaaccagcacaaaggcagaaaattcctcagcaagagaaatttacttctgcagaagggtgcaggttatgccagtcatgatcacaagagaacaccgagaagggcagggcaggggtttttatccctgatgcagttcctagcacttctgtgtcccttccccattggctgggattagacctcacaatcaaagctaactcgattggctaaggtttaaaattgacagggtctattaggcgggaaggaagggggactgtccattactaagcgggaaggcatatccggacttgtctgggcatggcaaaggcgggaaggttgtttacagaacaggtagcttggagacaaggaagtacaaggaagttggtcttgagcaacaaacaacagggaactaaagctttctgaagagtaatttgtcaactctgacattgctgactcctatttcttggtatggatttaccagcttccttgtccattccccagtccagggatatgcaagttgtttccaattgggagaaattgtaaataaataaaatatttttaagtttaagatttgaaaagattgtaaaaaacactaatatacacctatggtatgggcttggggaaatgtttattcccagtgtattaatcaggattctccagagaaacagaaccaataggagggagtaagggagaaagagacattgatgatgagaaattggttcacatgtctatggaggctaagaagtccaacaatctgtcatttgcaagctggaaatccaagaatgctggtggtgtaattctggtatgagtccaaaggcttgagaaccacggaagccaatggtgtaaatcccagtgcaaggacaggaaaggataagatgaaatgtcccaactcaacaatgaggcagaaaatatgggtgaattcctcctctctgccttgtgttctatccaggcccttaggggattgaatgatgtccatacacatacggagggcaatctgctttactgagtctactgattcaaatgctaatctcatctgtacacaccctcacagatgcacccataagtaatgtttaatccagacaccctgtgaccaagtcaagtttacacataaaattaaccattaaccatcacagctattctatttttttttttttttttttttttttttgagacagagacagagttttgctcttgttgcccaggctgcagtgcaatggcatgatcttggctcactgaaacctctgcctcccgggttcaagtgagtctctcaagtagctgggattacaggcatgtgctaccgtgcctggctaattttttgtatttttcctaaagacggggtttctccatgttgttcaggctggtctcgaactcccgacctcaggtgatccaccagtctcggcctcccaaagtgctgagattacaggcctgagccaccacacctggccacagctattcatttttacggtgaatttgattaactctggaggctcattttttcctctcatttcttcttcggtttttgtacctttttcccttttacatttcgttgacacctaataattgtgcatatttaggggatatagactgatattttgacatgtgtataaaatgtataatgatcaaatcaggttaattagcatatccctcacctcagacatttgtgtgtgtgttgtaagcattcaaaatcctctcttctagctttttgaaaatacacaataaattacagtcaattatatttatcctacagggctgtggaacaccagagctcatttcttctatctagctgtaattttgtattcatataccaacctttccccatcctgccctccccactaccccctcaccctctaatgcccataattctactcactacttctatgagccccaatttttttagctcccaaatataagtgaaaatgtgcagtaattatctttctgtgtctgacttatttcacttaatgacatccaggcctatccatgttgtggcaaatgacaggatttcatttttatagcagagtaatattccactgtgtttatataccagattttctttttccattgatgtgttggtggacgtttaggttgatattatattttggctattgtgaatagtgttgctataaacacaggagtgcaggtatccctttgatatatggatttcccttcctttggatatgtgcccagcagtgtgattgttggattgtatggtagttccgttttattttttaagaaacctccacactgttttatatagtggttgtaccaatttacattcccaccaacagtgtctaagagttcccttttctatgcatccttaccagcacttatttatttttcttataatagacattctaactagggtgagatgatgcctcattgtgattttgattggcatttccctgatgattagtgatgctggacatttttcatacatttgttagccatttgtatgtcttcttttaagaaataattattcagatcctttgcctgcattttaatcagattacttttgtttttgtttttgccatcgagttgtttgagttatttgtatattcaggatatttgtcccttttggataaatagtttgcaagtattccctaccattctacaagttgtctcttcacttccataattgtttcctttgctgtgcagctttttagtttaatacagtcccacttctttttgttgttgttgtctgtgcttttgtttgtttgtttattttgagacagagtctcaccctgttgcacaggctggagtgcagtggtgtgattatagctcactgtagcctctacctcctgggctcaagtgatcctcctgcctcagcctcccgagcagctgggattacaggtgcccaccagcatgcctggctaaattctgtatttgtagtagagatggggattcaccatgttgcccaggctggtctcgaactcctgtgctcaagaatctgcccacctcaccctcccaaagtgctaggattacaggtgtacaccactatgcctggcctgtctgtgctttttttttttttttttttttttttttgagatggagtctcactgtgttgccaggctggagtgcattggcttcaacctggctcactgcaatctctgcctcctgggttcaagcaattctcctgcctcagcctcccaagtagctgggattacaagtgtgcaccaccacacccagctaatttgtgtgtgtgtgtgtatttttagtagagatgggttttcaccatgttggcctcaatctcctgaccttgtgatccacccaccttggcctcccaaagtactaggagtgcatcaccatgcctggccctgtctgtgctttctaagtcttagtcataaaacttttgcctaggccaatgccctgaagagtttgctctaggttttcttctagtatgtttacagttttggtcttatgtttaagtctttaatccattttgagttgatttttgtatacggtgacaggtagggatcaagttttgtccttctgcatatggatatccagttttcccagcacaatttattgaacaggtggccctttacacaatgtacgttcttggcattttaattaaacgttaaaggacttataatattataattccacttatatgactttgtaataataaattattgttgatatatgtgcaagtatatttaaatcaatcagagttcaaatggtaacagagagatcactcaagtattacaactgagagaatttgatgaagattatttaaagcaggtgttttaatggtaaaaatgaacactgagctaacacaggatgacaacatcaggtagcagctacctgtctagggctgggaaacaatggaaaagattaaggttctcggaacctagaaactcacaagagtggccccagagagctagaattagacaagacagcggaggcaggggcagtgccaggatcatgctggtacctcaggtattcagagaagagctttgcagaactggaattcagatgctgtccagttgctaactgaactttcaggaaggcatgttgaagcacattgtgttcacctctgaaagtcgttactgtccagctggtgctagtagccagagtgggatcaatgtggagagttctgggagagctaaaagaagctggagggtgatcaacatgttctggaattagatagtggtgatggttgtgtaactttgtgactataattattgaattacacacttttaaaggagtaaattttgtatgtaaattgtatgccaatgttacaaatacttttttttttttttagacggagtctagctctgtcaccaggctggagcacagtggcatgatctcgactcactgcaacctccactgaagaaggaattcatgaattttacaagtataatcaaagaccaccaagaaatttttactttttccttcaaaagctaagtgtagtgtagcaccccctgcccatagtctaagttacagaagaatactaactgcctgtttttctttctgtgttgtgagccttatctgttctcaccagtttcacattccttgaggctcagtgagttcctgcgcacctccctagcacagctgcaaagttacaaggttgatatgcatatgttacagaaacatagtttcccaaggatgtggaacatgtagtatagataaatgtaaaagactgatcaactgcctttgttctcgcttgtgtaagtagacttcatgaatcacatagctcccggccactgactgcttaaaaggtggctgcattctttctccagggctcagactttcctggacgctagtcctactgagccaggtgatccccttaataaaggctttcctgaactctcttcagtctctcccgtctctgattgtcccataacatttctgggggcctgtctgggattggagatggcaggtttctgtctcctttgcctgtgggctaaagccacaggacgcgggagatttgggaactttggtgccactggggaagacttagcccagaaggagaacggctcccatgtattggagcctcgccctgacagcgcaaacggaaccgactcaggagttgcaggacagtcacaggagcagtgcgctggcagactactgaaccgccataaggttgggccctggaaaagcccatcccataaggacagaaggggagcttgattaccttccccggaacgatcacttatccaacccagagtggctgggggcagcaggagtggcctgccaatttggatgaatctcgtgtccccacacaagcaaaagtggttcactggatctggagacagaaactgggagtgttttggtgtgtgtgaacctactcgggacataaagaaggcttctttcatctgatcagtcctggggtaggagtggtttgtgtatgtgtgtgaatgtggaagcctaactaagctcactcgggacatgagagaggcttgtttcatccgatgaggagtcctggggcaggggaggtgtgtgaaagtgtgtgaaagaggtggtctcggagaagccaacacggggagtgatgtggggagttgcagatcttagtgcagactgtgtccctcaaggtgagtgtgggacaagccagacctaggtcactgcataagaccgacaagattcacttcatggtagcttcacagcagtagttggctgtgacctggccaagcagcatccaaacctcctgtaataggaccctgtctggtgcatccaagagtgaaagtgagagtgaaagtgtgccacgagggaggcaataggaggaaaagtattgaagccaactccattagaacatatgttgaagaactttaagaaaggctctgatggtgattatggaatgaagttaacaccgcagaggctaagaacactttgtgaaattgactgcctctccttcaacatagggagggcggccaagggaaccatagatagggaaataattggccgagtatttagggtggtcactggggttggagaacagcctggacaacctgatcagttcccatacatagactcctagctgagcgtgattcaaacccatctgaaatggctacaggcctgttttgaaaattattgtaagactctggtggctcgtacaaaacaaggaaccatagaaaagacccacaaagtgtaggcccaggagaaagaacagcaaggaaaacaggaaaaacctgtcctacaggccccactagaagagctagagactccatccccttatgttccaatttatccgcctctggcaaggcttaggcaggaagtcactccagcagctgcctgtggagggtcagactcagaggagagtacccttcaaacttcaccacatagggaagagccagggtcactgcccgataattcaaaggaggaactccagtatgacggccatctccggtcaggacacgcccgagctttgcagatgccattcagagaacctaggggacagatctatttagatgcacaaaatgaggttcaaggaggagaacggctttatgtttatcagcccttctctactacagatattttcaactggaaacagcatactccctcctatacagaaaaaccccaggctcttatcgacctgatgcagtccatcttcttaactcacaacccaacctgggctgactgcaagcagttccttctgtcactgttcaatacagaaaaacactgcagagtaatacaagtggcttatcagtgactagaaagcaatgctccagtaggcacaggagatgtcagaaagtatgctcagcaggctttgccaatagaaactgacccaggctgggacccaaatcaggcctaagggctgctgaacttgctgagataccaaggggctctgatacaaggaataaaagctggagggaaaaaggcaacaaacactggaaaggtttcagaggtccatcagaaaccagatgaaagtaccagtgagttctatgagaagctttgtgaggcttaccggctctacacaccttttgacccagaagtggcagggaatcagtgcatggttaatgcggcatttgtgagtcaggcacaaaatgacattaagtgaaagttgcagaagctggaggggtttgaagttatgaacatttcccagcttatccaagtggcaactaaagtgtttgtaaatcaagatgaagaagcaaagtgggaggccaagcatagagtgaaggaaaaggcagagttcttggctgcagccctgattgaaagagaggctggatttgcaagaggacatggacatggtcgtggatgcagtcatggtaaaggacaagctagggctaggccaggtcaggagaccaggacaggtcaggaaggttggcctagactagagagaaatcaatgtgcgagatgcaagcaaagagggcattggaaagatgaatgtccagagaaagaaaagaataaaggctacaagcagggacagaatggctggacaaggcctccttctgctgctgggcagggcatagtaggatgcgatgtggatctaattgggctggcaggagtcagtgactaccttgaagactgagacagactgggctacatctcattaggccctgaggagcccatggtctcaatggtagtagggggccgaaaaatagaccttatggtagacacaggtgctgaacactcagctgtgactcaaacaattagggtgttatcaaaactctatgctaatattattggggccacaggtatcacagaaaaaacaccttttttcacatcaaagagaggtataattggaaaccaagaagtccaacacaagttcttatacttgccaaactgcccagtgccgttgttgggagagacttgttgcagaagctgcaggctcaaatctccttcacactgaatgcagatataccttgagcctagggcaaaagaaggctatggtactaactcttacagtacccaaggcagaggagtggagactttatgaaagtagttgtcaggagtgtggaaaggagtacagctgagaaagaaaaactgttcacagacttactccctaagttaccaggagtctgggtggaggacaatcccccagggttagcagtaaatcaagcacctgtcatagtagagctactacgaggaatctacccagtgtggatccatcagtatcccattcccatagaggctcaccaagggattgcaaaacacttaaaatgactccctgaatttggaataatagagagatgtgtctcctcacggaatactcccctactgctggtgttaaaaccttctggcaactaccagcctgtacaagatttaaggacagtcaacaaggtagccagtacactgcatgctattgtgcctaacctgtacactatgcttggacaaatacctgctagtgctgcttggttcatatgcttggacattaaagatgtgttcttctgcatctgattagcccctataagccaagacatttttggttcatatgcttggacattaaagatgtgttcttctgcatctgattagcccctataagccaagacatttttgcctttgagtggggcccatctcagtatacctggactagacttccccaaagatttaaaaactcctcaactatctttggagaagcactagcctcagacttaaaggctttcacaccaccaagtgatcgcttgtcttactgcaatatatagatgatctgctgttagccaaacccacaagaaaataatgtatccaaggaacagagagtctccttcaagtgctgtgggaagctggctataaagtgtctaagaaaaaggcacagatctgtggctgaggagttcagtatcttggattttacttctcccaaggacggtgtgagcttggacaggagcgaaaagagattgtctgtagcattcctcagccagacagaaggcagcaagtgcaggaattcctaggggcagctggtttttgccaattatggattcctgactactggctcctagcaaagcctttatatgaggcaaccaaaggaggggaaaaggagcccctcctttggggaaaagaacaggacatggctttcaaggaaatcaagaaagcttcaatccaggccccagcactaggactgccagacatgacaaagcccttttacctgtatgttcatgaaagaaaacaaacggctacaggagtctaagtgccaatgctagcatcgtagtatcagcctatagcatatttgtccaagcaactagacttggtggctatgggattgccaccctgtttcaaggtgctggccgccactgccttgttagccaaagatgctaacaagctcacatttgggcagcagctgataattcaggtgccccacacaattgtcaccttgatggaacagagaggacattgttggctctctaaccgtaggatgctaagataccaaggactcctatgtgagaatccatacatcaccttagaggctgtgaataccctaaatctggccacactgttaccaatagaatgtgcagaacatggaaagtccctgttatgtgccccagggtaccactgctgtgtagaaacagtggatgaagtattttcaagctgggaagacttaaaggatcaacccttaagaaacccagatgttgaatattttactgatggaagcagcttcatatctgagggtatcaaaaaggccagatatgccgtagtcacattaagctcggtggctgaagcctgccccctaccagtaggaacctcagcgcagaaggtagaactaatagctctcacaagagcactatttctagtgaagggaaagtcagtgaatatctatgctgactcaaaatatgcttttgccaccttgcatgctcatggagccatttacgatgaaagaggactgttaactactgaaggaaaagaaataaagaacaaaaaggaaatagagcagctcctagaggctgtgtgggctccaaaggaagtagcagtcatccattgtaaaggacagcaaacaggaagaagtgataaggctacaggaaacagcaaagcagacaaggaagcaagaaagactgcaatgacagaaaaaacaaagaaagaagagacttatgccatgcccttattagagcctccccttgcagacactcctaattactcgtccaatgagaaggcatcgtttgtgcaggaaaacgggagttatcagaaagaaggctggtggaagttttcagatgggagacttaccattccagaagccattgccccccaatttataaagcagtttcaccaaggaacacacatggggaagacagatttaaagattctcatagggcggtatttcattgtgccatgcctaactgccatgactcgagccatctacgagcagtgtgttacttgtgcccagaataacccaaggcaagggcctacttggcctcaaggaattcaggaaacaggagcagtgccatgtgaaaacctacttgtagactttaccgaactgcctcaggctggaggctatcggtacatgttagtgtttgtctgcaccttttcaaggtgagttgaggcattccccatcaggacagaaaaggcacgagaagtaaccaggatattattaaaagacattattcccagatttggactgcctctaaccttaggctcagaaaatggaccagattttgtggcagaagtagtacagcaactaactcagatgttaaaaattaaatggaaactgcatacagcctaacatccacaaagatctagaaaggttgtaaggatgaactggacactgaaacaactgttgaagaagttttgccaagagactcatttaaggtgggaccaggtattgcccatggtccttctctgagtcaggtgtacccctacaaaattaactgggtgttcacctatgagatagtgcatggcccaccacccccactcatatctcaagtaaaaggagatttaaaggaaattggagaactgaccctaggaagacaaatgcaggtattaggtgaggtaatgcaagaagtacaagggtgagtaagagaaagaatacctgttagccttacagatgcaatacattcctttcaacctggggacttcgtatgggttaaatgctggaatcctaccacccttgggcccttatgagatggcccccatattgtgaccatgtctacccctactgctgttaaagttgcaggtattacaccttagatccatcacagctgactgaaacctgcagcctcagttcaagacatgtggacgagtcagcaagatccagatcatccaactcaactgatcttgcagaggaaccaaggcgcagtaggaaaagacgaccaccctgctccgaccacaccagaagctggtctgtcaatgcacagctgaagcttaaggaaacgtcaagccctgctctagtcacacagctggaaggtgactagtctacgcatggctgaagcttaaggaaaagtcaagtcctgctctagtcacacaactgtaagctgactagcctatgcacggccaaagcctgaggaagccagcactagataagtaaatgtagattgaatttgcaagtgtagttatactattgcttatactgattgtcttgctgtcatgctatctttgcaattgctatcaaacttgttgcccgggaggatgcctgtgcatagtataaacttaatcacactaatgacaataatgttaacaggcatgggaggaaatcaagataactgtcattgtatgatagaaagttggtctggtaaaggtataactaaaaccctgttatatcaaacttattatgagtgtacaggaactcccctggggacatgtgtttataatcaaaccagctactccatctataacccaggaaataggcaacctcaagtatgttacaattcaggcctcctaccctgtggcttctggtttgaaattaaaatagggaaacctttattaccctcatatgccaatcctaaagatgttagaactgggaaactcataagcaaaacacaggtattcccttatttacataaaggatctgtttctatatattttgatgcctgtcaggctgcacacctcagcaacctaaacaatctaggagtagtctgcaagaacttaggacaagaaagactcagcagcaaggctgctaagatcataacaggagaaccagaagaagaatgtcctgattgtaacattcaaaggaccacacatgagttcagccaatgcctttatgcaggaagagtagctctgctaaccagccaagaagcaaagattggttgtgcgactaaaatatgcaacccccttaatctgaccatattaaagccaaacatgcctttttggactaaagaacaccaaggagagctaagctgtgctcgagaaggagcaaatctgggtgttctgttaatcattattaaaaagacacagtgagctaaagctcaagtcagtccaatgtcacagttcagatttctcaaatccttcaataaacattttaaccccaaggagccaaaagttcagattccaccaatgttagccaagaacctattcactcagctagctgaaagtattgctactaatcttggagtcatctcatgttatatatgtggaggtaccagtgtaggtgaccaacggccctgggaggctagagaaataataccacaagataactttaccataccagaatttgttacaaagttcaattgaaacccaggtgtctggctattaaaaacccctatcattggaagatactgcatagcacaatggggaaaagactttcaaacccaagtaggagatatgacttgtttagaaatatgacttgtttaggtcagcagtattttgaagagtctaagaacaagacacagtggagaagctttatagacaatttctctaccatattttaactctctctctcagtttccagtgctaaatcagtcgtagtatcaactagacactccaaatgtttggaaagcaccggcaggactacattggatctatgggacaaaagcctattaactattgccagagaagtggaccggagcctgtattttagggacaataaggccgtccttcttcttgctcccactgaaacaaggggaagattttagttacccagtctataatgaagaaagaacaaaagaaatgtctttactcagataagtactgtagaaaacataagcacaaacataaagaaggacattgagataggtagctggaaagataaagaatggcttcctgaaagaattatcaaatactatgggccagctacatgggcccaagacagatcatggggctaccacacccctatttacatgttaaaccaaattataagattgcaagcagtactagaaatcatagtcaatgaaacagcctgagccttggatctgttagccatacaggctactcaaatgagagatgctacatatcaaaataggctagcattagaccacctcctagcctcagaaggaggagtctgtggcaggtttaatttgaccaactgttgcttacaaatctgtgataatggaagagctgttacggaaattactgctagaatatggaagttagcccatgtcccagtccagacttggtctgggtggagcccaaactcacattttagaggttggttctcatggtttggaggctttaaaaccttgataattggttttgtaactatagtaggaagatgtctaatactgccttgtcttttacctctcctcaacagaagcatccagtctactatggaagcaatagtggaccgaaaaactaccaccaaaataatggcattacaaaaataccaacctgtcccccaggaagaatatgagcctacacaggaagagataaatgattgtggtgctctttattaatctacatttatggtgagcaccaaaggtgggggatgaagaaggaattcatgaattttacaagtataatcaaagaccaagaaattttcactttttccctcaaaagctaagtgtagtgtagcccccactccctgtcccgtagtccaagttagagaagaatactaactgcctgtttttccttctgcgctcagcaagccttatctgtactcaccggtttcatattccttgaagctcagcgagttcctgcttcacctcaccagcacagctgcaaagttacaaggttgatacgcatatgttatagaaacatagtttcccaaggatgtggaacatgtagtatagataagtgtaaaagactgatcaactgcctttgttctcgcttctgtaagtacacttcctacatcatgtagctcccggccactgattgcttaaaatgtggctgtttctttgtctggagctcagaatttccttgatgctagtcctacttgagccagacggtcaccttaataaaggctttcctgaactctattcggtctctcccatctctgattgtcccacaacaccacctctcaggttcaagtgaatctcctgcctcagcctccggagtagcagggattacaggcaagcactgccacatccagctaatttctgtatttttagtagagacgaggtttcaccatgttggccagcatggcctcgatctcctgacctcgtgatccgcccaccttggcctcccaaagtggtgggattacaggcatgagccactgcgcccagcccaaatacttttttaaaagaagaagctggagactagaactaatggataaagtaaagggctactgctggggtgagattaacaagagcatactgcagacaggaaggaggaggaaattccttaatctgttatccttcctacagtcatcattataaaaatttaaaattaggccaggtgcggtggctcatgcctgtaatctcagcactgtgggaggccgaggtgggcagaccacttggggtcaggtgtttgagacaaacctggccaacatggtgaaaccccatctctactaaaaatacaaaaattaaccgggcatggtcgcaggtgcctcgaattccagctactcaggcagctgaggtgggagaattgcttgaacctgggaggcagaggcctcaatgagcagagatgtgcaccactgcactctaacctgggcaacacagcaaaactctgcttcaaaaaaataaaaattagtctgggcatggtggctcacacctgtaatcccagcacttttggaggttgaggtggttggatcacctgaggtcaggagttcgagaccagcctgaccaacatggagaaatcccatctctactaaaaatacaaaattagccacatgtggtggcgcatgcctataatcccagctacttgggaggctgaggcaggacaatcacttgaacccgggaggcagaggttgcggtgagccaagatcacaccattgtactctagcctaggcaacaagagcgaaactctgtctcaaaaaaaaaaaaatagaatgatattaaatgttaaaaatacaatgcttcattagctcacccaaaaaagattccaaagcacataagacaagcctatgccttatttgtaggcccttgacataaatgaagttaagggcaccaccacttagctttcacataaacatgggtcacaaaccactgttgacactgtgaaattctgtaattcctaagactctttcaaaaatgttgagggaattgaactatttcaacttttgagcataacatgagaatttatttgcaaacatgatttagaattcccttaaagtatgacaatttaaattcttttgaaatatgagagaatatatgttttctataggctcatgtataatggataaaatacaaggtaaaagttgaaaagagcctcacaaaactgatagcagtcattatctttgtggaagaggcaacactgggaacgctggtcaaaagagcttttgtacttacatgaaaaggcaatgcatgttactattacctgtgacagtgtaaattaataattttaaagaatagacaacacaaacctgatacatacactcacatttgggacagcaggagaggggacaacctaacatggctctttctctatggcatgggaacttcccctctctggttttcactcttgccatcttcaaactgggtcaatctactctaccacccagggttctgaaaataaaatgtaggagctcctagcccaaggcctacctagaatattgtaattcctcattaaatgtgcttaagtattgtatcagagttctccagagaaactaagtttgtgtgtgtgcatgtgtttgtacacttgcatatatgtttgtgtatatatttatgtgtgtatgtgtacacacacacacacacacacatatatatatgggagagatttattataaggaattgacttatgcaatcttgcaattatggaggttgacaactctccagatctgaaggatgatgagtccatgtttggggacccaggacagccaattgtgtagttccaggctgaaggcctgcaagcttgagatgcaggaagagcagatgtttcagttcaagtccaaaggcaggaaaaagctaatgtgtcagtaagaaggcttgttttactcaatccttcaactgaccagatgaggcccactcacatcaggaagacagtctactcagcctaccagttttgttttctcttgttttagtgggggcttttgctgtttttctttggggggggagttatttttagcataattgaactttttatgtttttaactttgtttgattttagatttgggggtagatgtgcatgtttgctacatgggcgtattgtgaactagtggggattggacttctagtgtaccccattacctaaatagtcaacattatccaaatagtgagccctcacccccttcccaccctccccccttttggagtccacagttgtctattatttccaaaacaaacagaaaaacattctacattcatggatatgaaggatcaatgttgctaaaatggccatactaccaaaagaaatttactttttaattcaatgttattcctatcaaactaccaacaacgcttttaacagaattttttaaaaatgaaaaatcttatttgaaacaaacaaaaaagaggctgaatattcaaagctttctatgcaaaggaacaaagctggagtgatcgtactactcaatttcaaactatactataaggctacaatacctaaaggagcatgggtactggtacaaaaatagacatatacaccaatggaacacactagagaacccagaaataaagccacacatctaaaaccatctgatctttcacaaagtcaacaataacaaacaataaggaaaggactccctattcaacaaatagtgctgggataactggctagtcatatgcagaagattgaagctggaccacttcattataccatatacaaaaattaactcaagatggattaaagacttaaatgtaatatttaaaagtgtaaaaaaccctagaagaaaacccaggaaatatcatgctgtacattggccctggcaaagaattcatgacaaagactctaaaagcaattgaaacaccaccaccacaaaattgacaagtgagacctaattaagctaaagagcttctgcacagcaagagaaactacaaacagtaaacacgcaacctacagaatgagagaaaaaacttatgtatccagcaaaggtataatagctacaatctataaaaaaaggtaactcaacaagcaaaaaacacacaaccttatttaaaaatgaaaaaagaacattaacatacacttctcaaaagacacacatgtatccgacaagcatataaaaatactcaatatcagtaattatttaaaaaatgcaaatcaaagtcatgagataccatctcacatcagtcacaacagccatattaaaaaggcaaagaataatagatgctggtgggtagtgaatagtaaaagcttatacactgccagtgggaatgtaaatttttcctgccactgtggaaagcagtctgaagatttctcaaagaatttaaaaccaaactttcatcagacccagcaatccaattttttggtatataccccaaagatagaaatcattcaactataaagacacatgcatacttatgttcatcacagtactatttacaatagcaaagacatggaatcatctgatgtccttcaatagataaatggattttacaaatgtgatatatatgtatacacacacacacacacacacaatgaaatggtattcagtcactaaaaaagataaaattctgtcctttgcagcaacagggatgaacctggaggacattaagtgaaacacaccaggcataaaaaaaaaaaacactacacattctaatctatagaatctaataaagttggtatcattgaagtagagagtagaatggtggttactagaaactagagtgtgtaagagagtgcaaaacggggagaaaatggtcaatgggcaataagttacagttacatagcaggaatatattcaagtgcacagtagggtgacaatggtgaacaattttgtattaaatatttcaaacggctagaaaagagaattttgaatgttctcaccacaaagaaataacatgagatgtcaaacatgataaatcccataatttattacatatatatacacatatctaatgctcacattatgctccatctgtatgtaaaattactgtgtcaattaaaaacaaaattaaaggccaggcgcggtgactcatgcctgtaatcccagcaatttgggagacttaggcgggaagatcacctgaggccgggtgtttgagacctgtctggccaacatggtgaaaccccatctctactaaaaattcaaaaattagccgggcatggtggcaggcgtctgtaatcccagctacttgggaggctgaggcatgagaactgcttaaacctgggaggcagaggttgcagtgagccatgatcatgccactgcacgccagactgggtgatagagactccatctcaaaaaaaattatagaaggaaaaaatgaggtcataaactaaccatctgtccccagattgtatggaaagacatacaaataaagataatgacaactcaccagaagaaaaacctgtaagaaaaaacttcagtagcaattagtactatggtagaaaacctacaccgtaattgaggagttgctgaagcctaagagtggaaaagtttgagagttaaaatctccatggaggccagtcttagttcctcctcacttttgagagttttattttcagaagccttaccagattctcacagtagaaatagaaaaatcttttctttctggcatagggaagggaaatgtacccttctaaaagccactcagggcattctgttcttcttaccaagctctgccatcattaaactattttagcaaagcctgacttactggggttttgtctgagtttatatgacctgaggtaagggaaatacccatcaccaaactgctgcagtattcagttgggaagaagagaaatattcaatttcagaccacttgagcccttcatgtgagcaaagggacatacccaactcccattctctctagccttcctgttagacctaagaggatgggaaatgtgaagcattttctaagataacaacacaggcacagactcgctaaaagacacaacactcacagtggttggaatgaacatatccatctgttctcaataaatgtacttggacaaactgatgggagcagaggtaataagcaacctacattttcctccctgtatctcatgttctgtgtcaacagatgtgtgctctggaggacagagcagttctcctatgtttctttaaaagaagtaagatttttctgactcccaaagtaattttgatctagttccattctgaaaactaaaatccactaaggaacatatacaaagaacaccacaaatcacccgtacggaactcacagggacacattaggaaatgtgacactgggttgtactaattttgaaggctgtatcattgggagttatactttgttgacaacttctgagaatatacaatccactaggcagaagctacatagaaaaatgagctttgacattaaaatgtctgaaatccagatggtacaacaaaagtttcaaaattgtatactctctacagcatgactgtgaatgtgttattatatatataatatatatatatattatatatgttatttgatgtggcaatgagtgaggaggctggattacccagaatgtatatgagataatcagagttaaccacgaagtgggtaaaattaatatgaagatggtaatcatttggaacactaaagaacactgataatgtgagatctattgtttttcccagatacaagaaatacgtttgttattaagactaacacgctttcctcttctgttatgcttaaaaatgcctctttttttccccaagcttccactggactttgacccaacacctttttttttcttcaacatcttcacattcctttaggatcacagatctaagcaccatggcctgatcagctatcacttggccttcattaatattcctcactgtggtggatggttggtctccaggtatgcttgaatcactgcacttagagaatgagttcaaacttaagtccttgttctacataaacagagtgaggatggcctatgtatctgtaacacctgtctcctgagtgtacacccagccagcaccatcagccccagcaactgccagttggcaaggtttaaacagaaattcacaaataacattatcactgtcatctctttttatttttttatttttattttttggtcagtttgtctttcagtagtgatataatattcttcactgtggcttcttccaatgtgatgcataccagtctacttaaggtcagcaaatactgttccctttctcccatgaagtcctttttttactctgacattatccggggatgtcttcattataggaattacactgcattcaatcacacacatggtgatctttttgtcccagcatcagaggcaatcccagcaccttcacagcaccaggatctctccaagagccttcccagagaaaagggccattcagaccatcctgctgttagtgagctactttgggtgctgggtggacctcatcatatcatgctcttcaaccctgctgtggacatataacacagtcatcctgagtgtgcagaaccttgtgggcaatgtctctgccactgttgttccactggtacgaatcagctgataaaaggatagctgacattctccaaaatatgcaaagtgctataaagatttaacgagttagcaatggaaaacatttctaaaagaacagtcttatcctataaattgttcaagtagccttggaattctttttatcttatttaataaattgcatggaatcacacttttattaatatttatatgctttcaaaactgatgcatccaagaactatgtaatttctttagttcaatgtctaccatgggtagacatttccatatcaagtctcttacacttttattttcattttatcttggtagcagaaaatgtttctctcgaagtatactcttaacaatcttctatcggtaatcaaatctctcaaagtttttacttctgaaaaaatttaatttactcttatttatgaaagacactttagctaaatatcaattttagcttttatactaagcttgttcattagaacttccctgactggaaataatatgtcaatttggattttacatttaatctataatttattttaaagggattaaaataaaatttacatgtaaatagttgttcttctttattaatgaaatttacttatacattaactatagcctccatgctgtacattaggtctccagtccttattcatattataaaacaggtttgtaccatttgaccaatatctgattcccccaagacacagcccttggtcacttgcattctattgtctgtaactgtaattcaaacacttttttagactccacatatgattgaaataatgcagtgttcatctttctgtgcctggtttatttcacttagcctaaagacctcaagatgatccatgtggttgcaaatggcaaggtttttttcaagacctgaactgtgacacacacacgtgcacacacgcacatacctatacctatacacatacatatatatatatatatatatatatatatatataatttccttgttgttgttgttgttgttgttagatacaacaggctggagggcagtggcatgattatagctcactgtaacctctgaattctgggttcaaattattcttccacctcagcctccaaagtagcaaggaccacaggggtacaccaccatgcctagctaatttgtaaagacatggtcttgctatgttacccaggctgatcttgaactcctggcctcaagtaatcctactccctcagtatcccaaagcactgagattacaggcttaagccaccatgctcagctatataatattttacttacttctgtgttaatggacatttaggttgttttcatatcttatctattgttaataatgcttcaataaacataggagtgaaaatatctcttcaagatagctattttatgttccttggatatttacttagatgtaagattgatgactcatatgacagttctatttttaattactcgatgaacctccatgccgttttccataatcgctttaccatttacattcccagtgatagtgtacaaaggtcccttttctctacattcttgacaacacttgctttcttttgaatttttgataaatatcaccttaatctttgtttgaatgcgatctcattgtggttttgatttgcatttttctcctaattactaatggcttctttaaataaataacctattagtttttggctactttttaaaaaaatgtatcactttttattgttacttttatttcggggtgttaagttttatgagtttctggcagatttcgaatactaatcctttatctgatatttggcgtacaagtatttttctccaattctgtaaatagccttttaaagacactgaactgtcttttgctatgcagtagactttttagtttgatgaagtcccacttttttccctgtgcttttggcgtcaaatacaaaaaaattatggctaggaccaatgccaaagcattttcctcagtgttgtcttctacaagatttttcgtttcaagtccagtgtctacgtctttaatgtattttaaattaactttatgtatgctgtaaaggctgggtgcaatttgtttttgcatgtggatatcgcattttcccatcaccatttactgagcagtttttttctttttccattgtgtatctttatgccattgttgaaaattcattgactgtatacagatggagacatctgatatatatatatatatcgatatatatatatataaatacatatatatatgagctctctattctgttccagtggtctatgtctttgtgtttatgccaatattttgcagttttgatgactacaactttgctatatagcttgaaatcaggcagtgtaatagctttgtccctcttgctcaaaattgctttatttgagtcttttataattccatacaaacagtagatttttaaaatttttgttgaaaatgcaattggaattctgatagagattgctttaaataatacatcaattttagtatgaatgttttagtaataatttttctgatccatgaacactaagtatttttaaatttatcttttctataattgcccccattaatattttacagttttcattatacaaatcttttaccttattatatttattcctaagtattaggttgctgcaaatgtaattgtggtttttgccattaccaatccaatactttattctttctcatgttacagtaaatgtaactgtcttcttgctttttcccagatatttgttgttggagtataaaaatgcaattgattttctttacattgatatagtatcccgcaaagttccttagtttaccagttctaaatttttttcatgtcatgatgagcacactggcctgtgtttacacattaattgacagtttctattaatctatcacagagcctaaaagtgtgctctgttgtatttttgctgtgacaaattccatggcatcttttagtcttaatctttttttaaatgcttttgtttggtacttgataataaggtgtgtctttgtttacttttcaattgtgaaacacatttatctccatgcctagtcaaactttctaataaagttctctaatagttttatgtacatttagttattataaatcaaaatagtaaatttttatgatagtttcaaagttactaagattgaaaatgtcaatttttcactgctcatgaatctgcggtttccttattttaaacaattatgtatgatgtctatatatttgtgtgtgtgtttaatggcttacaatcttgcccaacatatttgtatgtagtaagcaagtactaatcaaattaatcaaactatcatcttgatactattcttcaaatggcatattatgtttgttctaattaaaaactgtgttcatgtcttatataattatcaaaaaaattagaaagtctactttgtctgccctcttgagaaaatccaaagttaaatggtagttttactaatttcctttagaatcactaccttattttcctcacacaataaatgtaaacattattgggtgaagtcaagatggctgaataggaacagctccggtctatagcttccagcatgagcgatgcagaagacggctgatttctgcatttccatctgaggtaccgggttcatctcactagggagtgccagacagtgggtgtgggacagtgggtgcagcggactgtgcacgagccaaagcagggcgaggcattgcctcattcaggaagtgcaaagggtcagggagttccctttcctagtcaaagaaaggggtgacagacggcacctggaaagtcgggtcactaccaccctattactacgcttttccaacgggcttaaaaaatggcacaccaggagattatatctcgcacctggctggaaggtcctacgcccacggagtctcgctcattgcgagcacagcagtctgagatcaaactgcaaggcagcagcgatgctgggggaggggcacctgccattgcccaggcttgattaggtaaacaaagcagccaggaagctcgaactgggtggagcccaccacagctcaaggaggcctgcctgcctctgcaggttccacctctgggggcagggcacagacaaacaaaaagacaagagtaacctctgcagacttaaatgtccctgtctgacagctttgaagagagcagtggttctcccagcacgcagctggagatctgagaacgggcagactgcctcctcaagtgggtccttgaccccggagcagcctaactgggaggcaccccccagtaggggcagactgacacctcacacggccgggtactcctctgagacaaaacttccagagaacgatcaggcagcagcatttgcagttcaccaagatccgctgttctacagccactgctgttctgcagccaccgctgctgatacccaggcaaacagggtctggagtggacctctagcaaactccaacagccctgcagctgagggtcctgtctgttagaaggaaaacaaacaaacagaaaggacaaggacatccacacgaaaaactcttctgtacgtcaccatcgtcaaacaccaaaagcagataaaaccacaaagatggggaaaaaacagagcagaaaaaccggaaactctaaaaagcagagcgcctctcctcctccaaaagaacgcagcacctcacccgcaacggaacaaagctagacagagaatgactttgacgagctgagagaagaaggcttcagacaatcaaactactccgagctacaggaggaaattcaaactaatggcaaagaagtaaaaaactgtgaaaaaaaattagacgaatggataactagaataaccaacacagagaagtccttaaaggagctgatggagctgaaagccaaggctcgagaactacgtgaagagtgcagaagcctcaggagccgatgcgatcaactggaagaaagggtatcagtgatggaagacgaaatgaatgaaatgaagctagaagggaagtttagagaaaaaagaataaaaagaaataaacaaagcctccaagaaatatgggactatgtgaaaagaccaaatctacgtctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagatttaccaaagttgaaatgaaggaaaaaatgttaagggcagccagagagaaaggtcgggttatccacaaagggaggcccatcagactaagagcggatctcttggcagaaactctacaaaccagaagaaagtgggggccaatattcaacattcttaaagaaaagaattttcaacccagaatttcatatccagccaaactaagcttcataagtgaaggagaaataaaacactttacagacaagcaaatgctgagagattctgtcaccaccaggcctgccctacaagagctcctgaaggaagcactaaacatggaaaggaacaaccagtaccagccaccgcaaaaacatgccaaaatgtaaagaccattaaggctaggaagaaactgcatcaactagtgagcaaaataaccagctaacatcataatgacaggaccaagtacacacataacagtattaactttaaatgtaaatgggcaaaatgctcccattaaaagacacagactggcaaattggataaagagtcaagacccatcagtgtgctgtattcgggaaacccatctcatgtgcagagacacacataggctcaaaataaagggatggaggaagatctaccaagcaaatggaaaacaaaaaaaggcagaggttgcaatcctagtctctgataaaacagactttaaaccaacaaagatcaaaagagacaaagaaggccattacataatggtaaagggatcaattcaacaagaagagccaactatcctaaatatatatgcacccaatacaggagcacccagattcataaagcaagcccttagtgacctgcaaagagacttagactcccacacattaataatgggagattttaacaccccactgtcaacattagacagatggacgagacagaaagtcaacaaggatacccaggaattgaactcagctctgcaccaagcagacctaatagacatctacagaactctccaccccaaataaacagaatatacattcttttcagcaccacaccacacctattccaaaactgaccacatagttggaagtaaagcactcctcagcaaatgaaaaagaacagaaattgtaacaaactgtctctcagaccacagcgcaatcaaactagaactcaggactaagaaactcactcaaaaccgctcaactacatggaaactgaacaacctgctcctgaatgactactgggtacataacgaaatgaaggcaaaaatgaagatgttctttgaaaccaatgagaacaaagacacaacataccagaatctctgggacacattcaaagcagtgtgtagagggaaatttatagcactacatgcccacaagagaaagcaggaaagatccaaaattgacaccctaatgtcacaattaaaagaactagaaaagcaagagcaaacacattcaaaagctagcagaaggcaagaaataactaaaatcagagcagaactgaaggaaatagagaccaaaaaaacccttcaaaaaattaatgaatccaggaactggttttttgaaaagatcaacaaaatcgatagactgctagcaagactaataaagaagagaagagagaagaatcaaatagacgcaataaaaaatgataaaggggatatcaccagcgatcccacagaaatacaaactaccatcagagaatactacaaacacctctacgcaaataaactagaaaatctagaagaaatggataaattcctcgacacatccaccctcccaagactaaaccaggaagaagttgaatctctgaatagaccaataacaggctctgaaattgtggcaataatcaatagcttaccaaccaaaaaaagtccaggaccagatggattcacagccgaattctaccagaggtacaaggaggagctggtatcactccttctgaaactattccaattaatagaaaaagagggaatccttcctaactcattttatgaggccagcatcatcctgataccaaagccgggcagagacacaaccaaaaaagagaattttagaccaatatccttgatgaacattgatgcaaaaatcctcagtaaaatactggcaaaccgaatccagcagcacatcaaaaagctgatccaccatgatcaagcaggcttcatccctgggatgcaaggctggttcaacatatgcaaatcaataaatgtaatccatcatataaacagaaccaaagacaaaaaccacatgattatctcaatagatgcagaaaaggcctctgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaacacagggatgccctctctcaccactcctattcaacatagtgttggaagttctggccagggcaattaggcaggagaaggaaataaagtgtattcaattaggaaaagaggaagtcaaattgtccctgtttgcagatgacatgattgtatatctagaaaaccccactgtctcagcccaaaatctccttaagctgataagcaacttcagccaagtctcaggatacaaaatcaatgtacaaaagtcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaatattctatgctcatgggtaggaagaatcaatatcgtgaaaatggccatactgccctaggtcatttatagattcaatgccatccccatcaagctaccaatgactttcttcacagaattggaaaaaactactttaaagttcatatggaaccaaaaaagagcccggatcgccaagtcaatcctaagccaaaagaacaaagccggaggcatcaagctacctgacttcaaactatactacaaggctacagtaaccaaaacagcatggtattggtaccaaaacagagatatagatcaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctacaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggttaatatccagaatctacaatgaactcaaacagatttacaagaaaaaaacaaacaaccccatcaacaagtgggcgaaggacatgaacagacacttctcaaaagaagacatttatgcagccaaaaaacacatgaaaaaatgctcatcatcactggccatcagagaaatgcaaatcaaaaccacaatgagagaccatctcacaccagttagaatggcaatcattaaaaagtcaggaaacaacaggtgctggagaggatgtggagaaataggaacatttttacactgttggtgggactgtaaactagttcaaccattgtggaagtcagtgtggtgattcctcagggatccagaactagaaataccatgtgacccagccatcccattactgggtatatacccaaaggattataaatcatgctgctttaaagacacatgcacatgttatgtttattgtggcactattcacaatagcaaagacttggaaccaacccaaatgtccaacaatgatagagtggattaagaaaatgtggcacatatacaccatggaatactatgcagccataaaaaatgaagagttcatgtcctttgtagggacatggatgaagctggaaaccatcattctcagcaaactatcacaaggacagaaaaccaaacaccgcatgttctcactcataggtgggaactgaacaatgagaacacatggacacaggaaggggaacatcactcaccggggcctgttgtggggtgggggcaagggggagggatagcgttaggagatatacttaatgttaaatgacgagttaacgggtgcagcacaccaacatggcacatgtatacatatgtaacaaacctgcacgttgtgcacatgtaccctaaaacttaaagtataatttaaaaaaagaggaaaactacttgaataagcttcttttgctgtttttataaagcaaaaaaaaaaagagattcactatcagtagaactaatacacaaatttatccgtgttacaagacagaaaactggcatgccaaagtagattatggtttatataaaagcaaccaacaattaaaaataaaataaagaaaacaattccacttataatggcatcaataaaaaacattaagagaaaaaaattcaagacagatacaggaattttacacaatttgtaacactgaaagaaatcaaagataaactgaaaaataactggaagtcattttatgttcaaggatggactgtttgtaaggcaaaggttacatgtttgaggggatggataccctaccctccaggatatgagtgattattatgcattgtatgcctatatcaaaacatcccatataccccatacatacgtatacctacaataattttttaaatacttattattcttaggataacaataccctataaattgatttgcagattcaatataatcccttcaaatttccaagtgtatttttttagaaattagaaagtctctcactcccttaaatcaatatgtatgtacagaaaatcaaattgcacaaaacaatttttaaaaagaaaaacagaatcaaatgacttatacttcctaatagcaagtcttactagaaaggatagagtacaattccgcagtttcttcacattttccatctgttctgaccaagaatacacagacgcttgacttctctgttattctgtggcccggatacctgcatgctttcccctgcagacttgaacccaagccagggctctgaacattcgcagacataagtaaaggtgttgtgtttaggttgtaattcaaaacactaaaagaaagtatccctggtcctgggagattccttaaacgctcctataaactgcataaccagactcctcactgcaaagatacctagacaaagcatccttggtctcctttcctcccaataagatgagctgcagccctcactgtgtgtacatcccttaagaaatgctttgggctcatcataccagggtttagagtttacttctttggaatcctaacccccttcatctcaggacagtctgggacagtcccttgtgaaaattcctctgtgatcacctttggggcaactccagctaagtgctgagctggaggaagaagtagggaagtcagcagagttttaaggaatgggctggggaaaagaggatcccattcggagatcctgagatacctgtaagggtctacgtgggctttgttgcctgcccctccctgatgtccgcgagctgccccagagatgctgagatgctccaaaatctccagcaggatacaggagggtgatggagggtctgaaattgcaaaggatcagtaaggaagtctggtgcttggatatagagggacaggactggttggcatcagccatgggcagcctgcatagaaacaggctaagctggaggcccagagtaaggtgtgcaaggccctggggaaacaatgatgaatgatatcctcaagggacacagggtctaacagaagatagaattttacagaaagatgattctggcttctctgttctatgctggagtagaattacataccagggaccaaggtgggcaaatatggagtgcctaactctgggtatgggagtctgagaaagtttcccaaaggagaaggcagactcatagtatcagtgaaaaatgctttattaaaagtggctgccaaacggagagagagatctgccctctcagggagttggggtgatggtgggagtggtggtggattctgaaaagcttcacagaaaaattgatacgaaaggctttgcaggattatgaggggtgtgtaatcttgaaatgcagagggaaccagactggcaaatgtttggtagcacagaagtatacagcgcctttggtaaatgatgtgtagtacagtggctagaatgtaggtgtaggatggaagtccaatgtagtgcccgagtgtagagggctttgaattttatatgaaggagtctgactattacagcaggtacttgaataatgtcatttcgttcagtatcatttcattgtaatgttgataagaaaaaacaatcaactcccagctggccacttcctgtgtgtcctttacacattctccccaggtccacatgggttttcactgggtactcccagtttcctcccacatctcaaagatgtgcccattatgtgaactatcatttctaaatagtccccatttgagctctgtgtgtgtgtgtgtgtgtgtgtgtgtgtgtgtgtgtatgtacactctgccatatgatggcaccctattccagatccagggctggttctgcctagcgccctgagttgctaggagagactccggccacccatgacccctagctagaataggtgggtaaataataatcttacttgtttttatcactgataaagggagttttttcctgctttgtattagtcgcaaagcaagaaaacccaatcagaaacaaggccaagtgggttttttccctgcctgggatggagaagaaaagagttcttgctctaaagacaccctttccctgaaaaatggaaggcatggagtttttaagaactaggtacggggagggagaacaacgttagcatgagcagggtggaactctaggtgcacaggttcagtgcatataaacatacatctttatacaactcatgtcacaaaatggcaagattttctttggcagagggaattttagtatcatagtgatatgttaatgatctaggccagaagcggtggctgacgcctataatcccagcactttaggaggctgaggcatgtggatcacctgaggtgaggagctcaagaccagcatggccaacatggtgaaacccagtctgtactgaaagaaaaatacacaacaaaattagccagataagttggcatacacctgttaattccagctactcagaaggctgaggcagaagaatcgattgaacctgggagccagatgttgcaatgagccaagatggtgccactgcactccagcctggacgaccgagtgagagtctgtcaaaaagaaaaaaaaaaaaagttatctaaaagcaactagggctcacctgttcgagtttgtgctggttggggatcttatctcctggtatgtggtcaggggtggagaagccctggtgctggtgggccaactggtttctttatgcagctatgcctacaaataaagaaactaaagaaacacagtaataaatagatctttcccagttatttcatcagggtggccctggtaacatttttattaatttttctttatcttttttggggggggggggcggtggggagatggagtcttgctctgtcacccaggctggaatgcagtggcacgacttcagttcactgcaacctccacctcccagattcaggtgattctcccgcctcagcctcccaagtagctgggattacaggcacgtagcaccatgcccgggtgattttttgcatttttagtagagacaaggtttcgccatgttggccaggctggtatcacactcctgacctcaagtgatcctcccaccttggcctcccaaagtgctgggattacaggcgtgagccaacacgcctggcctaatgtatgtagagctcacatttttcttaaatgtatgtagagctcacatttatttcagtatttaatactggaagtgttttaggcctttctaagtttggtgatgttcttgtgaccagaaatatgccatagaaacttaactatttctatcaattagactatggtaaggttggcttaattgtaggtcacagttttcaagaatgtattaaatcctcacactaagtgagaacttaactgtattcagcaggcaatggagagtcaggaaagtttaagcaaaaatgtgtaattattctaccagaaaatatttgataagacataattttatgaaacatcaggtttataacaaagttattaaattatgtacatattagggttgtgaagataaaggccacataggcccatttcaagtcaacacataaacatagaaggatgattaacaaaataagcgtgtagcttatgctaaatgttgattggaatagacaataaattatggagaacttcacaggatactaagcttggatgggatcttagaagttttacaggtcaatgccactccatctactggctgatttgcactagtttaataaatgaacaacaaagataacatgtatcagtaaaagttaaaatcattttattgaatatctgtcatgtctgtgccattgtagtgtactaggtgccttataccacttatgagtcctctacttacaaaacgcttttcacaaaatatgagtctccaaagtcaatggcatgaatagttgtggtccagacatatgatgtttgtttttaaaatctttacacagccttgtatcctttttccttttcttccttttaccctttttaaaatgtgctgagttttatctaaggctaacctctgtaatgttgctatatgccagtattcagttactgtgtttgatgaatcataaaatggtgtgaagctttaattagtgttctttttaaataaaatgctgtttatgaatgcatccatcaaaatgcttttgatttgggtattcacaaaatattagttttctgtggatctaacaataatgcaaaaatccaaaatgaatataaaatattagctaatatatatttcaaagtattctacaagtataaaaactattgtatgacattactttcatatatgtaaaaaataatttttagtcaacataaacatactccttatatctaaacttgtattaattcatttaagagttaatatagtattgtaaagtcatcaaatatttaaaaacaaaatgtattttgacttagaatatacataaaattaactattttcagctgagtccagtggctcatgcctgtaattccagcactttgggaggccgaggcaggtcgactgcatgaggtcaggagtttgagaccagtctggccaacatggtgaaaccccatctctactaaaaatacaaaagttagccaggcttggtggagcgtgcctgttatcccaactactccggaggctaaggcaggagaatcacttgaaccccagaggcagaggttgcagtgagccgagatcgtgccactgcactccagcgtgggtgacagtgagattccatataaaagtagtaataataataataataacaattttctgtgagtcccaagataaaatagcattacagaacactgaataatcctgagtttggttttcttggttgcattctgctttatatttagttttgttcaccttgaccagtgggcttgtggttcttaggtgcaacagggttttcatttttaggttcaagattttaaagctttaatgtggtaatttctctaatttttttgacagttatttctcaggttacaagttaaaataaaatttccatttcactgaagtctttggtttattaatgatttcatgacttaatatacaatgagtaataaggggtgctacaaattttcagaaatcaacactaaataacttactcatggaagcaaacactacctgtttcccaaacacctattaaaatacaaaaatttatcaatagtttttaaaaataactaaaaatgagaatgaaaaaacatatatccaggttaaaaaaaactgtatttcaattaaatgacaagtaatttttggggggtctcagcgctactacaaaattatttgctgtttattataactaataagacagctacaaaataattttttaaaatgaagaaatagtaagtacaaaaaagatattaacaaatattggtatattggtgaaggctggactcagtggctgttttccaaagtggttataccagtcgggtgtggtggcacacacctgtaatcccagcacttctggaggcagaagcgggcaatcacttgagctcagaagtttgacctaggctacatggcaaaaccctatctctaccaaaaaatgtaaaaatcagccacacatgatgacaagtacctgtaagtcccagctacttgggaggctgaggtgagaggatcacttgtgcctgggaagtcatggctacactggccatgttcatgccactgtactccaccccgggcaacagagcaagattttgtctcaaaaaaaaaaaaaaaaaaaacagttggtgacaatgtggaagaactggaacccacacacattactggtgggaacataaaatggtgtcatcagtttgggtgtttcttttctggtcaattgatttttttaaaaatcaagatattgtctccctatgttgcccaggctggtcctgaagtcctgggctaaagcagtcctccaaactcagcctcccaaatagctgagattaaaggcatgagccaccatgcctgactggtgtaaccactttgaaaaacaacgtggcagtttctccaaggctaaatgtatagttatcacataatgcaacaatttcatttctgggtgtaaatccaagagaagcagaaatatatgttcacacaaaaacttgcatgtgagtgttcatagcaccattactcatgacggtttatatgcagaaacagcacaaatgtccatcaactgatgaatggctaaacataaactattattcagcaacaaaaggtaagaaatactgatgcacactataacatgaaagaaatttgaaaacattgtgctaagagaaaaaaaagcaaactacaaaagatcacatactgtacaattctatttctattaaaggtccagattaggcaaaactacaataaaagaaaataaatcagtggttgcctatgaagacacaggaacgtgggggaagtaggaggtagcagctaagaggtgagggtttctcactcttaagtgggtaactcataaatgggtaatcgcttctaaaagtgactgtggtgatggatgcacagcttcatgaatattctaaaaactactgaatttctctctttctttcctttctctctctctccgtctctctttacttctttcctctctcactctctctctttctcgacatggtctccttctgtcacccacactagtgcagtaccgccatctggtctcactgcaacctatatgccttctgggcttaagtgatcttccagcatcatgtcctcaagtagctaagactacaggcatgagccaccatatccagctaatttttgtattttttctagagatgctgttttgccatgttgcccaggctagtctcgaactcctgaactcaagcaatccacctacctcagcctcccaaagtcttagcgttataggaattagccaatacacccagcctgaattgcacactttgataaatgaattgtgtgagatgttaatcatatttcaattaaattattattataaaaagggccagatgcagtggctcacacctgtaatcccggcactttgggcggccaaggtgggccaactgcctgaggtcaggagttcaagaccagtctggccaacatggtgaaaccacatctctactaaaaatagagcaaaaattagccaggtatggtggcatgcgcctgtaatcccagctactcgggaggctgaggcaggggaattgcttgaaacagggaggtggaggttgcagtgagccgagatggcaccactgtactccagcctggacaactgagctagactccatctcaaaaaaaaaaaaaaaagaaaatgggggttgagcacaggtggctcaggcctgtgcataattccagcactttgggaagctgagacagagagatcacttgaggccaggagtttgacaccatcctgggcaacatagcaagatcccatctcaacaataaaaaataaagaagttagctaggcacgggggcaaacgtctgtagtcccagctacttgggaggctgaggttggaggattgtttcagcccaggggtttcaggctgcattgagacataatcaagccactgcactgcagcctggtgacagagcaagagcttgtctctaggaagaaaaacaaaagtaatgcaagttttcgtcaccttctgagagtaatcgactttcaggaggactagaaaaacaaaaaaaaggaccactgaatggttgagggtgtgttcctggttaggctcagttgctggctgagtagtatctgaaaaattaattagtaaaattacagctctagggatcagtcatgcagtcaccatagccaggactacaagtgagcatcacaactcccagctacttttttttttttttttttttttgtggagacagaagccttgctatgtgcccaagctggcctcaaaactcccaccctcaagagatcttcccacctcgacaaccagagtaactgattctacagacacatgccaccgtgtctggataattatattttattattatttatttgtgtagagaggagatcttgctatgttgccaagggtggtctcaaactcctggacttaaaacaatccccccatctctgcctcccaaagtgctggcactacaggcataagccactgcaccagcctgacttaaggtttccttaatctagcaacccatacttcatataattgggaaaggcagtactgtttttttttttttaattacttagtatttcaacaagaatcaaccatctctcagggccaggcacggtggctcacgcctgtaatcccagcactttgggaggccaaggtgggtggatcaaaaggtcaggagttcgagaacagcctggtcaatatggtgaaaccccgtctctacaaaaaaatgcaaaaattagccaggcgtggtagcaggtgcctgtagtcccagctactcaggaggccgaggcggaagactctcttgaacctgggaggtgtaggttgcagtgagctgagatctccccactgcactccagcctgggcaacagagcgagactccgtctcaaaaaagaaaagaaaaaagaaaaaaaaagaatcagccatctctcaccattgccatgaccctggtcaaaaacacttatctcccatctggatgttgccacagcttggcctccctgcttctacccaaatcttcccacaatctttctcaactcagcagccaagggatgcttttaaatcaggagacagatcatgttgcctctctgctcagaaccctcccacagttccgatctcagtcagagtaaaagccaaagccccagcaagagcctcccagagattacacaatctttactgatcagacacaccatggagttccctcctagcatctttatcctgttgtttctgcctacaatgctctcacctcagcaccttggccagttgcttcccccacttcaagtctttgataaattttcacttagggcaaccctggccactctatttaatattgccatctgtccccattcctgccatgctcttttttttccacaaaatctcgctgtgccactcaggctggggtgccatggcacaatcacgactgagacctcgaactcactggtgaagcaatcgtcctgcctcagcctctctagtagctaaagactacaggtgcatgccaccacacctgctaattttttaaaaaatatatggagcatcactatgctccccaggcttgtcttgaactcctgggccaaagcgatcctcctgcctcggcctcctaaatacctggaattataggtgtgggccaccagccctgggttcatgttcatttcttcttgctgctgttacaaactgccctacattgagtgccttaatacacgacaaatctactacctaacagttctgggagccagagtccaaaataggtcaattaaggctaaagtcaacgtgtcagcaggactgcattccttctggaggctccagagaggatgggttcccttgcctttctcagcttctaaaagccacccccatttcttggctcatggcccctaactgcatcttcaaagccagaagcgaagcatattcaaatctccctctctgacctctgcttccatcatcacatctcctccaattctgagtctcttgcctccctctttctcttataaaaacccttgtgactgctggacacagtggtcgtggctcacacctgtaatcccaacagtttaggaggtcaaagcggggaaacacctgaggccaggagctcgacaccaacctggaaaacatagtgagatccccaactaaacaacaaaaaccaaaagaaataagaaaagaaaaaattggctgggcatggtggtatgcatctgtagtttcagctacttgagaggctgaggtgaaagggttgctttagcccaggagttcaagaccagcctcggcaacgtaacaagatcccatctctaaaaaaaaatacaaaaattagctgagcatggatggtgtgcacctgtagtcccacatacttagaaggctgacgcaggagaattgtttgagcccaggtggttgaggctgcatcactgcactccagtatgggtgaaagaaagagactctgtgtccaaaagaaaaagaaaagaaatacacatctggtttctgcccctggtcctggcacaaagcttctaaagttctcataaagttctcagtgataaagttgataggagcatcttttgtttcaatatttggtcttagtcccaggtttctaacacaagaccctctaagacctttgggatctccaccatagtaagaatgcatttgatgatgctactgagatgactgggtgactgaaagctcccagacagcttcaggaggagggctggttgccagaacaaaccatgtgattagaggcttgaaacttgcagcctcacccactgagctccaggaagaaatagtggctgaagattgacttaatcaccaatggtcaatgattttatcaatcatgcctgtgtaatgaagccttcagaaacaccctaaacaacagggtttggagagtgtctgggttcctgaacacaagggggatactgggagggtaacatgcccaatagacggcatggaagctctgtgcccctctccacataccttgccctgtgcatcttttttctttcttttttttttttttttgagacagggtctggctctgtctcccaggctacagtggcacaatcgtggatcactgcaacctatgcctccctagctcaagccatcctttcacctcaacctcctgagtaactagaattgtaggcacatgtcactgcaccaggctaatttttataaaattttttttgtaaagatgaggtttcaccatgttgcccagcctggtcttaaactcttgagcttaagcgatgctcccgccacagtctcccaaagtgctgagattacaggcatgagcccagcatgtacacctctttcactggctgtttctgagatatatcctttacaatgaaccagtaatagaaagtaaattggtgagacccagtggctcacgcccataatcccagcactttggaggttgagatgggaggataatgtgagcccagaaatttgagaccagcctgggcaacataacaagaccccatctctacaaaaaataaaagaatatagccagatatggtggtgtaggcctgtagtctcattgggaggctgaggcaggaggatcacttgagcccaggagttcgaggctacagtagctttgatcacattgctgaattccagcctggcaacagagtgagactatgtatctcagaaaaaaaaaaaagaaaataacctgtttttctgagttctgcaaactgttttagcaaatgattcaaccaaagaaggaggtcatgagaccccagtttctaactggttggtcaaaagtacatgtaacaacctagggtttgcaactggcatgtgaagtgaggatagtcttgtgggactgagcccctatcctgaggggtctgcactaactccagttagtgtgagaatggaactgtgagatacccagttggtatccagattgtccgaaaactggtgtagaatctctgcatttggttggatgtatttgaccacagctactattcaggaaaaagaactactcattataaagaaaaaaccataaaattatatgttctacaaaaaacaaatcaaccttaactacagcccagtcctactcaaatatagactgttagaacaaaaggtctcaccatggactcgagagctgacatgaggaatgtcacaaacatcccgctctctgagaactcctcatcttcaacgagcggggggacactgcaactttggccatgatccctgcgcaagaaaagtagtaagaaagtgagtggtagaaatccagtgtcttaaacccatatccagagctgtgagagttttttttaccagctggctaatttacacttgtcttgcatcagaggaaaattaaggctcagaaactagatattcgatttgtccaaaactctcatcagatacagaatccatccgctaactttctatctggcattatttccataaaattagaacagtatcactcccaaaataaatccatatggcacccagcatcaatgcatttctcccaagtaaaataggaggcaaggcgctttacaacccagcgacgggctaccacaacacaggaaagaggtgccaacctccctttctcccctgcacaacccaacacaaaaaagagtgggtgcagtggaatgaggctgggtgaagagaagttcctcttcttagtgagaaaatagatcacagggcatcaagtaacatgtaaaagtctctataataaggcatttttttgaaaacgttttctaatattttggtatcaagaaaaccctcagatgaatttcaaacaccataaaaatacaatacataaacagaaaatattaactgtcaacaatgatatcgataaattgtaacctttatggatggctttttggaatgtaaaatggtacagcccactgtggaaaatggtttggcagttccttaaaatattaagcacagaattatatgatccaacaacaccctttaagcgctatatccaaaagaactaagatcagggactcaaacaggtatttgtacacccgtttaacagtagcattattcacagtggccaaaaggtagaaccagccctatgcccatcggtaggtgaatgggtaaagaaaatgtaatacacacatacacagaatactatacagcgataaaaaaaaatctcgccaggttcagcagcttacacctgtaattccagcactttgggaggtcaaggcgggcaggtcgcttaagcacagaattttgagaccaggctgggcaacatggcaagacctcgcttctacaaataaaaattttttaaaaaaaggaaattctgacagtgttatcaatgagccttgatagcattatgctaagtgaaataaaccagacagaaaaggacaaatattgtacaagtccacttatataaggtatctagaataaacaaattcatagaaaatagaatagtaattgccaggggccaggaggacggttcaatggggagctattgtttatggagtacagagctgcagtttacaatgatgacaaagctctggagatggagagtggtgatagctaacaatgcggatgtgcttaacaccagggacctctgtgcacttaaaaatggttaaaagtgttattttatattatgtatatttttaccaaaataaaaaaataaaaaataaaacaagacaccacataaggacatactaagatggcaaaatctaaagcaactttttaaaacccagagagtttttctgtaaatagcatatgaattaaatgcctattaaaaattagcccctttaatttagttgaattaattctacttttagagagagcttaaataattaaataaacttaattggaagcataactgaaaaattaaacactagatgcaggaagaggaactgtaaaaacatatctatgtacataaaccaatttactgacaacactcgagtatcccttaactaaagccccagtattccagagaagatggacaagcacttgaagagctgtcagcaggaaactgttgtacctaaaaatgtcagtaaatcttcattaaagagaatgttctattttcctattattaaaggttgtcacctagctttaccatctgttaccatgtgcattgactactaggccagatttagacatcaagtaatgaagcatacatacttaggaagttacaacttataataacaaccacgatcagaaaaacagtactttgcatcatgaagaccttcagttaccacttagtcttcatcctcatgggctttattgatcaatattgtaaagaggtatattacctcttataacttaaaacaacttgtcgcctaggaaagcataccaaaagaatcatcttttatttccaagtgaggtgttttaagaataatataatctataaaatagaataaacatacaacagaccaggcatggtggctcacccctgtaatcccagcactttcggaggccaaggtgagtgaaatcacaaggtcaggagatcaagaccatcctgaccaacatggcaaaaccctgtctctactaaaaatacaaaaattagctaggtgtggtggctcttgcctgtaatcccagctactcgggaggctgaggcagaagaattgcttgaaccagggagtcagaggttgcagtgagctgaaatcacaccactgcactacagcctggcgacagagcaagactccatctcaaggaaaagaaaatatatatacaacaaatacagtaacacacaaaatctctttttctcctaaccttctgctggtccttcaatttctgctggtactgttccgtcactgccttctacagaatgatggcttcctaaaaagaaaataaacatgtaataaaccaataaaaactcacactgaaaaaagagaatctagataacaatgcaatcacttttaagatataataaacataaaaaaagattcttttaactcaatggaaacaatactttctaattcagaaaaaaaataacacttctattaggcagctaaaaattattattttaaaatacaaatacagagtagaccaaagtaggtttgtggatttaatattagttactgtaactgtatggcaaaattactggatattggaacctgaagaagcacaattatgtttcaagtaccatgttcatctgtcactgacacacacacagacacaccattgtgaatgcttgctttgctcagacacttaattaactctctataaataagtttagggtttgctgtggaatgctccctgctttccattttcactatggtaaaagctacagaaactcgattcccataatttaatcaaagttgtacttaaagtaactcgtaagtaaaaattaaagatactacctttagtatcaaaaaacattttaatccaggtaatataatctgcttgcttctaaaaactgggacataaagcaacagatctgttaggcagtcacatggtaaacaggcttatcctactggagcagaagtttattcacaaataggaaagaaagaatctaagatatcggagctccagtaaggattaagaccacaagctgcccccaatatacatcttctgtccttgaagatctgagctactaacatggaaaagactgaaaaacactgccttcaagtataaataaaaaagtattgcattttggtaagaatacatcgcttagggggaagggaagcagatgctcatctattttgtcctgtctattgataaattcagaagctgtactaaaagttaaataaaagttataaataaactttctcttaatttttaaagagtaatgattaccgtctgaaaaattcatttgttggctactattcttgaattaaaagtgccatactgaggtgaaatctttttggtttccagtatctagctttattatgtaataattatcttgggattcttttcaacttactgcatattgtgaaaactcacctgaactcaaaactctaggtaaatctataaacctctatgaatccatctttaattcacttgtaaaacatactttctctgcaaacatttcctttcttttcttaaccttaatatttggattcagggagcattaagttctttgactgcaaagtcaaagaaaaaagagatgtgaggtcaaaggaatgatagataataaagaagaggccagtaattaaaacgtaaaatttcagtaaagagtaacagttaagatggttgttcatgttattacccaaacaccaagggtttggtccaggtcctgctgctcaccagacagaaactagtcactgaggcgacaagtattaccaaggaagaaagctttaacctggtgctgcagcccaggagatggggtctcagtctcaaatttatctccttgactcacttaaactagggtcaggaaagaaatacaataatgtataagagaacagaaattaggggctggcaggaggcatctagtgcggtgatctggtatgtttcagttatttgatacttcctgaaggtctttttttgaggagacaactcagataaaacagatacaagtttcaaggtttaacagcagggtcaactcttatgttgatccaaacaaaaccccatccatgggacaattgggctggtgtcaatgtaagcaataattctataggtcctttttgttcaaaatctgaacaattaaatttatattatatgctaaaccaaaggaaaatacatcttatgtactcgaggccagaagagataggagtaaaacctactactaaatagcctatgagtgtcaagtttgggaacactacaaaaaattacaaaaaagtaataaatgcataaaagttacagattaacaagtgctatttcagaattcttctaaatactaagtacatgaccttattaatatttgcattactaaccacacaataagaacctgacttatgactattctgagataaggtataaatgtgtacctttaccttaaatgggaaagtgtgtcatatacccacatcgagattcacaaaagggaaaactgatttgaaaaattgttgcttgtgaagttcatttatacgttaagaaaaggccaatacaatttttccttttcaatatagaaaagtaattcttaatactatagttataaatactaaaacacagtctgtggaatacaagaaaccattaaatacaaacagtatgtaggaaagtggaggtaaaaagattacaccttgcaaagacttcaggacaagttttgcatgtcatcagtttcagaagggcctgctttgagatacaaagataatacttcaacagtaaccccccaggccagaggcagtgacttatgcctcagcactttgggaggccaagacaggcagatcagttgaggtctggagttcgagacagacctggccaacggggtgataccccatctctaccaaaaaatacaaaaattagctaaatgtagcgacatgcacctatctagtctcagctactcgggaggctgaagcaaaagaatcccttgaacctgaaaggcagaggttgcagtaacccaagattgcaccactgcaccccagcctgggagacagagagagaatctgttaaaaaaaaaaaaaaagtcatgttcacgtagagttaggctccacagttcactctcttaaccatcctgtattctacccactctatgctatgcccggtcactgatgcacctgtatggtagctcatggcccccttagagcttagaacctaggtttcatttcctgctctacagctatataatttaacaattttcctctcgagtttgttggattctaaccctatacataacaaatcttattaatattactgcatcttaaagggggctgtgatgtcttcagtccctagaaacattaaacaacctataaacaaaggaccatatgagggtaaacagaatccaaatttctatacgctttaaaacgctgaggcaatgtactgagaaacacacctaagaaactgcaaccaatctactgtcgacaaaaatttagacgctgtcgacaaaaatttagacactgtctcttcaaaataagctatctggtggtacttatccatattcccacatgtatcaacagtattttacatgtcataaacttaaaaataattttaaaagtgtcaaaattataggccttaatccatttctgtgggcttgaaaaatgataaaatatacatttgtttctttattcaataaaatgcataaacttctagtgcaatcactaaaaaaagagttcataccaaaggttgtaatactaggaaagagggctcaatactgcaggttcttaaagacaaaagttaataaagccttgtttttggttgtgaatcttggccttaaaacattatttgcatgatccccgcttccttttcctgttgtaaagatgtggtgacaaaccaggtttggtcacgcagataataatcttgaaaatagtgggagggaaataacatgaagggaatatagtttacctaatgacctcctaaattggaacttattacccccatgcctcttgcatatctccagactaatatgtaagacagatgaaacagctgtttgctaccaatattttatttgatgcttcttttttttattccttgaataactgcttacaatgcgttaacaggaacaggaaagcatatctattcaagtactaaataattatgcaaatctctaagacatagtaatggaccaattatttttaaagtacaacacactgacaagtactttatttttaactcagtcttggtttgttgttaatgccattgcttgggaaaaagcaaacaaaagcaggaggtggtgaaggagaaacaagaaatagaggcagcagcataagcaaataaagaagaacaagaagatgatgatgagaataaaagactggaagaaaggaaaaacaacacgtgagggaatcggaaggcctattatgataccttttttcccctccttgattcatgaaatttgaaaaagttcaagactttttcacaacaacaacaacaacaacaacaataaagagcaaaaagatacacagtcacccctaaattttgttaagattgcgataatgctccactcacacctggctcaggtgccagcagaaggatgggaccctccagattctgcaggagaagggggaggactcctccttgccctggcggcacctccactgctgccaccgaggccgacggtacagcacccacagcttcctacccacgccaggccaggtggctccgcagtgctcctactcccacttcccaggacccccagacttgctgctgctgccaccactaaggccaatgccaatacaaccactgctgctgtcaccctcgatgcaccggcactccctacaaggcccctactagctggccacagccacagccctgccacaggtggccacagctggctgccctcctacctactgctccaaagtgccacccaccgcagtgacgccagccgccacgtcccaggctccaggctccagcctccaccctccagcgtgtggcaggttgctcctccttctggcacagagcagctgggccagtaaagtcagaaaagcctagaacatgatgcagggagtggtaacgttagagcctcaccttgtcatggtggccactgggtggcagtgacaggtttcagtgaactggagactccaaggtggctggctccccacccacaggaaccgttgggcccactggggctgcggctccttggagagcaggaacagcagaactcagacccagccactactaccccgcccaacccccggcccctcctgcgcccccaccccgagtgccggtttccattcctaacgtctccacccacagggccctgtccccccatgacgcctgtgccccatgtctaccccatgactgtgctcaggaatcccaggttgtctcaacacagagtaagaggacgcagacccaggaaccatgacaggccctgccatgcccatgattcccatggaaacactgtgtgcccgctgagcagtaggaggtctccttctagagtctggagcctggctccttccttggaggccaccgctgtggcggccacctctgccactaccagcagtgcagccccgattgcgcccctaacccgccgctgacagtgtagcccccgatagtgtcccaaacaccaccccccactcccagggagtgtaacccctgatagcgcccccaacccgtccccacctcgaacactgcagcacccaatagagaccccaacccgcccccacactgggagaaataacgcccgtaacagtgccccaagccccactccatccccgggcagtgcagccctggatagcaccccaacccgctcctggctgcaggcagtgatgcccggaatagcgcccccaagccgctccccaccgtgggcagtgcagttgagaatactcacctacctgggctgcctttctaccactccagcagccgtgcagtccctgtcacagccaccagcttcagtgaggcaagccagggtgccacaggctccggcctccagcttgtgtcaggagaaaccaccttcccctccccctgtagcaccgcacggagctgctgcagctgctcgtccgccatcttaccactccagctgcgcttcagtcgctgtcgtcgcagccaatgttctaattggatgagagaaaacctctaggcttattctgattggactttattatcatgttctgattggttagcctaaggcttactctcatccaatcagaacatgtaacccaggaacctcggtatataaagcatgctaagggggagtcaggccattccagactcttctgcttctgtctgctaagctggtgtgtgccaggcttagaaggggggaaggggctgggcatggtgactcacctgtaattctgaggcgggtggatcacgaggtcgagtttgagactagcctgggcaagatggtgaaacccccgtctctgctaaacatgcaaaaattagccaggcgtggtgctcctgtagttccagctacttgagaggctgaggcaggacaatcgcttaaacccaggaggcagaggttgcagtaagccaagatcgtgccactgcactctagcctaggtgacaaagcaagaatccatctaaaaaaaaaaaaaaaaaaaaaaggaagggggaaaggaagagccacctgctgcatgctggaggctgtagcctgcagctccacagctgggcttgctgcagtgagtggcagtgatgcagcatggcaggagcggtaggatctggatgatttccagcttcatccatgtccctgcaaaggacatgaactcattctttattatggctgaatagtagtccatggtgcatatgtgctacattttctttatccaccaagcaataagatttatcatctagggggccagttgcagtggctcaggcctgttaatcccagcactttgggaagccaaggcgggcagatcacgaggtcaggagtttgagaccagcctgaccaacgtgctgaaaccccgtctctactaaaaatacaaaaaaaaattagccaggagtgctggcgcacgcctgtaatcccagctactcaggaggctgaggcaggagaatcacttgaacccagtaggtggaggttgcagtgagcagagatcgagccactgcactccagcccgggcaacagagggagactccgtctcaaaaaaaaaaaaaaagatttatcatctggggtatcaggtgagaggactagctaggttgggtatatggaattagaactcatgagtgaagaaattcaaaattaaagttaagaatattactggtctatatagcatttacagaagagccaaatagacaatattccagactatagaggttagagaaaatcaagttatctatcttaagagcacacttttttttttttttttttgagacagagtctcgctctgtcatcaaggctggagtgcagtggcatgatctaggctcactgcaagctctgcctcccaggttcatgccattctcctgcctcagcctccctagtagctgggactacaggcgcccatcacctcgctcagctaatgttttgtatttttagtagagatggggtttcaccgtgttagccaggatggtctcgatctcctgacctcatgatccacccgtcttggccttccaaagtgctgggattctaggcatgagccacagcaccaagcccagcctgcttttctttaaattttcggataacacagaactcagcaacactttgacagtatggatgattacatactatttacaatattattgtcttcctctatctacttgtttatttactgagaaaaaggtgtcagcataatcacggaagcaacctaatgaataaactacaccttgattataagaaaattaaaattgattcatccttcttgaatacagagttttaaaaattcttaagagaattatggcttattgagtatgccgcaatccttttctgttacaaaaacaaagacaaatgactgctttggggttatttccccaaatagcttccatgtgtttctccatctggtacactgcaaaacttcttttaactcctaaggcctcaggagaatttcacagcccctttataaatcctggaagttcaggaaagtgccaacacgtgctgagcatgctaattcccagtgtccttggaaaggagtcttgatagtagtggactctcccttagggaagtctcacatggcaggaaaccaagcgactgtaacacagggtctagttgtacggtgatctgcctcactcactgttccttgggttcgttttcctcagctgggcacacacagaattatggctttgtttgaacagagttcttttggaccatatgtacctatgttagagccatttgactcccttcattattggtggtctccaagcataagaagaatattgtaggccaggcatggtggctcatgcctgcaaactcagcactttgggaggccaaagaggaaggatcacttgaggccacgagttcgaggccagcctggacaacatagggagaccccatctctacaaaaaatttaaaaaattaattgtacatggtggtgcatgcctgcagtccaagctacttgggagactgaggcaggaggatcacctgagcctgggaggttgaggctgcagtgagctatgatcacaccactgcactccagtctgggcaagagagtgagctcctgtctcaaaacaacaacaatagcctcaacaacaaaaagataaaaagaatattgtagataaatgggagaatgtgttcttagaactcacccactcgaaactcaaggacatcaaattgatagtcttggtgactttctaggtaaaaatcttcaaaatgaatataaatagatgaatttccctgatttggattgctgagagtccattcacagtttaggtttctcgagtaattcctgactccgtcatagccaggagaagtaaagtttccttcaggagtatttggaagagacccaccacatactaagaaaacagaaggcagcagaaagtagtagtaagattcaggccacaacagaagagataaacaatagaggaacagtaactaaaacatcaacattactgctttgatttgtttttctagatgcaatcaggattatgggtaaaaggcatgcaaattatggaagtttctgcacgtttatagaggaaacatgtgcaaaagtcgacaacttctctattttcctgttggtgtagattaggtggctggggtttggctctgtatcaatatgtccaaatattgaagcctactgctcattaatatttaatttaaaggaatacccaaatataatggtggcaggtcctaatggcttgatagcaattctccacttgatctaataatttaatttaaatcaaacagataataagacattgacctaccaatgaatttgcccccttttaataaaggaacagatgcttcttgtaccaatgaaataacttagtgtttttttttaatattcactcccacttctaaattttaaaacccttagataatagcaccaatccaggaaataggaggatatttacaattagaggccatatcttgcttaattttggaatattctatatcaaatcaaacctcccatttattttcgctggaaatatgtgtgtgaatagatgaccagaaacagtaaagcctgttctgtcccaagcaaaattaattactctccgagactaagttaccttctaggaggtagatggtttctttcagcaccaaataattgaccaaggactacggaacaggtcaccaatcctttgggtaacatgactgaaactgtgcaagaagctcatctaatggcattaaaagtttaccacagcagtttcttcctgaaatcagaaagcttttttctgtctgcagtaagtttttgatctgcttatatgtgtttgtcttatgtcaaatattccaagtgaactttgatcactaaagggaaaatggatggctctgctgacattggcagtagctggggggcatctgcagtgcacctgattaaaatgaagtacatttacaatatcctacattatctgcatcttcaccggaggtataagaagcagtgaagcctccatatggcctagatccatccgtgaaaaaaatgactttcattgtgtttcctgaagatttaatctcactgcttacattcacactactacacagtttctctagctggggtaagttacttctaatgctattgaatacctattggaaaaagagtttaacctttagacacacaatccatcttactgcatatttcctaggaggtgatattcctagcccagacccacttccttctatgggaaccctgccctaaaatgaatgacctaacaatgcaggtttctaacccagtgccacaagccactatgttaccctgaacacattttgtgacctcagggtgatttcactagaatgaaagtattgcagtaatgccttcctgccatgtggtgacagattaaaagctgctatacactttggaactggaaactgagctcccaatataaaggagataagccatcatgcttacaatatgttgtgcagagctcactggtgggcagtttttcttaacaatgcatcaggacttttgctatttgtaaaggaagcttaaaggttagtttctgatgatttgatatatataataaagcagatatttttattttaatatttatttatttatttatttattgagatgcggttttgctcttgttgccctggctggagtacaatggcatgatctcagctcagctcactgcaacttctgcctcccaggttcaagcgattctcctgcctcaccctcccaagtagctgggattacaggcatgcaccactgtgcccagctaattttgtatttttagtagagacggggtttcaccatgttggtcaggctggtctcgaactcctgacctcaggtgatccacctgcctcggcctcccaaagtgctgggattacaggtgtaagccaccatgcccagcaagcagatatttttaaataccttgaaaagtaatttgaaaaatcaatctccatatgcaattaaacataatagttctttcctcattagttatggattcaaagcttcaattttctcatttgaatttttaagaatggattattattgactccaaaatattaaataataactgtagtcattcacatagttacaataattggcaaattgttccaatgctgtacaaaataaaaaaaatttagatgaaataactaaacaataattcattgattgagtgattgatattccagtgtttaaaaggatttgaatgactcaagattagaaataatgactcagactatggcactaaaagttacgcagtaggagaatgcactccacaacaaaacatgtcagtttttaaaatttactataattaattaaatttagctctctggggacttctggtctaaagtgtcttccagctcacgcgaccagaagaagagtttgctatcatttaccgagcagacaaaaatgccagtcttgctcatcatctacttagtctgtcttatccaatcagcacaacaccctcccaagcagataacagtatccctgttttccagattaagataccagaattcagaatgatgatgtaatttgctgaagttcaaataattactaataatagaactgggattcagacaatccctctgattccaaaccatgaagcagtgtataaagaaatagatgaggacaaatatttctataatgctgaaaacaggaatgggcatcacattgccaaaatcaaaagggattagaaccaactgtaaggttaatgggacatgttggaaaccatgatcaatggctgttatcctgcctctgagtctgcctttggcgtagaatcacaatgactgaacatgttatagtcatccatttatcacatggacttctgctgttagaagcaaccagaatgcaattctcatcattgtgctctaatcccttttgtactcagaaactacaactctcagaatacaaatggatgggaagtaggcacgtgagatttaggacaggctataacatttgctatgaacagggacaaaatcagatacaggtcatattgtaggacacaccgggtggcatagcttttcattttctctgtctgtacagagagtcagataggcaagtgggtttggagaaattttaggctcagaccagctggataaggcattagccacgaagcagtgcaatgaaagttaaagctgcctctgcaccagcagatcttctttcttctttactctttttttttcttctccttcttcttttctctttctccctctccttctcaatctcctccttcttctctttctccttcttcttcttatccttttcctcttttctccttcttcttttttctccttcccttctccctctgtctctttctccctctccttctccctcttcttcttctcccccttcttcttctcccccttcttcttctcccccttcttcttctccctcttctcctcctccttctcatcctccttctccttcttctgcctctttcgtcttcttcctctttttggcaagttgtcaatcaagtagagtggcagcaaaggcagacccacatgcccttgtttggagcagagtaaagaggaaccaaaataaacattgaacatataaaaatatatttcagaaaaaggaatgtggacattatactaaagattcagaaaaaaaattaattccgaaagtgattccttgctggagttttaacctccccaagagaaaagtcctgtggatatgacatttgtagatttgtaggtttccttatttaaagagtcagggcaccctcatgcatacagagatgccagtcatccttttggcaattcattcttaaatatgaatgaacagccaaggatcagcagacatttagggaactgactaatgtaaaaggcagagaccaatatgagtaaacgggagataggaacatgaagaaaactgaccccaaataagcaacacaaaacttcaaaattactattaatatattcttgtatatattaatatagtaaacatgtaaaatatttaaatatatatttttcaaagaacgatggtaaaataaagataatttcaggtatatcatttctttaaaaatgtattgcccttgcccatttccttggggagctacaagagggtatgcctcaccaaaagaggaaattaaccaagaaagggacgtgcatagcatcacaaagccagctttctagcccaagagcagaatgaaagaacttgcaaatctgctggcaaagggaaattctgaaatgacagctagcatcaggcttgcagctgtggacaaaggctcaaggaaggatattactgaggaaaagaaatggaactgatatgttttactacagaaggtgaagatgaacacccagggtggaaagggtgtggaagaattagtgatcagtgcttaaaacccaagaaaatgtaaagaggacacaattattattattccttgggaaaacaaaaacaaatgttgccacagtacactacttggctcagttgtgaatggtgtttatgtaatcatggtaatgtcaactaaatgacaatttaagcaaaagctgtgacatatgtattttgggagacatttgggaaagtatataaactgtgcataccccatgtgcatttgtggtggcagagggctaattctcatcttccagagtaggatgtggatagataatgtccaaaaaaagcaaggagtagtagaataggaatattatatagaaataatgacataaaacccaccggcagtagctgcaagagttataagttgataattaagggatagggagatgacaactaagatctgctttggaatttgtggttgtggctataacttttatctttatttgagttctaaaactatgactgttcatattctgtttcctaaaggacatgtgaatactctgcttataaaattcctaataatcattatattcagtatgatttaaactatgaaaataatttcaaaggtaaaaaacaactgctcgcatatacatcaaaattttagtaatagatgagtagaattaaaaatatctttatattttttattttctgaactctccaaatattgctcaataagcatccattatatttattaccagaaaaatagactaaaattagaattcaagtggatttatatcatataattacagtacataaaatatgctttgccaagaagagatgagaaaatgcatcaaaatatgatatagtgggactggttagtattttttctacttcatctctgtttatatatattcaatcaataataggaaacaaagtttctttataataaacaaccttagtccaaaatttcctgtctctcaaataaaagaaaacacacttggtttcttattttcaagatctgaaagacaactgttcagtccttcagatattagaacttggaaataaaatctgaaggttgaaggagatcattttagggcgatacaaagtggtcataagatacaaatatatttcatatttttgaaattgactacccaacagaagacaattaaactgaaaacagaagtggcttcttattaaagggataatgatagtacctctaccatccattcattcaacaactatttatctctattatatacaggcattggggattcagtgagtctccagcagtgaatgaaactatggcttgacctcagggagcttacattctagtgggggaagcggacaataaactgatgaacaaatcaaaatgatgtgtggcagcaggtgtaaagtgctgtaaaacaacatggcagagaagtggcaggccagggtggggtctctaatataaggtacttacaccgtatggattaaaaggcattcaagcagagacctgaatgaagtgagggtgtggagcaggctgccatctgagaaggggcattccagatgaaggcaacagctggacagggagcatctcagcacattcaaggaacggaacggaggccaggtggctggaccccagcgagcagagaataggggagtttgagataaggcagataggtagaagagggaggggcagcagataatgttggccaggtgggccacaggtgcaatttgggattttcctctgagtgagatgagaagccattagaggattttcaaagggagcaacatgatctgattgaggcttaaaaccatcacatgctgctgtgttgagaatgtaaggagttgagaatggaggcagtgggaccaggtggaacttactaaaataatctaagtgaacggtgggggtggtagtagtagatataataagtagtttgattgtggattttttttattttattactattatactttaagttttagggtacatgtgcactatgtgcaggtttgttacatatgtatacatgtgccatgttggtgtactgcacccattaactcgtcatttagcattaggtatatctcctaatgctatccctccctcctccctccaccccacaacagtccccgaagtgtgatgttccccttcctgtgtccaagagttctcattgttcaattcccacctatgagtgagaacatgcggtgtttggttttttgtccttgcaatagtttgctgagaatgatggtttccagtttcatccatgtccctacaaaggacatgaactcttctttttgtggatatttttaaagagacacccaacaggacttgcttatagatgccatatagggtgtgagaggaagtattccaaaacagacatcaagatttttgaccttagccaccagaagtttggaattatttactgagatagcatatactgcagaaggggcaagttgggtggagaaatgtactaatattaatccaatctacctatctacacacacatatgtatgtgtagcacttcacagttaacaatctatttgttattcacactcagggatctcatttgctttctttcactgcaggaagctgagagtgctgagggcacatctgaaaccactggaggttggcgacgtggaggtcaggtagtagtgctctcccaccaggagtccctctgcacccctggagagagcagtcattatgcaggacaacccatctgctcagaactttcagtggcgacttgtggtgtgactctgttcccattcatctatgtgctgctgtaggcttagcttcccacagcctccccagctttgccatttgtcattatcatttactcttaatatttattctatctatgaccctgatgcacagagtgatagctgatagtctcttaaaacaacgtttacaattattttgacagtttaccgtgttttgttctctcaacaatacttagaatttgtctgagttatagttgcatagacggcaattttcctgacctagttttctgactatgatttatgggtcagtaaactccttaaatgatggaatataacatctcaggccacagggaacacttactatcacatgctcactgttgcaggacggatgcgtggccagcctcaggttgctaaatgttagggtgatctgccttccttctggggcggtgattctccacttgtagatccggccatgaggatttaggttcgggtagttgggagaagtagatgttccagcagagccctgaagatccccaccacactctgatgtgggggaagaaagccaagaaaacttccaatcaaatcaaaatgtctccttccatcaggaaagctctcaaaattcaggtatttaaaaattatccttctagacaaaattattcaccgtatttatgtgcgtgaggatttcagtgaacatatacattgatttcctatctctattaatatttaaccctggcttccatggatgatagtccacagacagcaatttaattatcatcatggcccaagaaatatgagagatcaatgaatataatgaacttaagaatcacgaaaatcaggtcgggtgtggtggttcacgcctgtaatcccagcactttgggagcccaaggcgggcagatcacaaggtcaggagttcaagaccagcctgaccaacatggtaaaaccctgactctactaaaaatacaaaaattagccgggcgtggtgttgggcacctgtaataccagctactcaggaagctgaggcaggagaattgcttgaacccaggaggcagaggttgcagtgagccaacatcgctccattgcactccagcctgggtgacagagtgagattccatctcaaaaaaagaaagaatcagggaaatcagccaggagtggtggctcacgcctgtaaccccaacactttgggaggccaaggcaagaccccatctttacaaaaaaaaaaaaatcaggaaaatcagaaggttaatgtaggtatccagtttttccaaacaagatctttatttcatctgagtttgttggatttgcagtgaggcaaattctgagtaactacaggactttcttaaggcaggcattgcagtataactctcatcctcttattgtatctctcgtgatactagttattttcccttatagcactgatcacagctgtaactttttgtttatcagtgtgactttttgattaaggtccaagaagataggggtcatgttttgttttgtttttcaaactattgtaacaccagtgcctagcatagtgtctgtccaatgcaggtgctcaatgttgttttgaatgaatcaatgaaatcaccgtctatgctggattcaaatcgcagtctgaatcctgaggcagtcagagagccatctatgacaaacctgaccatggcagtattgctagaagtctctatgctgtcaggaatggtgtttgcacagtatcttcccaagatgtttcctgtgagagacaaataattaaatatatatgtccaggtgattgatttcttttaacctctattcaaggtgtcctgcgtgtacaaagaaaataataaaaaacaagaccttgcccatgaagaaatattaatctctctcaagaaaacaggaaaacatgaatgaaaattaacatattcaaatatatgaagaagtgaaaaaaatgcaaccagttaggggaaggatatctcaggataatgaggaaggccagttttttggttgaaaaagtggtttgagacaacagagtgacaaatatctgccttatgctactgccaggagacatgcatgaccctctttctgcctcaagctatagaacacccctcaaataacggcatctggcaatgggatgtctcagcagcaacaggttgccttcccactaccgttgctctccccaggtggcctccagggtaggctatatgacacctgggctctggacatccattgttaatggtagaattgaggtagagaatcactggtactgcccaaagcccattaatctgcacttctttgcagagtatagacatgctttgcctttcttggaagtgaagaaacttcagaggctgaataagtacatgcgaaaataaacaccccaaagagagcagatatatttcactaaccagaagtatgatagtcccaggtctccacaaagtctttttcacagccagaggaattctgaaggttaaaatcttcaaaagagatggtgagatagtgtctggagagcccctggagatgccaatcacagaataagttgtctctatatggaagcattagatggccaatgctttcaacaacaccactttgccctgttactcttcccccacactgagctgaaaaaaaaaagaaagaaagaaagaaaagaaagaaaggattctattacaaactgtgtttttttcatttcaccagcacatgtgaaaacttttaggtgccaagtgactatgaattgaagtttttaaaattctgaaaatgcttagtgctttcctcattatttgaattctagggttgatgtaaacagaagtgataccacaagtccaatccaataatgggaaacaagatgacgaccaaatggcacattctgtaatgtcacattaattcttttgggacactatgtaagagctatcagttgcaagcaagtttcatctcaagaacaaactggtagactcatctgacctgcctagaaccttgtgttgattctaaagactgaacccaagctcacctggaaggggggacacctgctatatctagttttactatcaactaaactttcactactgtaactgatatctcagggccttgaaaattactattcaattatgtcttattagctggatgtggtagctaattgaattatatgcagcttgacccgggatataatatgatctatggtgtagttaaatactgttacaactagcctttctgaacttttgctatattaaatatttgtttggtttgtgtctagacctatcagatactaaattgtgtgctattgtgaccatactatagtgaatcttcaacaagcaaagttactgctcaatttttaagtaaggaaatcaaaatcctgaagagacatatttgctttttatccagtgactgatttggcactagagactcagagaaaaaaaaaaagcttaatcattttatatatgatgaggaattcaaagacattgttctaaatatagttatctggttcttaaatagttgtattacttaaagtaataaacatactgtagttcttccttttccttggcggatacattccaagtccccccagtgagtgcctaaaaccttggatagtaccaaaccctatatagacatatagacaatttttttctacatatatgtacctatgataaagcttgctttatcaattaaacgtagtaagagattaactaataataaaatagaacaatcataacaatatactgtaagaaaagttatgtaaatgtggtctctcaaaatatcttggtgtactgtactcacctattttttgggcctctgtttaccaagtgcattgaaaccatggaacatgaaaccatggataagagagaactactgaatttcatagtaagcagaagaaacaggagtttgatttaactacacatatttcttcacaaataagttagaaaaaatataaaatattcaagtttactaagattacattttaaaataaaaattaaaagagaaattaaagttgatgactgtggttttaaacatttacactccttacttatttatagcattaaaatatttttaaaattatgcagatagaatgacttctttttaaaaagtcatggttttaaaaaaagttttaacatattcatcctgtaataactcttttatttaatataaaaatgttttccagggtttttatagttttgtgttttacagttaagtcttcaatctatcttgaattgatttttgtatatggtataaggaaggggtccagtttcaatcttccgcatattgctagccagttctcccagcatcatttattggatagggagtcttttccccattgcttgcttttgtcagctttgttgaagatcagatgcctgtaagtgtgaggccctatttctaagctctctattccattttattggtctatgtgtctatttttgtaccagtaccatgctgttttggttactgtacccctgtagtatagtttcaagtcaggtattgtgatgcctccagctttgttcttttagtttaggattgccttggttatttgggttctttctggggtccatatgagttttaaaatagttttttctagtactgtgaagaatgtcatggtagtttgataggaatagcattgaatatgtaaatttggggaagcagtatgaccactttaataatactgattcttcctatctatgagcatggaattttttttcatttgatagggtggagggtgggagaagggagaggggcagaaaaaatagctattagatactaggcttagtacctgagtgatgaaataatctttataatgacccccatggcacgagtttacctatataacaaacctgcacatgtaaccctgaacctaaaataaaagttaaaaaatatatattacctatagaatacttggccttgaatcccacatgagtggggctgttgtcagaatgaaatctcaaatacataacctctcctgacgaccactgactgctgggcaaagatgtcccacaaaatttggaaagtattggtgcatctgaatccactccatcccacaactaggggtagttagaaggacagctaaagtggaaacaaaattatgttaaatttacatggtcaattgccttgacttattttgataatgacaacttcacttactttctttgaagatattattaaatcatcatttcttagcataaaagactatgatagaatcagcgtaagccatgtgtcacattaaaatgctgtatgatatttttcctaataatacattctttcattagcagctcagaaagacaggttttacatgttctacattgaagaatatttacttcccttccatattctgtattggttttacaaatataaatgttgttttcaaattaatccctatgaatttcaaaaaaaaacaagtattttgttccacacaatgatttggtacatttcacatgataaagataaattctctaacagctctgtaattgggactaacagagagtcccaactggaattttctgtgtccataagagtagacaagcatgtatctagcgtttcttgaggaacttacatcagctaattaatgctccatgagtggaagagtagtattaaatccagtgtcagaaatagcaacaaaagctcttatatcttagttttgcaccacagctgcattcatgcaaatgtatacacacttttgttaaaggaaagaggaaaacggttttttacaatctatatatttttactttctcttcaacatagtaagacttactctctgttttgtaatactttcagaactcttattaaataaagactgagaaattatactgtacgtgctttagtactgttctgacactagtgacccctggtgacacaccacacaaattcccatttgttaaacagacattttatcatttgtgacactgaataagaggctgggcaaataaatattcatctctcagaaacatgacatatttcctgcgggaggaagaatggataaacatcaatctcaagtagccatcctcaacgtcccttgcaggaagtgtctagggtcacaagggacagtatccatgtacataacctactcagctgatgggagagttgctggcagactgtgttttcatgcctgagttattaagcatttccctttttccctagatttgcttgcagtatgtgctactgaaagaaatgaattgttctgagacatgacagttaaaaaatactaacttcgggtaggaaaaaagtgaaaatggaagtgacatacttgggtgttatttcaatatcaaattgatcttcaaattgcagccgtatgcatgtttccggtggagccgctaagatccaaatgcaatcagcgtgcaggggataattatcagggtgggtgggggaggtcacatacccagcagaatcagctttatggatgtagatgttgcccccacaggctgtcagcaaacacagttaaatcaatctacgctctggtgaaggagatgcattcaatggacaaaaatcatcttttaaagtcaacttctctgtaatttgtctcaatttcctttcatctgttatgatcctcattttcttttccagcaaacgaattctcaatttgctatcgaggcagctaccaggtgtgacactttttaatttgccagatcatctatctattctcattggaaatttcattctttcttaaagccaaccaaatgattatggcacattgtgcatggggcagaacatcacagaagcacgaataaatatccagcacttcgataagcatgtaagtatgctagcagttacagcttcccactgagcgttcagtacagcagaatgatgcagagctatgatcttggtatacttaaaagactaagcagatgtatctttgcacaactctgggggcattcattcatcacatttcttcaggatttagatgcatttgagaaacaaggtcaatggcatgagacaatttataagccatgttttgctagatgataacggagctttttaatacttcttttctaaaaaaaaaaaaaagtattatggaaaaatacttttctattgtcaataaatattctttggcattttcaacaaacaaaccagacaggaataaatgtacttacaatgccaatgccaatgaaattaacctgtccaatcacttagccacacagatacttgatctgctcaactctagcaacatttatgtccactgtcactcatccacttacagtcacatcctgaattctgtcaatacctccaactcccccatttctgaaactgtaaattgcaaatctctttgatgacgtccaactcccttgcttcatgtctttccttcaatgtcgaaagacgttcacaaagggacctatgttaaaggctgagaaataggagtagcatggaagtagatatggtgggaagatagccagatagatatgggaagtagaagcctggctatagttatggaacatggttgagttggtaagtagagagaaataagagtgatgctattgtttcaggttgccaaaaataggttgtgaaatcaaaagacttttgtttaagtctgatgttaatggcagtaataacaagcttcatgaaagacagggagaaagcaatggccatagccatacttgcatgaacagtgagtccacaaagaaatagaagaggtgcagtgtcaaatatacccttagtgtatctcttagtgtatctgaattaccattaaatgttgactttaaaaacttaaatcaagactgagtctattggctgggcacagtggctcactccagtaatcccagcactttgggaggctaaagcaggtggctcacctgagctcaggagttcaaaactagcctgggcaacatggtgaaatcccatctctaccaaaaatacaaaaattaggtgggcgtgatgatacatacctgtaatcccagcttctagggaggttgagtaaggagaatcacttgaacctgggcggtggagattgccttaaactgagatcacaccactgcactccagcctgggtgacagagcaagaccctgtctcaagaaagaaaaaaagactgagtcgatcttaaataaaaatagaaaagtagaattctgtcatgtgggctgacatctactcactagactcaagacactgctactctcaaaatgctttggtaccaggtgaaaacccgcccattcctgactcagttgcaaagctcaacatggagagagggaggggtgagaaggtcccagcctagaaagccatagtgcaggtgcccacagagctgcattaaagctccctccttgtgccagagctctgtgcactgggaagtgaccaaagccccttccctggtgttttggaccttactccagctattcgattatttttgtgtgtcggttggtaaacactcttactcatttcttttaccaaaatgaagaaatgatgttgactttaaatctcatacaatgtgcaataaaacatatgatttcattgatatttatttatatataaatacatttaggaatctgggatacaagtcataggatcattttgaaatctatattatctaacttctggtgtgacaaagcaaaaatttattattatattactttctactgacattactccgttttttggaagtgatgcctatttatttatttaatttatttattcaattaaacattactgaaaagtaaatgtcaccaaaatcaaatcattacagtagaattaaatgcaattataatcaagtgcaattaagtacaaggaattaaggaaagatcttaggtaatatataattaaatcagtaataatagaatcaaaagattatatgttcttttaaaaacagcatacacattattacaaaataaggcaaatgtaattcttataatgtttctataactagatttaacttacaattagacatcttataatggaaaggtctaaggagtttcagggatcaagaagaatagtgtatcttatactcatggaaaatttcactttggtcactaattagatatgtggccttggaaaagtccaagcctcgttttacttatctttaaaaccgaaataatggtactttacttgaaaagtagtcacaatgagatattgaatgtatcaaacataataagtacttgagagtaggcattcttattaattctattactgttagttcagaaaagaaaactttatatgtttttttctcaaatctacttaatcaaagaagaccaagcaattgcaggaaaagtagatataattctcagtgaaaatacttaccttaactctttgcctcatatttgatcttaaatccttgcccttcattactataatcagaaataaactgaacaaacatttgattatccgaggtgaacacagtcgatgaagcacgactgccacaaaaatgaacatttcctccacagggtccgaagggtggagaatagatatcagggccatttcctagctggaaagacaaattaaaattgcatcaactcctttacattgcaaaagaaggagtacgtaattcttatccatttatgtcccaggaaagaaaaattatcattttgttttctgaatgaagtctgtggaaaacataattagaaagggtagcaagcaagacctaccaccaagtaatccccctggttgcaagaagaatcaccatttggaatctggaaaggctgttcaaaatggacagcaatggtcaggccactttggaccaggacgtgccaggaacagttgaggttggatgggtaggtctctggatacctggggaacatgatgatcccttgtctgcatgcaaatatccaccagagcctccccacaaagaaacaaaggtaggttatttcaatagaattggcaactggatttttatgctttcttagttttcttggggggttttcacagtgtaggcaataaaaatgcttgaaaataaagccagagtgtaggaaatgattagcataacaagcatgtattgagcacatgctattggctactccgtttgtggtggttgttgagatatgggatatagaggtaagtaatgaagacaaattacctactttcataaagatttctttatagatggggaagacataaaataaacaatacataatatgtgagatagtgataaattctataaagaaaaatggatgggaggagggagaagggtactttattgtcagagttaagttggaaaagccacgtcattggagtaacatcttagcagagacattaatgaaataaagaatcaagccagatgtttatgtgggagaaagcattccagttcagaaaacagttaatgtaaaggcttgatgtggcagaggtacatcatggaagtcagaatggatgaggcagaatgagagattccaaaggtagcagcatgtctaggtcatgcaggaaactgaaaagacttattctgaataagaagaggaagacgaagggttttgggcatcagaatggcatgatctcacttacatttgaaaatatcactctatgtgcagtccttagactgtaaggagtggagggcagggaagggcaggagcagagtgtccaataaaaaggggactgcctgaggccaaggagagatgataggtgcatgggctaggctggtagcaacagaaatggagaggcgtggttgaaatctagatacattgtgagggtagagccagtgtgatttgttgatggttaagtgtgagacaaacagaaaagtcaaaaataacatcaagatttttgacttaaataatgagaaaaatgtactttccatttgctaacattgtgaggagtgtagaattgggggcggtggtggcatggaaaagggtgggaataaagtgttcagttttcaaaggttacattttttgttattggttatctatctatctaattgtggtacaagtggtttttggttaaatggatgaattgcatactggtgaagtctgagattttagtgcacttgttacctggctagtatacattacacccaatatgtagttttttatccctcataccccacccatcctccctgcttatgagtctccaaagtccattatatcacaggttaaatttgaaatatattctagaccatgagctgccaagtatatatatatgcacacacacacatatatatacacaaacacacttatagatacacatatttatatatattatatacatatatacgcacacatatatacacacacacatataaatcaattacaatggttctaccctcactatatacattcatatgtatacatgtatgtatgtataatgagctgccatacatattaatgtatacatgacagtgagagggcaggaggtgaaggaagagaatgaaaggagcaggcattaattctccagtggtcagggactagaagctcatcagcaaggaagggtagacagctcacacagctagttaaattgcagaggtgaaaatttatcccttgtaagttggattcctaggtattttattctctttgaagcaattgtgaacgggagttcactcatgatttggctctctgtctgttattggtgtataagaatgcttgtgatttttgcacattgattttgtatcctgagactttgctgaagttgcttatcaggttaaggagattttgggctgagatgatggggttttctaaatatacaatcatgtcatctgcaaacagggacaatttgatttcctcttttcctaattgaataccctttatttctttctcctgcctgattgccctggccagaacttccaacactatgttgaataggagtggtgagagagggcatccctgtcttgtgcaagttttcaaagggaatgcttccagtttttgcccattcagtacgatattggctgtgggtttgtcataaatagcaaacaccgcatgtcctcactcataggtgggaattgaacaatgagaacacttggacacaggaaggggaacatcacacaccggggcctgtcgtggggtggggtggggggagggaggatggatagcattaggagatatacctaatgtaaatgatgagttaatgggtgcagcacaccaacatggcacatgtatacatgtgtaacaaacctgcacattgtgcacatgtaccctagaacttaaagtataattaaaaaagaaaatttatcttaggtctaattccaaagcccatgctcttaagccactatgcagcctgcctctcttgagtgtgaggaacacaatttatcgtcagttgctccctactttataaaaggtatatataagcatggaggaaatattagattaatttttaatgttagattgagaatctactttaaaattatgtttttcagttaaaaacatgggagtctttcactcttccatggactactttattacctttcatttagtttggatttaaggctgttaatggacttcacatgtcaagtttgaaaagtctcaatcatactgtgcatgatggcatcccatatatggtgcctgtttttgactcatcaagttcatatttcaagagcaacaaacccttcctgccaaccctcaaatggatgactttaaccaagtaattcataaggataaatgatgacgttttgctccgtcgatgagttacggatatgagctgtgctctagttccagccctcagctaggctgaaaaattgctttaaagctctctctcatgcatttcatggagacacctcctctggagtgaagatgccccacccagaggcctgaagcaggacacttttgtacgacttggccacagtgctttggatcaggaatcagcattgacataaggggagccagccatccagaacctgggcagagacccatgtcctctgacgtggcttgtgtcctcgtgcccagaaagctatattaggaagagagaaagagagaggaaagcagaggagatgggataacatgggattaaaaaaatatttaaactcattactcttgtgaaaggatgcactgaagcctgccctggttacactggagtccaaggtgaagcggatgaccgtgtactctcagtagaccggatgggcccagggatctctctgccacagagaactgctagcttctgggccaagtcattttctcctacattgaaagaaaggaaacagcatgaaaatacagtcttgagaatctgctctatcatcatttgcaacttagccgaagcatctcacacatttttttcagaacatcaggattcacaggagataatgggattctcaaaaagaaggacccctcaggggtgatatcattctggctccagcttgcaatggtgctgcctgcccttttctttatcaccctgccttttttttttattttatgagatggagtctccctctgttacccagcttgcccaggctggtctcgaactccagagcacccacctcagactcccaaagtgctgggattccagacatgagccactgtgcctgctctcagacctcagtattttttaaggagcacatctgagttcttccacactggccactgacatattacacacagttaaaatctgggttttaacattcaatgcattgaatagcactgaatctgtaaatttgggggagaagtatggccattttagtaatattgattcttcatatctatgagcatggaatgttcttttcatttgatagggtagagggtggcagaagggagaggagcagaaatcactggccactgggcatgtgttgctctttttggctttagtgagtgagctcctgagattgtcccatgggaggatctgttgactcagagacccagaaccagggcaacccaaggccagcaggtgaagtcgaagaagtgtccgcccgatagcatcttatctatcctcagcttgtagactgtggctacccccctgcccccattctctttgtcgtcagcccctccaaccaaaatgtacctgttccagaatcctttttcttgaggtcctgttctgtgctaagcggaagctagctaacatgctaattcctccacagtatatttttaaatggaaccaccccaatcatgagaacttcagaacggtggcaggctgtggagaaaataagacgggggagtgtaagtctgtcactttccaactcataattagcccatgtgtgcggctgatcctgaaaaaggtttcttttgctattgatgatagaatgtctatcaaacagaattgatgtaatagcaaaatattatacatagattttcagttgatgcactctttcctaaataacttggtgtgtgtgtacatgtgagtatatgtgcaggatgttagaggagatacactaagaagtgcgatacttaggtgcatacattcttctagagcatctgttctcttttttatgtttctattttttagagatagtgtctttatcacccaggctggagtacagtggcatgatcctagcccactgtaacctgaaactcctgggctcaaacaagcctcccaaatggatgtgcaccaccacgcctggctaatttgcccaggctggacttgatctcctcggctcaagagatcctccttccttggcctcccaaagtactggaattacaggccactgtgagccactgtgcctggccttcttaacttttcttaagtcactgactgttttaaatagtagagtgaaaactacaaccctgatccgtagagaagtgcatgtgatggttctaatttcagcaggcctatggatcccattgtgttcatccatgaattctttagaggtccacatagctcagatttagaaactccagagttgggtgaagataacactagtatgtttgcatgtatgtggacatagtgatgctattttttttctttttgagatagggtcttactctgtcatccaggttggaatgcagtggcatgatttcggctcactgcaacctccctctcccaggttcaagcgattcttctgcctcagcctccctagtagctgggactacaggcgtgcatcaccatgcccagctagtttttgtttttagtagagatggctttcaccatattggccaggctggtcttgaactcccggcctcaagctatctatctgccttggcctagtgatgctatttcttaaaggagatgcttcttggaaatttgtataaaactttagacgatttttaatgcatcacagaactcattcttgatggcttcttaaaaaatgttgataagtgccaccttatttatctgcttaaatttacatttggttaaataagaatttgtaatcccatagctcccaggcttgaatggaacatgagtgtgggcacatgcagattttttttaatggaatacctttcccatttccatttttcattttcttcgtcagtcagcctcataggccaaaaccactcaaatacaactgataaccagttaacaaactcattgaccttgcattttgctgttttcagtctgaaccctcttttgtctaattttttgctatttctttagctttttttcccctgcctacatattctttgttctagttacctgaatttttctaaaatctgaagttcctacccctctctctggattttgcttatccttcagaaagttgagatgaatgctcatctttctctgtgaagccctccttttcatccaactgaaccagcaatttgtggaaagaaatacaagacaccccacagcctgcaggaccatcaagaacaacacctatgtaataacttcagcaggagatgaaagtgacaagagcaaacttgttgaacccccactctatatcacgtggaggagacaggtgtagttaagtgacgagaatgagggaacgacagagctttctgcacggcttccaagtggctgctccaccatgtaccctgctgtctctgcaagtgatgtgtgtgtgcacttgagatgccccatcaggtcaatctaggagcgccatgggcgaagtgttcctgtggctctggatccttactcgttccaacggaagaacagggacaattcctaaagttaaaagccatagttgtgttagttcaaagggaaagatcaaagctcccatgtggatttggtggattttcctagccttgggcctcttcctttccctccccttcctgccttcctcatgcagtgaccctaaagataaggtccagtaggaagagaagcagtccagttttggcctcttgctggattaattccttttttttttttttttttttttgagacagggtcttactttgtttcccaggctggagtgcagtggtgcaatctcggctcactgcagccttaacctccaggttcaagtgatctttccaccttaggctcctgagtaggtgggactacaggcattcaccaccatgccagctaattttttgtagaggtagagttttgtcctgtcacccaggctggtctgaaactcctgggctcaagcaacccacccacctcagcttcccaaagtgctgggattacaagtgtgagccactgcacccagcctagattaattcttaattgtaaaagaagacagaaactaatggcaaaacatgctttttatgtgtacgtgtaagagagtgcaagatagaatatgacttgcttactgtctacctcataatgttaataatcgaggtttacatgtagatatacattcaaatatattatacataataaagacatgtactcatataaaagagcctagatcactccttttataacactgagcttgttattctccattgatgggttgaagttttttttcatattctccttctctctcttcccagtgttttggaatttcctgggcatttttcctacccttccttttcttacccttcgctggatgtcacctcctcccccggccactgaatgccattgaatgccattgaatgccatttcctttcctctcagcgctgcttctccctcccagctccccagttaaagccctttattgatgtatggctttgctggaggggtagcacatcagaactggagtgcaatttagaagcggtgttcctgcaagaattcagaattcatatgtcctcctgaagatgctttggaagttaacacaagattcagaaattaactaatttttatatcctcagaggagaagaaatctatgcttatcagttttttaggagatttgtttggttatgcatacacctttttatagctcaggaacatatatttttgcatgtttggctttatactctcaaatctaccctattacttgcttataccttttttcctgtaattttcatgcaattcgttttcacattgctgctgaaagagtaggaccattgtgttgcagtgagttaagcaagggacatttttgtttactaaaatgacttaggctatagaatcctgaggcggctcataataggatagagtgagcatgtgctttcgggacacaggttctcagtaaatacttgttgtttattaactgaaagtagcattacctttgttatttataaaactaataatatttggagaactttgttatttataaagctaataatatttgttggcctttcttggggtagatccttagatattttgctattttatgtttaccttgaggaacatgtagaaccttttaaatgataatttgtttcactgtttcataaactttatgtttttaagtaacccagaactactgtaattcactgctttaatacctgctttgggtgaaatcccataaaatctgtgaagccagttttcattagtatacttttgaacttcaaactcttatggtaatatgtaataagttaattatccaccttgtgtttttggccagaaaacctttgttttctggccaaaactataactacaaatgacctttttttttttgcatataaagtgcttaggaggacttgaaagtaattaatcactataactacaaatgaccttttttgcatataaagtgctaaatagtttaattattcctatgcgagactgagaagattcttctttatgtataatcattaaaatggcatcgagaactatgatttgctgaaagaattggcacgtctataattagtctagacaccacctttgtgctgtgaatggactaatgttctccagttattatggctagagattaaaaagcctgtgctttcactttgaccacggatgccccaagtcatatttcatctcgtttctgctaatttggtttttttctcccttgcttcattcaggccaaagaggggcacttgtttttcagtatcatattcatcaaatgctggggcaaggaaatgtttactttcaccattttctcataaatggtccttccctctcccatacctataatgaataatctcactcattttcatctattctcaggtttttagtgatttttctagtaacttaattgtagtaatgtaatatactaaattatctaagtgacaagctaattttaatatcctctaccatcctctatccttctgtgctttattttaaaaagctgtagaaatatatgacattgtgaacatctgagcaggcattttcctttgttatggcagcagacaaaaacctccttttttaaaaaatagcaatatgtcaggtttttagaagcaatgctactcggcttcattttgctgtgactcattccatgtgttttctttggggactctttggcctgagggttggtggcatttttgcatcctggaggcgggcacaatacagtagtgttaccaccattgcagcacaagggtggcatgcccctgtgccacctgctgtcctagccctggctgtaagcagttgcctgccctaagtcctcctcttcattcccttgctgtaactcaccatccttcactggaagcagaggttcagccatcagttcacttttttcaaagaggcttggtcccctggctttcatgctctgggccagccctagctcaggaatcactagttctaaaaacatcctttggtgcttctgcaaaaacagttgggtgtagtgcagcccccaagtccccagaagtttggtggagatggtgggtggaggtcacctccagatttcatgcccgtgctgtggatggaaagcgccatgtgttcagagcagcttctggcttcctggcagccgtaggtgtgcgttagcatggtgcagggtctagtgctgtccttctggagctgaagagaacctggctgtcgctggtaaccatatgactctaaagaccaaagtgtgaccccctgacccttccgtgggctgcacccaagcagagcacttgtccttatgttttcacattgtgcctgctgctcccagagtctgtcgctccttacagctttgtttctttgcctcaagggccacaagatgcttttgctcaaaaagcccccagatcagctgcacccaagccggtctgtcagtgccatcactaccacccagcatcctgccgttaaggctcagtgttttgaagctgggcagtatagcaggtgacatctctttgtatggccacccttggtcatgatgaatttgccactgagtgacttaattcagtgtgctagggaattcaaggcttttctcctctggaacgttgtccatcttaagcaatactgatctcgccataaaatcctgtgtggggaagcagaagttgactagaaagggtttgattgtggcacccacgttgaatgtgttagctatctagagtatcatttgtttcacttttcatcaatccccaggctcagtaggcgtcttcatttggataagattgattattatactcattgcattattgcatggggtaagggacatatgtgttggattgataatcatgatgctgccaatgaattcaaagttttctaagccaaaatggggttcccagagcagcaacatcagcatcccctgagaagttgctggaaattcagattctcaggctttaccccaaatctactaaatcagaaactccaggacactcctccatctgtgttttagcaaggcctctggtgattctgatgtctccgtggtttgagacccactgccatagagcagggctgtctaatagaacgttctgtggtgatgaaacggtcagtatccctgccatgcagtagtggagccactagacaccacatgtggcggtcgagttcttgaaatgtggctgctgtgaccaacaatagcattcatcattttatttaattttgattaatgtaggtttaaattcaaatagctgcatatagctagtggctgtccatcagatagcccagccccagaacacaccctgctaattattattggtaaactcctaaaatgctttaagatgttggttgtggaattattaattttagatcatagaacagaatcttccttactcaattcaacagaattgaaactgcaattgttataacagtagttgattttgattctttgtgtgcaggggagatagtttgtgggctgctggctggttagggaaagcctattcttgagctgattgattgttgattttgtgaatgtgcaccaactgtgcagtgccgggtggctcatgcctgttgcagatataaccaatggcagtagatacatgtccttttaggagtaaagctgttgctcaggaaggggctgtgccagtgtttcgcacagatggactctggtttctccagcctgtccagcaaagtggaggtgcttccggccaaagagaagttaaggagcccttcaggcactttgggctgcttgtggaaccttccagaaactgtgctgcgggagacgggggtgctgaattgccaagtctagggctggcacgtcagatggacaaaactcttgaatcacattcagtttcttcagtttaggagaacttgaaggaaaaaaggtcatgccaggtttgttaggtggaactgctacaaagcccagaagaaactttgagatttgtctctggggtgatgtgaccacatccttgtcacctttccaaaacaccagcagacgctgtaggaagaaagcatccccagcagtcctgtgatcctgcagctagagcaaaatgtgacatcgaggagccagggaatgtctgagtcctttgggacggttcccccaaacccagcaactgaagtctcaaacttaaagcaactgtctttggctacgcagaaaatggtactcaattctttgtcagaagcaaagttctacatcactaagcttcctaattgagggccccattttttgaattatttgaagccctatcattgattttcataatccatctcctgttagaatcctagaatgttaaaacgaggtggaagagaccttggaaacggtcataatccagccttcttattttatagacacccagagaggttatgagttgagtaagggcacacacagcactgtagggtcaaggaccacattgctcttcagtttcttcggtgtcataggtcagctggggtcataggtcagaagctggacagattgatgaaaaaggaacatttcaaagacatgataagaaatatactgatgcacgctattaggttttaaaatgcttcttgctcatgcatcctatagatatctggaaaattccaataaaatattttgagtggtaagatattgcagtggcctttttgaaatagctaaaattgttcctgccacatatgtatatgatttagtcgtgacacaattcatattgctaactggttattttttctggacaactagtttggctgggagtagtttattttccaagcactaggcctgtttcagtttattgactttgataccctgtcttttgtaacttactttccttaaataacatgcccctcctactttacccccaaagtattgagatgctatgtgtgaaaagtatggcactgagcacctaatcagcattctctaagtgttggttcaaagagtgaataccatcccatccagacgggtctgcatgttaatttctttagattttcactatggctgggggttaaaaaaattctgtatatttagggagaatattagctgcgtaattttttttctcatctagcttgaatggagtcttaagcaaaaaattcacatgctcaccaaaaggctgggagaggttttgtaaattgaatatgaggctatcgtttgcgtccacaagacaaagccctaaatcacatttagcataatttgtggttttaaattggactgatttagcaaggagagtgaaataatctctcatcctgtcaaaaaggtgatatctttagagagtatttaattccactggcagagtaacttcaggaagacgacagtaattctgcctgcattattctaggtttgtggctaaattgagatcataaatttctcctgatttcactaactttcattattgctcttcgaactcatcagatgaatgtgctcttcaaactactcagatgaaggcttagtggtagctggagggtggacaggggagggatgaggtctgtgggcagctgcactgtatatactttatgatctggggggagaagatgacatccagtgacttagaagacatagcttggtgattttcttttcctttgagatagagtttcactcttgtcacccaggctggagtgcaacagcgtgatcttggctcactgcaacctccacctcctgggttcaagcagttttcctgcctcagcctcccgagtagctgggattatgggcacctgccaccatgcccagctaatttttgtattttgagtagagtcagggtttcaccatgttggtcaggctagtctcgaactcctgacctcaggtaatccacctgcctaggcctcccaaagtgctggggttataggattataggcgtgaggcaccactcctggccccggtgattttcttgataatcacttacacaagatgaataccattcatttccatggaagtgtcccatggactgtgcacctaagaatgtgcatttgcatccatattttacaggtaggattcctttgaattcttgcaggtatccaagagggagggttctggaggaacttccagctgtctagattaccccatgaaaacctgttcttttatcaacagccacttcaggagctcacccaggggctgctcactagaccactgctccctgcccatgtgccctagttcagagtaatccgtattcttcacagtcccttcttccagtgaaagcgtttcttttacctttcaccaagcattcactctaaaagaaatcaggtcagcgatactgtagacatttcagaaagctgaaaatgatgactcaaaactataattagtcatgttcctgtccctttaattttattccccttggagttatcaattggtgtccttgaaatggctagctgcttaaatattttagatgtatgtttggcgttttacacacacctttgtactggttctaatcacaagtgctcttgggtctgagtttaggtctgactgcaggcaagcaggttggttttctggcctcctggggcacccctggaggaagcagatgggatgggaagtaaacctgacggatatgagacatcacacttttttgggctgggctccaggcacctgttcatgtttttagttacctggatagtcttggtatcagagtttacatgaaccatggccaagcttatcacccatacaaatgtttgtagaatgattgaatagcaaatggaatagatgaattacagcctatggaaagtccttctgctgccaatttatagtttgtccttttgagataaagatgcctttggcttttacatttgtattttcaagtatatatatgctagggaaggaggaaccttttgggtccccagtggttgattttcacctttgatctgcatactagtgttcatagcatgttactgagttgacttttttatttctatataataacaatatatcgatgtgttgcaaatctgatgtaacctttgtgtgtgtgtgtatgtgtatgtatgggtgtgtgtctgtatgtatgtgtggtattgatcaagatacattactccagaggccaaaatcagaaactagggatattgaatatttcgttatttaaagttgagctaatataatgcaatgttaagaggacagctgttcagatactgggttaaacagcttcaatgtatgtcacccaggaagggatttggaggttgctgtctttcttctggtggcaatgcaagaaaaccgaaagaaaaaaacaattgcacttaaaagatcctatatgacagctataagtgtatatgctttgtaatattcacttttataggctgctatggtacagaaattctcttttgtgcatttttgctctgtttccctcctcgttgtccctccgaaacaaactatgccaagcacttagctaatgatatacgaagaagcatttcagcagccactcagaagtgagtgactgcttatgaaaaacttgtgaaaaataagtaagactgataggtgaattcgatggtccttttggagttatatgtttcttagctttgaataaaaacaaaatgtgctgctgccatcccttgctaggagttccattcccagattcacactcagcatttatgtttccatggtggtaccaccaaacatagcagaactgaagaatttggaagtgctcaactttttaaataaccagatcgagaagctgccaacacagatcagcaggcttcaaaaactcaaacacctgaaccttgggtgagtatcagtggaggtgaaaggatggagaggaagagagtggaaggggcgtgctgggtagggccaggggagggattccatttatatcattgcacagaagtggatttctaatttctttttgtgttttgtgttttaaaaaaagttttattgttttaatatatcctttcggtggcctacattagtgaagatttgagagctaattgagaagctaatagttggcacaataaggaagataaatttttactgtattttgtgtccagtaaaattttatctcagctctgttgaccaagaagggacttatttgcatagcatgaactggcagacaagttgtaatatggttgacttttttctctctgtgttaaataagaatagtttataaaggacctttgtgccatggagggaagaatatattccctaatgctgcttcattcatttttgcaattcttctctgtagttgagaggtgacaattctctgtctttctttatgcaaaggtaaagatatgagttttgtttcaactgaggttgcagaaccagggagcagtaaataataataatgataacctgtcttcgtgtattgctttgtagcacttgatcctgtcaacatttgtgaggtaggaaaggcaggttttagtgctttcattttatacagaggaagccaagccttttcaaaggggctaagggactgggtcctggtcacccctgaggttagtggccaagctgggaagagaaccccatggttctgggtctaaaggctccatcagactccattgatatggtctggatctgtgtccccaccaaatctcatgtggaattgtaatccccattgctggaggtggggcctggtgggaggtgattagatctgggggcggagctctcatgaatggtttagcaccatcccctcttggtactgtccttatgatagtgagtgagttattgcaagaccccttgtgctctccttctcctgccatgtaatacacatgctcctgcattgccttccaccacgagtaaaagcttcctgaggcttccccgcaagcagcagctgccatgcttcttatacagccggtagaaccatgagtcagttaaacctcttttcttgtaagttacctagcctcaggcgttcctttatagcaatgggagaacagacgaatacatccatagaccccaactggaactgcaacatcagaattccatcttcattggcacagctattagatgaaactgcccactcatgcttcagtctctgtgcaaagtcgtatactcattaaattgtagccactaaatgctctggttaagttagtgattgacgtggagtggcaatggatgctggccagatatttgccaattttttttaatttttatttttgagacggagtcttgctttgtcaccaggctggagtgcagtgatgcgatctcagctcactgcaacctctgcctcccaagttccagcgattgtcctgtctcagcctcccaagtagctaggactacaggtgcacaccaccacacccagctaatttttgtatttttagtacagacagggttttaccatgttggccaggatggtctcgatcgatctcttgacctcgtgatccacccacctcggcctcccaaagtgctgggattataggtgtgagccaccgcgcccagccacgaacgacatatttaaacactcacagcactgcctgcctggggcctgggagttgtcagttctttggtactgttgagtataaagtgtgaggcaggtggctgtaaggtcagaggtcaggctagacagggaatcctggatatccgctgttcagtgaatgaggatctaccaagttcccaatcgtgtactaggcattgttacagctgctggccatctagccctgatggagcttccattacagttgaggaaaccaactgtaaacaaataaatgtttataataatggcaaggagtcaaaagtgctaatgaaaggcctctgtgctaaataaacaagctcctcctgggcatggtggctcacgcctgtagtctcagcactttgggaggctgaggctggagggtcagctgaggccaggagttcaagaacagccttgtcaagatggcaaaacctcatctctactaaaaatacaaaaattagctaagtgtcgtggcatgcacctatgatcccagctattctgcccagggggctgaggcaggagagacatttgaacccaggaagcagaggtttcagtgagctgagatcgtacaactgcactccagctacgtgacagagtgatattccatctcaaaaataaacacatacataaataaattaatgagctccaattttatcatgctgaccatcgagaaatttgcatagccgagtagtggatatgagatatgaaagatcagtgtggagaagagggtggagggagggaaactagaggttagaagaccagtaagaacataagcttcatgtcccatgtgaactaggagagtgacagtggagacagggagggattttatatgaaaaatatacaggtggtaacgttgacagacagtaactgatgggatggaatgatacctacatttctgttggacagctgaaaaatagaaccgatggagacaggtttgggaagaaaataataagctcaggttttgttgtttggtttgaggcaccataggacagagccgtaaacttttcttctccttttcctttttttttttagacagagttttgctcttgttgcccaggctctagtgcaatggcacaatctcggctcacggcaacctccacctcccgggttcaagcgattcttctgcctcagcctcccgagtagctgggattacaggcatgtgccaccacacccagctacttttgtatttttagtagagatgccattttaccatgttggtcaggctgatctcgaactcctgacctcaggtgatccacctgcctcagcctcccaaagtgctgggattacaggtgtaagccaccgcactcagccctaaacttttctttttcaatgaatgcatgtagttgccttcttgttctctttggagttgtttgcattttgggctgttggcgctttattgattgtgtaaagctttttgtacttaattacacagcaacatagatggagttgtcaaagtttgaagaaaacctcccaattctttgggaaaggagctaagatgggtttcactaaaggatacctctgtcctcaaatggtataaagaattataccacacagtgaggcaagttatagggaggactccttattctaaggagccgggctgaaagcatacacacgggagatcacaaaacggagcagggaagccacgtgtatgcataatccaaaaggcaccctcaataagaatttgctttcaaagttttatatagtacttgcagtttattctgttgattgtaagacatgagagaattttaggccaccggaacaaattaaagaaagttaagttctgttcttaattccttaaatgcagtttatttcatagagttattttccaaaaaatgtgaagccacataggttaccatgttgatgattatttctaggataacttcactgcaggaccactgtgcccaactattcgggaataacgtttgaccttgtttcttgcaagagctagtctcatgaacacatagaagtttttattaagttccatattggttatttacggatttgaattatttatttatttatttattgagacagggtctcgctctgtctcccaggctggagtgcagtgcagtggtgcaatctctgcccactgcaacctatgcctcctgggctcaagtgatcctcccacctcagcctcctgagtagctgtaaccacaggtacgtgccaccacacctggctaatttttgtagttttttctgtagagatggggttttgccatgttgcccaggctggtctcgggctcctgagctcaagcaatctgcctgtgtaggcctcccaaagtgctgggattacagacgtgagccaccgggctcagcctggattttttttttaacttttatttttgataactgtgtgagtaggtcactgtggaggtgagaaaaattagtgcctttagccaagaaggttttattgaagctggaggtgctcaggaccacctgcagagaagaaactgctctgaaaaggagtcattattacagacctttctggggctttagaagaaaaggaaaaaagatgctgaatagacttagaccccctggttttataaatttctccatcatatgcagacatttgcccacttccaacatgcatttgaaaaatcttcccatgcaaacaaagaattgatagcacttggcatagctgagacctgcaaagctttatgtttcaacacctgaagtcacctgagattaagcaagtgtggcacaaatagtaaaaccacagttaatagttcggactatccaaagtggcttgtcatgaggtgagcttgctcgcttagggctgattcaaaattttctctcaaaccttttgaaaaataattctagcaacagctctcatttcctgagaagtcacatctgagccatggatcaggtgttgggtgcttcacatattttctctctcatcctcccagtgatcctgccctgaagatgttgtcagccttattttatagtcgaggaaattcagtctcagagaagctgagtaacttggtcaaggtcacgcagctagcaagtgctggagccagattcctcacctagctgtctcctatcttaaagctccattcttttcctactcccactgtaacctctcatggaaaccttgattgctagcagtgtcagagtggggccctaagcatggaattcctacaagtggaaatgtggatggatggagatggatgttagcacctgctggggggaagggggacagccagcatgttccagccttcattctgcagagagagatgccaccaggtcaccatgcacatggtctggcctccgaagaggtggccagaagtctctgcagttccttgccccctttgtagctggggccgttgctaggagttcttctgaagtttcagcatttgtttaagggcttcctttctgccccaccatggtggtgtgcctactactgttacatactgctgtcagctccacatgggactctgctgtgttccttacacgttgtaggtattggtttgtcactcaaaggaaaaaggaaccttcaattaagtagattcttgccaccaagaggtggaggggctccaggcttgctctgggctggagattgaatgggagttctctctcaggtgagatgcctcttccctctaagcctgtctaaccgtggatttcctatacctaatattgcaaaagtgcatttctttatttgcagagaaaaatgttaaggaatcagcagttttcaaaaacggataacttaaagcagtgtttaaagacagaagcacctagtgtatgcttctctaccttcctttctgtctctgacttgcaattcttctcagaatccttgcatgggagcccaagggtctggaacggctttggcctctgtgaggtacagggtgcttccagacacatgtcaccttcatcagtcacttctgaagtcttttctccttactctctcttaggctgttttttcatctcaagatagcactaattacaagctccatcttgcctgtgttacaaggtaatacaacaagccaagtacttgccataatgtgcttcacaaattgtgacttcatggagaatatttgttgttgctgtcatggcagtagatagtcgtggaggtagttttgctgggtgtagtctgtctgggtcgttttctgcctgagagcgggaacccacgtttccattttggtttctccctctgctgtctgctgtttctggtgaggcctgcttggtaggactggaccgagctggatctgttataagaagcatcgatgactagaatgatttttattgtcatacttccttccatctttcaatatctgtcaacttttattaaagtttttttttaattggcttttaagtatgctcaaagggaacggctttaagaaaaataaggggcttaaagaaaaggataaaagatagtgtagaaaaaaattcccttaacatcacacaccggggcctgtcagggggtggggggctgggggagggatagtattaggagaaatgcctaatgtaaatgacgagttgatgggtgcagcaaaccaacatgacacatgtatacctatgtaacaaacctgcatgttgtgcacatgtaccctagaacttaaagtataattaaaaaaaaagaaaaaaattcccttagaattcatcggagacacacacacacacacagacacaaacacatactgcgtaaacacacacaccaccacacccccatacacaccccatacacataccacaccataccatatccataaccccacacacacaccacacacatacaacacacaccaccccaccacacacacaccccatgcccacccacacacaccacacacacacgacaacccctccacacaccacacacacagcacacccctacaccaccataccacacacacaccacaccccccacaccacacataacacccccgtacacacacacataacactacacacaacaccacatacacacccacacacaccacacacccctgcacacacccacacacaattgatccttcagcaacacatgggtggagggagcaccacactgaccccccatgcagtcgaaaatccacacataacttttgactctgaataaacttaagtactaatagcctacagttgaccggaagccttaccaaaacataaatgccaattaacacatattttgtgtgttatatgtattctattctgcattcttacaataaagtaagctaagcaatagaaaatgttattaggaaagtcataaggaaaacaaagtgcatttactgttcttcaagtggaagtgggtcatcttaaaggtcttcatcctcttcttcatgttgagtgggctaaggaggaagaggagggttggtcttcttgtctcaggggtagcagaggcagaagaaaaatatccatgtgtcattggacccaggcagttcaaacccatgttgctcaagagccaattgtacgatttaaaaaaattttaagttgcaataaaatacacataaaatgtactgtctggctgggcacagtggctcacacctgtaatcccagcactttgggaggctgaggcaggtggatcacgaggtcaagagatcgagaccatcctggccaacatggtgaaacctttctctactaaaaatgcaaaaattagccgggcatggtggcacgtgcctatagtcccaactactcaggaggctgaggcaagagaatcgcttgaactggggaggtggagtttgcagtgagctgagatctcaccactgcactccagcctgggcaacacagcgagactccgtctcaaaaaaaaaaaaattactgtctttgtagtatacagttcaatggtgttaagcgtattcatattgttgtttagccaatctgcagaattttctcatcttgcaaacctgaatcctacacccattgaataacatctctccattgcccctccctccagcccctggccatcaccattctaattgaagataactttgaattttaacagttgtagaaaaaaaaaaaaaccatgattttccctcctaaagggaataaatgaaatgaaataaagcaaaagtctgaaaactacaaagcttcatgtgtatagtttcagatattatcactacattcataaggacgtttttctttacaaggacagatattttgtgatggtttgaatttttgtgtaaaacagtgattcaatttcaccattggagaaaaatgacaactaagaaatttccaaatgtttcaggaatatataagttctctaaaattattagtttaaataagacaacataccacatcatctcacttatatgtggaatgtaaaaaagtaaacctcatcgaaacagggaataaaatggttaccagaggctggagggagagggaaattgccaaaggacacgaaattttagttagacaggagaagtaagttcaagagatggattgtatatcatggtgactgcagtcaataacaatatgtagcatatttgaaaattgctaagagagtgaattttaagcattctcaccacaaaagacaaaaaaatgacaagcatatgatatgaggcaatgcgtatattaaacagtgtgatttaagccattccatgatggattatacatatatcagaagtatcatgttgtacaccataggtatgtacaatcttcatttgtcaatataaattttacataaatgatttttataattaaaaaaaaaataggatggatgtgttgactcacacctatgatcccagcattctgggaggccaaagtgggaggatggctcgagctcaggagtttgagaccagcccgggcaacacggcaaaaaccaatctctgcaaaaaatacaaacattggtggggtatgatggtgtgcacctgtggtcccagctacttgggaggctgaagtggaaggatcgcttgagcccatggaggtcaaggctgcagtgacccaagatcgtgccactgcactccagcctgggcaacagagcaaggccctatctcaaaaaaaataaaaataaaaataaagtataaagtgactctaggatcatggcactctcttacactttcagcctgtgaaactgaggtgcccttgatagtctctataaatgtgtctttggtgtcctgatgtagatttttgtccccctgcaacagcatgaacaggctgaacatttcgccacaaggctttggctccctgccagctcttgaggttctggacttgacttacaacaacttgaatgaaaattatcttcctggaaacttcttctacctgagtaagaaactttcagttctatgaatctcctcaacattatactttgcattctaagagtgaaatttatttgccaggacttaaactccaagagaaattattggacagagataactttttctttagagactccttttgaatattccttcatagctcagcgtatgtgcatttgatatatcgttatgtgacaccattgggctgaagtggacttagtaaagtcatattaacattctgagagagatgatatacctaaatgagatcaaacctcacatttagctaagagacttgactttctttttaaatagcgtgccaaaaaaagatatcctcccatgttggtattaattctttgtacgatattttccaggatgtcccaatcaattaattataaaaatatttattaataaaccactaatggaatttttaaattttccagccaggattcttattttcagccttttaaaaagtactcttattgacctatttatccagtacacaggcattaagaaattattggccacaggtgaacacaccttattcttttatatgccaacaaatttcttgctgaagatgcttttgaaaattaaaaaatgatttcttctgggaactcatgcactatttcagacaaggtttgtttctcttaaatgagtgttctatttcttcaattagtaacttatatggcattcagaaaatctgaattttctgagctggtctctaaaatttcactttttgccttatgtacgttctctctctgtgactttctcaagcacatgaaaccaactgtaaaatattttcttgggtggtgaagcccctgtttttattatgttatattaacatacagttctggagtctgagctccaaagatcacttgaggctaggagtttaagaccagcctgggcgacatagagagaccctgtctctagaaacaaaaattaaaaaattaaccaggcatagtagcatgtgcctgtaatcttagctaattgggaggctgaggtaggaagattgcttgaggccaggaatttgaggctgcagtgacccactgcactccagtctgggtgacagaacgagactctgtctctaaaaaataaataaatactgataaacaaaacatacctctaattatactcagcttttttggttgaggataaacagatgctttagaattttagccttcaatagtttggaatcatattatcattgtgtagtaattgtgaacaaatttctgactactgatattctgcttaagttaggatttactctgttaacttcatgccattattttagtccctttgtcttcatttacttttgtccttaaggctgtagaaacaagtagtaataattagtcagattatggactgatgagctgtagttatagcctccatcaccagaaagcctttcattaatttttaacacaatgctatttacataggaaaaagtctattttaacatagttgcattcccttgaaagaacctttttgccctaggtatccacaaaagtggcacagtagttttctttgttttactttggatgcaaatggagaaataaatgtgaatcaaaagtaatctgtgagaaaaatagcaatcttttttgaaaatgtgttgaaactctgtgccccaaaatgctagtgcctacgttgttaattgtatcagtcctcttggatatagatgttttcctggacacaccagctccacaacaataagccagtaaatgtaagtttgacctgcttgttattattgggagccctaggtatgtcaaaggcttttcaccaagccagggttattaatcaaagctgactccctcgtattgatcagacctcaaatggttgggttccatgccaccctgtttatatattgctgtttaatttgcagccaccctgtgtgcactctatctaagtgacaacgattttgaaatcctgccgccagatattgggaagctcacaaagttgcagatagtaagtaagttatctaaattcttagagaatcaattcactgctgcagccttgtaggggtagaatcaagtcaatctgagaaggagtcaggtttgttttgcaggaataaaccactgcttctgatagtgtttcttgattatctgccggcgcttgtaaataaatggaaaggactgagctgtggtagaagagaggacatggaggaagatgagagtttctgtggagcaccttttaatgtgaaaatgtgttgacaactccctgttttcttctgtttagctcagcaatagggataacaacctgatctcactgcctaaggaaatcagggtgcttacccagcttaaagagctccacattcaggggaaccgcctcactgttctacccccagaattaggtaagtttgctgatgaatgaacttagttctgggtttcatgagtaacaattatcctaatgtagcaattctgaacaacctctctcctcttcttggcaactgctctccacctagacacccagttctgatcatttgagaaccatttgtcattgaccagagttcagctgctataggtttgaccttccccgatgctgtgttctgcagctgtagtctcccgtgtcttagaaactgctgatgaaagatgaccctgctcagctccctgcatgatgtagtggaaaaagcatggggttagtagtaagagccttatgcatggctcctcgttgactagctgggtaagctttctgggtcttggttgttattgataactttatcgaagtatcactcttactttttaaccccttacttttttattgacctagaaaaacttttagcaaagaattaaagtagttgttatggctacttgaagatgttgatacctctcctggtcgtgaatttgcctctctcctgatcccatttctagtaggaattgttaaatatgttcttgctgggaatgggtcctacttctggccactgaatcctaatcctctaacaagtcattcctatttccggagtgggtttatgtcccccgccagaagtaacctccaagccagtcattctgttactgcttcattccactgcaaaaggttcccaagttcccttatcttttcctgtgcagaccctcaatagcctctaatttctttaatcctttgaaccacattgttttctcaaactgcggttatttgcttttctgccccaaaataccatcatttttaagaaacacattaaggaagcagttctttaaacaagtctggcagtttgaagaggccatttgttagaaattagaatgcaagcaccaggagggcagaggcattttcgcatttgttccctggggtgcagtacttgctcagaaaacattgactgaatgaatgaaagaagcaaggaccttggatggcaagaggttaggaaggttatgagcaggccgatggggctaatggttacgcataggaagactgagacacagagcacacccatcagcactgagagttctgttggcagccttattagtctaaagggaaggcagtcacatgatttcatggaacagatggaaagtcccgcctcctcccttcccatttcccttaactctcttgttagtgttaaaagaccagaggtttatttaattatttttaagggctgaggagcaactcaacatttctctttattgagttgcaagcagtcaagttttgttttgggagcagggttacagaatcaagaaacactttttgcgaacaatttcaaggcaaaaagcttcttgtcaaaggagagatcttgggctggacacggtggctcacacttgtaatctcagcactttgggaggccgaagcgggtgggttgcttgagcccaggagtttgagaccagcctgggcaacatggtgaaaccccatctctacaaaaagtacaaaaaattagctgggcattgtggtgcatgcctgtagtcccagctactcaggaggctgaggtgagaggatcacctaagcctgggaggtcaaagctgcggtgagccatgattgtgccactgcactccagcctgggtgacagaacaagaccgtgttgaaagggggaaaaaaaaaagagagatcttgcacagtggttaataaccacaggtgttatcattagtaacagctggggagcttctacagaactcaaacacttgcttcctccccagcctactaaatcaggatctccatgtgtgaggtgaattcttgtgtaacttggtgtaaagctcacttaatgcctctgacatgtgtccttggttagcgtggttagtagaaacagaaaaataaatgtatattttgatgtcatttgatcttatttcatttttcaagcagtgaggcaatgtaggatattagattaaacaattattttatcagacagtaatttgccagaaaaatgtctagttgaacctacacgtgcctatgtatatattttaaaatgttactcattttgcttatcttatttaaatactatatgaggtcatctttgttcaacatttctgttaagctttccattaacaactcatgtatatttttattcaggtgtagaattgagggggaaggctttaaatgactttatttttgccagccatatgtagaaaagcttaatcttaacatttgcctgatagcaggttttcctgattataggcaaacacttagttgtaagtaaatgataaacctttagaagtcactgtcacgagctaaactcaagatgaagacaaatgtactatttatttttgaatggtgattttttttaaaagtcaacattaatataatactaatatagtaacagctattataataataggtagtgtgtattaaggcctggaattgcaaggcactaagataagtgtttttcctgcaatgtcgcctacaattatcataagaattataagcagactttttagaggtgaggacgttgaggtgtagagagggttggttggtgacatgtctgtgggggacacagctagtgagtcacagaggtgagatttgaacctgacagtccctcctctgggtccagcttcctcatcacggtgtggtcctctttcccacccatatgctggtaaaaggattcctagaaatgcagttttcaagtttgaacaaaacacaaccctggcacacccccccaaaaaaagcaggcagagagatgttgctggatggtgagttggcatgggctttgctggtgtgtgagcaaggctagcataacactttgcaaaatgcagctgagatggcctctggaagacaaattgctgccccattccaagtcagttgcattgtccccatgtctctttcccctcaacaaacatgacccccgatgggaacgtcttttttgtttctttgtgtccccaacacctgaggtgaccatatggatgctgctctgggctggctgatgggcagtgccgggcactgatgatgcacatgaagtttatgctgcaggtttgcttctgggggtgttttaaagcatggatgatgatatctccctgtatattttttatgtatctgaatatacaagataaatgcttttgagatttctgtgaaatttcctttcataataaatccagagtttattaacttgtaacctttttggtactaatatttcagccaagcaagagaatctagataagttctgatttgtcaggtctgagaacatgcagggacacagcaaaataaagtcaggggcttagctggagttttaatatgtgactgtattactttccctttattgtgtgtccttgaataagccacttaaaccgttatgtctgatttctaagtagtaaagcactgctttcatattagtctttatacctatcaaaaatgagatgtaagttgagtctctcctgtacccattcattcatttatttattcaggttaagttcctactttagggcagatctttgagtccaaggaaattgcttttccattaaagtaagattcacttattcaacaactgtttgttgagcccctggtatttgctaaggattatgacaagagacagaacacccgttattgatgatgttctagtgggagaggacagaagaaagaaagagagagagaaagaaagaatatgaatgacagacgtgtgatattaagagctctgggaaaaaattgagcatggaagggagtgtccagctggggaaggggtaatcagagaaaccctcactcatagggtggttccctttatgcagagacttaaaggaaggagggaggtctcctgacagagagaacggtaagtgcaaatgtcctggatgggcttgtgctgaggaagagcaaggccgggtacctggaacagagtgagtgaaggggaaagagttgtaaccaatgagcttatacaggaagtggggtctggttcacatgggaactagtaggacattgtcagaacttgggcttttactctgtgtgaaatggacacccccacagatgctcccatcttaatcaccagaatatgagaatctgtattggtgaaacccgcccccaatatttcaacgtaggttctttctattttccataagtgtcggctggctgagaaataaagagagacagtataaagagaggaattttacagctgggccaccgggggtgacatcacatatcggtaggactgtgatgcccacctgagtctcagaccagcaagtttttattaagggtttcaaaaggggagggggtgtaagaacagggagtaggtacaaagatcacatgcttcaaagggcaaaaagcagaattactaatagggtctaacaaagatcacatgcttttgagggaacaggacaaaaggcaacagcagaaccactgataagggtctatgttcagcggtgcacgtattgtcttgataaacatcttaaacaacagaaaacagggttcaagagcagagaaccggtcagaccacaaatttaccagggcggagattttccccaccctagtaagcctgagggtactgcaggagaccagggcgtatctcagtccttatctcaacagcataagacagacattcccagagcagccatttatagacctccccccaggaatgcattcctttcccagagtattaataataatattccttgctaggaaaagaatttagcgatatcttccctacttgcacatccatttataggctctttgcaagaagaaaaatatggctctttttgcccaaccccgcaggcagtcagaccttatggttgtcttcccttgttccctaaaaatcgctgttattctgttctttttcaaggtgcactgatttcatactcttcaaccacacatgttttacaatcaatttgtacagttaacacaattatcacagtggtcctgaggtgacgtacatcctcagcttacgaagataacaggattaagagattaaagacaggcataagaaattataaaagtattatatgggaactgataaatgtccatattaaaatgaaatcttcacaatttatgttcctctgccacaactccagctggtccctccgttcggggtccctgagttcccacaacagaagagttttaggatgtcttccattaacccttataactaagtgttttttagaaaaaaatgaaagtttaaggaactgtttagatttttttcaagaatatttcatagacaacattatgtttttctacccaaacattatttctagttgtctttctttttgtgatattagcagctgttttgaattattttgccaacttggcagcaaccactacagttttctaaaactaagaagcctgtattctagaactctcttccctaaatgaatcctcataaaatttgcaaatagagaaaattcacacacaattccaaagacaaaagtaaagccgaagtcactgtgagcaatttttggcagccaggcatggagactttcacagcttttaacaagtttcttctcagcaattctagcatccagatatagccccatcatagacctcgcatgagcatgtacttcataatcctggtgaatacagaagtttcctggactcttcatgagctgttgctttccctcctatatcagtgttttcagctgaggccatttgtgattgtgtttctgactttctgtaggcaacctgccaaaccttcatttttttttctgcttagatgcacaagaatgtaggcactaattcttatattaaactgtttatttctataatacttaattggctgttttcctggctgaaccaaaccaagagcagcagggatgataacttccaaaactgattaaattagaggtcaagaaattgagccattttaattctattattcttctttcatatattaaatagaaaacttttgtagatagtttttcttcattatttctttggttaccctgaggtactgcttgtagagaaaaggtagaataaatatgggattctttccctttatttaccattttctatttatcagttacttttttatttaccagttttctaagtagtattctgctttcctaaaatcctagaaagcacttgaagaaattaaaaatgggttgatttttttttcttttttgagagagagtcttgctctgtcgcccaggctggagtgcagtggcaagatctcagctcactgcaagctccatctcccagattcacaccattatcctgcctcagcctcccaagtagctgggactacaggcacccaccaccatgctcagctaatttttttgtatttttagtagagatggggtttcatcgtgttaggtaggatggtctcgatctcctgacctcatgatctgcctgcctttgcctcccaaaatgctaggattataggtgtgagccaccatgcctggccaaaaatgggttgatttttcaaaaataaatgttgggaattattctcctgcctcttctcagtctaatgaaatttttctgtaagatattgcatttttaagtactcgaattttaatttttttaagtttttatctctactgagatttcacacatgtttactcaatattattattatttcagtccttgagcatatctataatatagtagtatccccttatttgtggctttactttcctcactttcagtcacccacagtcaaaaaatattaaatataaaactccagaagtaaacagtttataagttttaagtcatgcattgttctgagaaatgtgatgcaacctcccgccattctgctgtatccggttcaggatgcgacatatccctttgctgggcagatccacacttcctgcttcctgctcattagacatttgcagccatctaagttatcagatggacctagcttagtgtagcagtgtttgtgttcaagtaacccttattttatttagtaatggtcccaatatgcaagagtagtgatgctggcaattcagatatgcaaaagagaaacctgaaaatgctttcagtaactgaaaagcagaaagttttccacttagtgaggaaaaaaaatatgctgaggtcgctaacaactagggtaagaattaatcttttatttgtaaaattgtggaaaaggaaaaataaattattgctagttttgcttttgtacctcaaactgcaaaagctacagccacagtgtgtggtaagtgctaaggtagggtttggtattatccatggtttaagagatccacggaggtcttccaaagtacgccccacaggtaaagggggagtactgcagtcttttaatgctaattccaatatctggatgatgtatttattctattgactgcatgctttaatatcattataagcttgatgatttaaacatcaggtgtgcacctgctcattgcagtcatcatcatcatcatcatcatcatcatcattatttttgtttgtttgggtttttttgagatgaatcttgctttatggcccaggctggactgcagtggcatgatcaaagctcactgcagcctcagactcctgggcttaggtgaccctgccacctcagcctctcaagtagctgagactacaggcacatgctaccatgcctgcctaatttttttgttttctatttttggcagacagagggttttaccatgttgcccagccttgtcttgaacatctgggctaaagcaatccatctgttttagcttcccaaagtgttgggcttacaggtgtgaaccaccatggctggcttgtggtcatcattattattgatgcttatattagttcatgtttggatagtgggacctccttcaagttgcctctcagatcctatggacatgatcctggggggtataaacgtgcccttgctttccagtatgacaagatgctctagactgattttgcacattgcctgcctgcagccagaaagcagccatttctccaaaaagctttggttccttttagtgagtgatgatatggagaatccaaagttatggcaccaaggagctttctgcttctgttttgtttaatgcttctaggacttttcagtggattagtctaaaagataagtgcattttttaataaaaaattataatttttaagtaaacctttctgttaacagtcttgattagaggattttaattatgcttagagataatacatctgtatcttcttctatttcatttgaaaagcaccagttttcaatgtcacacccataatgagtcagagtctagctctgtcgcccaggctggagtgcagtggtgtgatctcagctcactgcaacctccaactcccaggttcaagcaattccctacctcagcttccagagtagctgggattacaggcacatgccaccacacctggctattttttgtatgtttagtagagatggagtttcaccatcttggccaggctggtcttgaactcctgaccttgtgatccacctgcctcggtctcccaaagtgctgggattacgggcatgagccactgcgcccggccttttttttttttttttaagacccagtctcgctctgttgcccaggctggagtgcagtggcctgatctcggctcactgcaacctctgcctcccaggttgaagcaattctctgcctcagcctccttagtaaatggaattacaggtgcttaccaccacgcctggctaattttctttttttttttttttttttgagactgaatctcactccgttgcccaggctggagggcagtcgcgtgatctcggctcactgcaacctccatctcaagtgatcctcccgcctccatctcctaaagtactgggattataggcatgagccatcacacccagtcaatataactttatattcacaaggaaacaaaacaatttgtttgactcgctttatagcaatatttgctttattgtgatggtctggaaccaaatccacaatatctttgaggtatggctgcactttctaagcatttcctgagtcagcctactttttctccattttattgccattattctatccatctttttgttttcttgttgttgtctggaaacagaaaagtgctgtgtcgcccaggctggagtgccgtagtacgatcatagctcactgccgcctcgatctcctgtgtccaaactatcctcttgcctcaggcttctgagtagctgaggctacagatgcacgctaccacacctggtttttgttttgttttgttttgttttgtttttgagacagagtctcgctctgtcgcccaggctggagtgcagtggcgcgatctcggctcactgcaagctccgcctcctgggttcacgccattctcctgcctcagcctcccgagtagctgggactacaggcgcccgccaccatgcccggccaattttttgtatttttagtagagacggcgtttcatcgtgttaaccaggacagtcttgagctcctgacctcgtaatccgcccacctcggcctcccaaagtgctgggattacaggcgtgagccgccgctccctgcccggctcatttttaaaaagacgtttgtagagatggggtctcatcatgttgcccaagctgatctggaactcctggcctcaaacaatcctcccgcctcagattcctgagtagctaggatcaatccattgctgaagagtacatggatgttactttgcagactgtcaacctgaattcgtgtttgcttgacattgcctaattattagtttcagtttcagcttacccactttttgtcagcaacatgcagaaaagactgtgccctttttagtgtattgtatcaggaagcatctcacattggtttgtgccgttactggtgcggtgactaccagccacttggttaagatggagttggccatatttctccactgcaaaattacgcattttccttttgtaattaataactgtgtgtgagaaaattctttgagatgaggtatatatctcattctttgtcaaactataaggttttttttaagtgaaagaaaatttattaagaaactaaaggaataaaagaaaggctactccataggcagagcagcgtcactttaaggttttgctgtcaactgatttttgtccaaatcaataattactgcgatgattgaaaaatgattattactaagtttattttcattgtctcaagttctgccaaactctggatccaggctgtgtcaatagggtagtgtggtgcctcctatacctgtctcggcctcctacagtcctttttatttattttgttttttattatagagacagggtcttactatgctgcccagactggtttcaaactcctgggctcaagcaatcttcttgcctcagtctcccaaagtgctgagattacaagcgtgagccaccacacccggccaagttctttaccatcttcagaaggcttaacttgcactttcagcaaaaggatagattcccaggaagactgtgagagagagttggggcctaagttgataataccaaatacactgaacttgactgtgttcaccatgttatggctctagagaaatgagagtgctagtgaggttggtgtcattttgtgtgttttctgtaccttgaagtccctcagaaatcttgcccctggtcttcttgttctaagaacacaacagtttctctttttctgtggagatgaaatatagatctttgattttggaaccaaatttggactcttgactctggagcaccaatttcttcagcaagttgttctctggaatcaatcccagggtatgggtttatcataaatgccttgatgagagtgtgtaattgagaggcgctataggtggtatgacactgtctggcttctctactttgaaattccacaccaggttgatcttgcccatggctgtggcttgaatctaaagtcaggttctggtcttttctggaatctgtgcctagctcttcaattctgggtgacagagcgagactctgtctcaaaaaaaaaaaaaaaaaaaaaaaaaaaaaggccaggcgcggtggctcatgcctgtaatcccagcactttggaagatggagatggaggtgggtggatcatgaggtcaggagttcaagaccagcctggccaagatggtgaaactccatctctactaaaaatacaaaaaaatagccaggtgtggtggtgtgtgcctgtaatcccagctactccggaggctgaggtagggaattgcttgaacctgggagttggagattgcagtgagctgagatcatgccactgcactccagcctgggcaacagagctagactctgcctcattatgggtgtgacattgaaaagtggtacttttcaaatgaaatagaagaagatacagatgtattatctctaagcataattaaaatcctctaatcaagactgttaacagaaaggtttacttaaaaattatacatttttattaaaaattttaaaaatacacttatcatttagactaacccactgaaaagtcttagaagcattaaacaagccttctggactcttctgtattgatttctaaagcaagtttttgtttcatagcataacctgggtaagatttttgattggaggtattgatgaggattttcaattgatcttctgtgaatttggtgtgattgcacctatgatttgctgctaccatcttgtgtgaagaggtgtctttggccatgatggaagagagtcctggaggctgagctactgtctgggagaccacttacagctcatttttaaaaagaaaggttgcatataatacaacataatttacaaatctaaagcttatggttttctgggctttgacaaatgaaaacacctgtgcaacttcaacccttaccaggatatgcatgagtttctacctgaaatcaccagtattctaacaaacagctttgcgttttttgaattgttcagtgcctgtgaggattccttactgcaagtttatgaaaaatatattcagaaggcatagtctacaattactgtttgggtaagtgttttcatcaattgtctgaatatttgctgtgaatttaagtatgctgatttttatgtagttatcctcggagaaacattgtgccatttttcgtgtggaaaccacttgtagaataaacagagattattaccgcacggagttggttgtgatgggcacgtctacctgtggctgccatttgagtggaaggtggaatccgactctggatcatcggcagcctgagctggtactgggctcacactgaccctgggagtgctctatgcgtgcttcaccttatgaggggtgcagcaggaacaaaaatagaaaagtgtgctctactttcacatgttaccaagggacagaggataccaccaaggaattagaaaactgttaagtgaggatgtattcttcttaatagcctttcaaacaaggaatttgaaaacaagattctactcatcccacaccaaaatgtaaacagatatattattttttatattcccaggataattttggttttacttaagcatcactattgccctgaaatgtcaagtcaagtggaaaaataaatgcgaataatcccaccactagcctccagacttgatgtttatgttatttcctttttaaaatgacctttaaaaagttataaattagaaacgtggaaagtagaatggtttcatgcaagaaatactggaataagatccctgttctggccccaaagtcttagacaagtcattcagcctttctaagcgtcagttctcccatctggaaaatgtgggcattcatctctatgggagcttctagctctgtcagtgagtttctgaaacttgcccaggaaggagcagccctagtctgagtgcatgctgcccctgtgcttgccttttgcctccttcttatcctcgaggtagcctgcagactcctcctcattcatctcctaagccagtgctatctgacggcagggaatatgtttccaattctggtcacatctgaaagaaatttttcctggaagattacatctatgacctgcaaagctttatgcttctctctgtattccagatcttgtgttttttttttttatatgggaaaagttacaattttttttttttgagacagagtttcgctcttgtcacccagctggagtccaatggcgtgatctcagctcactgcaacctctgcctcctgggttcaagcgattctcctgcctcagcctcctgagtagctgggattacaggcacctgccaccacgcccagctattttttgtatttttagtagacacgaggtttcatcattttggccgggctggtctcaaactgctgacctcaggtgatccacccacctcagcctcccaaagtgctgggattacaagcgtgagccaccacacctggcacgattatgtctttttaaatgagaaaaatttcttgagatcataagggaaaaaaaaaatccctaagccaaagtaagtcaaccaagaagaaaatgaaaatgaaaatgaaaaaaatatgtattttaaagaaagtaaagtggacatagcagtcactctgaaatctgggtatagaaccaccttcatctctaaagtttatatttagccaaccactattctaagcaaggttgtggtaggaatacctaccaactattgtaggccacatgtcacttaaacaggcaaaaagtaaagcaaagccataattgtggtttgatattttggatattcaatctcatttcagtatttgcatggtctcacattttggaaacaaaattgtggtgatttcacttgtctcttcatatcatgattatacttaaaactgagaaacaaatgtagactaaagaagtaaacactaaagggtgagatcatgcaagttaaacagatatgctttctcaggggaaggtcacttacccatcatgcgctgatatatttttgtgagcttatatggttctagcgtatttacaacttgactaactttacatgattcactgtgtactgtagaatataattaaattgacatttcctggtacagaataaatttgcatatgagcgaaacaaatgatgagaataaataagtctgaggccatataattccactggttaccaatttgtgtcttcagctctacaccaaagcaaatattacaactctgaacaagcaagcaggcgaagaatagatttgctgtaacctcagatgtcaaagaatgcatttatctctgaaaacatttgtatttttttgtcacattgtactttatttaaaggtggccacagcattaaagtgtcagttcattttgtacaaccagaaatggaaaatgagtcagtcaagctgaagcagaagtttctaacaaagtctaaggcatagttctatataactaataataaggatacaatatttggcttactgaattcccaaactgaggtcactaaaatttaagaatatctaccaaaacttaagcgaaatctcagagaaactttaaaaataacattttatttttgatatttcaaaatgtttcaatcaatattctgagcctaaatgtgcaggtgagtgctttctccatctttgcacatgtgaagtgcgcctgaaccatagccccatatttctcaaacaccatcacactcatagaacagaaaggaaagggtagtttcaccagctagcccccacaagccactccctggggtcctccccagcacctgctaaatttgggaggcctgatttcaggggggtggataatgaactggcaaaataaacccaaaagaatcgtaattacaaagaccaactcaggttccagttagacagcccataccagtgcttttgatgttagctgcggttaagggggcaggaaaggctcccactctatggtccgtggcgtggtcagctcagcgctgccaccttggcgggctccatctcaccatgaccctctcaatcaggctgatggtgtctccttatgccaagtggaaggaacttcaatcaaattctgacacgacctgcaaatcctctcgggccctgggctactggttaggccagtagggctgtgtatcaaccgattaaacccattaataactggcagcacagcacggcctccttctcaacaaattacgatgccgatcccggaatcagccatccaggcccatggtcttttgtccttaagctttcaaaacgcctcccctgcttcatgctttctagtcttgaggacttggcttcagcgtgcttctgaattgccgctccctctggttgacaattcttttttttttttttttttttttaagacgcggtctcactcttgttgcccaggctggagtgcggtggcgcgatctcggctcactacaacctccgcctcccggattcaagcaattctgctgcctcagactcctgagtagctgggattacaggcgcccgccaccacgcccggctaatttttgtagttttagtagagacggggtttcaccatgtttaggcaggttggtgtcgacctcctgacctcaagcgatctgcccgcctcagccacccaaagtgctggtattacaggcatgaggtcccgcgcccggccgacaatttacactgttctccagttggggcggagcgggagacactatggagcccacctctgcaagaggcaaggcttggcgaaaggcagagaccccaaccatgggaaggtgcactttgggcaccgaactttagggaaagcgctctgggtcaggcgtctcctccagagtggtcagtttagagttaaaaaggccgccttcaaaatagttttaaaatctatacatttacccagacatacacatttttcgagacagggtcttgctctgtctcccaggctggagcgcagtggtgcggtcgcaagccatcttcctgcttcagcctcccgaggagctgggaccacaggcccgcgccaccacgccgggctaatttcatttcgtttcgtttgttttattttcgtttgtttgttttgtagggatggagtctgactgtgttgcccaggctagtcttgaacctctgggctcaagggatcctccctcctcggcctcgccaggtgctggggattcaggcttgagcctccactcccggccctattaattattcttaattaaaacatttcaaggacgcagtgtttggggccagcgcggcgtttgcagtggctgctccagcctcgaggccgcaggtcaccgcgcgggccccgtgcctactggcccggcagtcctgcgggtcagctcaggggagtgctctggagagccctgagcccacctcctgcgccccgcccaacctcgggtccccaggcccagcctctgacacgccgctcccagcgcggccacgccacagctccgggctgcgctcccccaggcaaaggcgccgccggcgcgtccagcgcggcctcctcctccaggcggcgcttgtgagtcaatggaaaagtccttggcgaactgagcagccgcctagtatatctctgaagcctcctgcggagacttcacggcttgtcccaggagcttctacaacagcctggcattgagagtagagttgtaatattttccgccagtttttcccagcccggccccgaagcgtctgatcttaaagtccacgtatcagactccggggggcgtccctgcaagagcgccaggtccccgacacccaccagggaatgaatctgcgcccaggtccccgacacccgccagggaatgaatctccgtcccaggagaagggcgtggcgaggggagaagcaacaaccacaggacccgtgacagtggccaagccttagaggccccgcatgcctgccaggcgcccgagcccacgcagtccaggtttccccatccgggcgggaaccagctgtttcccctgcacgggcgagggcgctggggtcacctccgccgacgccaggcgtgagctccagaacccgctcccaaccgcccggtcccgtgagcgcggggagcctggctctcgcctgacaataaagaaatcatcacggacagaaggaaagaggagcgaggctgggaagggagcggctttaatccggggtccgcccccttcaattctccagcgcagcggccccgaaagtggggtggggacggggattgaggctgagctcgcttcttccttgttttccgggtctcgcgcctctgaagcgaactgggcctggaggggtgctggggatcgagggagcggcgttggtgggtgaccgagggaaaggtggggccagcccctgggcaccggtcggaggaggattacgaggcggagccgctgcctgcccgcgcctcacccgcttggtccacccaatagctccgctgtagactcgcggcggcaggagcggcgggccagatggtgattacaacccggggcgctatccctttggaacctgacccccaactccgctcagtaaccggatttccggaagccgcgacctcgaagcccccagcgtttctccaccgacggcggggccggggctcctggaagcctcggagccgcagctccagcctgcagcgcacgccttggcccccagggagcagagaggcagagtacccccctgcatccggagcatagcaagcatgccccaggctgaggacctgcgacttggtgggacttcggtgcccgcccctccgccactacagggagcagaggcggctctggaagtcggtttagtgcggagaccgcgaccggaggagcgcagaacgctcctcccagcgtcctgggctccgcaggcacaatttttaaaccagaggcgaaatccgagtcccgccgccctccggggagggagcgtggccgcctagccgagccccttctctggctccgcccgcttttgcgccgcgaggccgcctggtgagttccagggccctgtggtcccccagccgccggcgctctcgggtgtcttttggccgcggcaggaacggagctgggcgctcagacggcgccggggtcgtttctgtgcccccgcccggtggccggagccgcagccttgccccttccccactggggcagcgcctgcctttctcgcggccggaccgcgccggagtcccaggccccaggcagcccgggccgcagctgtcatggagaagcccggcgcgtacttggggtgcccggcaggagccccggccgcctcgcgcccttcttctcacccacgactgtggccggcggcggcctctgcttcccggacaaagctggagatgctgctgcggagtcggccctgggacctgcttcttctcttggctccggggcccgcagccgtcggggcccggaagggctccccggggcgttccctcaggagcggtggccagggctgatggggcgtgtacgacgcgggaccccgagcccggcagcagccaagtatggcaaggaccagcgcgagcatctccccactgcggccggggacggcgtggggtgggagccgacccgggacatccaggtgggatcggccaccgctcaggcgctgtcccaggcgaacgccgccaggggcaggctcagcaccgcccaggccgccggctcggtgagcgcagagaggggcccccggtttatgccaaacgcgtgtcttctccaacctcctccttaagcccctgtctcataggctggttcctgtctctctccagtagttcctgggtgcctgggagcagagacggcccattctccccaagctcagctgcaggcttcagtgacctgggcaaagtgcggttaaccctgaccaccttttggggaggaaggccggttgctcccctagcctccactgtggcactaggaggcaagggtagccaagctgatcgccggtttcatctgtacccacccccacccccacaggtgttgagatgggcagtgacaggtgggttggcagccggactggagtggcatggctaactgccctgggcaccatattccctgcctgtcaccactcctggctgcccaagtagcaaagcaaagttacaatgacaagatccagagaggggaggctccagctggagatggcgctgctgtcacaggccacctgagcaacaatgtgacagcttctcatgggggcgggatctgtccccagtccctaccccgccctggcttgatccttgtcggtgtctatttctttgccttgctcttatctcagcctggcttcccttccaggatgtcagctctgagtgtctcttggtccacgcttgtctccatctctcctttctcttccccactccctaaactcaggacccagtcactcctgctccttacacacatacacacccacactaacatacatgcactctcacattcactctcgttccccccccacacacacactcccaccctaccttagacaggaaacaagtttccctcccagaacccttataaagacctgtggggaatgaccgggatctgggccccccgtaggtctgtgagtgagcctgtgtgtgtgcaaaggtgtgagcctgtgagcatccatgtggctgtggaatttagaaagcatgtgtgtacacacgtgagtgtgacagtgaattgttgagagttgaaactgtacatttggggtcagtgtggtcttggtcatgtgggcacacaggtgagctccggctagggtggagggatgtgagtgactcggagtgtggaagctgagcccagggcagatggacaaatacatcctttgagctcctatggaggctgccaccccataccttgctcacctactccctctttgtcatcctgggttccgtcaaatcaggatggggtgcaggaagggggagtgaagctgctgacctctgggaaggggcctgcacgctccttgggcctgtcagccactgatctgttccatgttcctataaatacttaaaaatcctagctgctgaggaggaagacatcctccaccagccagctgggggtcctggcctggaagctggtggggagggagctagggagcaagacacatgggggaggggaggggggatcgcatcagcgaggctggcatcagggactcctgagttccgctcctagttttgccaaaggttagcctgggtgccccagtatgtcttcatcaggaactgcagagccagaaataccatctatgcctctgtcccaggaagcagccctacctctgcctgaagagagagactcccccgtcaacagccagctttctgccttctagtcacgtctctcaagtaggggtaaagagaggggtattcttgctttttttgtagtggggagcgtctcactgtattgcccaggctgttctctaactcctagcctcaagtgatcctcctgcctgtagctcccaaagcacaacaattacaggtgtgagctgccacacccagcagcttcttactctttaaacgccagacaaaattcttctggagttcctggaggggattgtctctttgaactgaaaatctttcccaggacacctttatcaatccatcaggctctttctggattggagacagaagaaactgcagttcaatgaccccctttgcaagagccccctctgcagccgttgaggggagcgaaagcattttcatctggcctcacccccatctgcagccagctctttcacttctggagctgggcttgttgtgataacctggaagagggggaattagttgggatgactcacttgctggagcccatcaacactagaccaggcttgtggccagatgcctggttaaccagcccaggagagcttcctttctcaggaagagaatgattattgatcctctatacccattgcccaggacagtgtcaggcacactataggcccttgggcatttgtgtggcatcatcagcattacgcctgtatcaccaagtcaagctttcccaatagcagttggtggcaaactccaactcctagtgtcagaaggcatcacaaagcccagatgtcctgggcctcccagctcaggcaagcctagcgtggacacagaaacccttgacactgagccaatatctcttccccctgtatggcttgaatttcagatatattgatgttgagcccttctggccggcagtgggactccccttggccttacataggtaatgcctatatcctggcctgggcttttccaagaagccagactctgggaaggacctggagtggaggaaaaaacaggcagagggaaccccatgaggggttctggctgtggaaacttgcccctaatggggcatcaaagccaggcacgcaggggctcctgctctgccagaggtttgaagtcaggactacagcttcccatcttactcttgggatacaaatcagctgttttcagatgagagagtctgaggttccaattttataagatgagaagggctgaggtgatgcccattgtgccacttggctgagtccagagctgtgatgaagagggaaaagtcacagggcaggacaaagaaggggactcagggacccgggagttttccttggcagaagtcaacttgccccacccctgagaaaactctgaccttctcagctgccagggaggaaagcagggactggggagaaggggacagggagagggaacagtctggtgctctgcgccctgggagagaagtctgatgacagcagtgactcaggaagggttaagaatattcctaaaatagccaagccacagcttaagccagtccatgaatgcctcttccagagagcagatctgtagcaggaaaagtcagcctgatctttgccccactgcctgctgcctggccctggctgctaattaagcctcccaccctgtccccttcaccaactcctgtcctaatggcgatggggtaggagtagtcagaggagccaaatctcccagatcaacagagaactccagctgggaccaggagcactgggcccaatgcctcccctcccccatccacactcctgagtcaggtagaggacatagggggacagacaggcaaagtgcaggccttctgcatgggatggaggctgccaggagagagcaaccaaattctcccacccacacatatgcatcgccagccatgatcaggtgggacctccaagatcatcatcaactactaccttctcctagctctttgttcccttttacttagggcatcttggagtgagatgcacagggaagggtcgagggagccccttcatgaacaaaccatatctttgtttcaggggcaggactgggtacataatttgcaggacccggtgtgaactgaaaatggagtcatttgttcaaaaaatgttaagaatttgaaggcagtgacaacatagcattaaaccaagttcaggtcccctctgaatgtggggcttttgccattgcacaggtggcacctctatgaagccagccttgtttaggggtttcgtttaatgaacatttactaagtgcccactgctcagctcttctggctctgtaatatggtctggctctgtgtctgcacccaaatgtcattttgaattgtaatcccctcgttttgggggagagacctcatgggaggtgattacttcatgggagtggttcccacgtgctcgtctcgtgaaagtgaatgagttctcacgagatctgatggttttataagtgacctttcccctcttcgttttgcacttctctctcctgctgccacatgaagaaggacatgtttgcttccccttccaccgtgattgtaaatttcctgaggcctccccagccatgtggaactgtgactcaattaaacttctttcctttataaatcacccagtcttgggtgtttcttcacggcagtgtgaaagtgaactaatacactctgtgacctcagagactccctctcagtgaccctgttctcaaatgaatgaagatgggtgctcaaagatctctctctaaacatggaacgggggctatctgaagacacaggtgattaatttctaatcataactaaggtctgagtcttgaagaccttcctctggagcctcattaaatttagttaatctagatgggtccaggtgctgcaggtaattacccttgtcttgtctcttgcaaaatcatggaggtttggagagttcttttagaccccctctcacatggaggtttgttttcttcttttttctttcctgcaaggacaaagtgaattctgtgatggtttgtgtagcgttttttagtttattgccaaaaattgaggctcaagttagtagactacatttttaaatgaaactttctagacaaagaaatgcagctgaaactgttcctttgataccagtttccaaatctgcacagagttgatagcaattttttctctttatctttccctgaattgtatatattcatataaatgctcttaaattattagtgcaacagggtggattgtcattacagagaacgtccttagtatagaacataaatcttcccactgccaactgggctctggtcacaaagcacccagagctggcctttaacttccacttcttgattcttttccttaccttttctatttctagaatggctttgtcatttcacttgtctgtctggtaatatcctcctcctgtaagaatcaacgagttcttgatacatattggtctaaatttgcctcctgtttgaacctttttccagttttccaggcaaggttgatttatctgtcttctgtgtctccataacaatctttccaagcataatacagtaaaaagagagctgattcatcatgtcctctccgtttccctctggagacttgggagctgatgtgagggtacaggtatgtccctgtataagctctttggtcgcctttgtcagtttagcacagttctcggtatataattgttctcaggtgccattaaactggacctgaataactgaaggatcgaaagtgttcaggaatcacccaggatgcttcaataattcatcctaattagggatatggggaaactgcatgagaaagaagttttttttttttgaactttgaggataaattaaaattcagtaggcagaatgataatatatgttgataatttttattttaaaatgttcatttttaccattttgatataatagtttattttttaagaaaaaggcagaaacccctgcttattagaaggcagattttattgattttttacccctagacttgttgcatatcaaacctatataaaaatatctataaatcaaatcattaattgtgcctcgtataataattctatatatggatgtaatgtttgattcttcaggagctttaataacttgaaggcgctttgattgctttaaaattatttctcattgtatttgtttatattgtatcgttaagcaaaagtacagagtaagcaattagtgtgattaattcctcttctataatacagtaaagcactgcctccctagaccaattctctgggatccctggaagacatctggcatccagcaagtctttacccctctttagaaagccgtggagaaactgggggcaattctgttacttatttgccctctagaggcaattccattaattaccctccctcacctatccatggcactatttcttcagttacatgtagaatgctgttatgtgtctcctggccagaccctttatttcacagatgtggaaattgaggccatgaaggatgaggtaattgttcagagtccacatgactagttactgcccagagcctggcctggacttctctcttgttctgaggccttgagttctctccctcttctttagtgcatatgaccagaggtaacataatctgcgtaccagatggttattttccatctttttttgtttgcattataatagccattttaatgggtatgaagctgtacctcactgtggtcttgctttccatttcccgtatgacttgtgatattgtctgcacatattttaatgtttatacactaacagagctgattactaggggtgtgtgcgtaaggggaactgtgtggctgctgagtggcttccctgtgggatgatcagccagaacccgctattgtattaggggaatccccagatgtcaccgtctatgggtctttttcagtttttatgggtacatagtaggcatatatatttatggggtacatgagatattttgatacaaacatacaatgcataataatgacatcagggtaaatgggatatccatcatctcaaacatttatcatttctttgtattataaacaattcagttatacgcagttattttaaaatgtacaaaaaaactattgtagttaccctgttgtgctatcaaataatagatcttattcattgtaactgtattttgtacctattaactatccccacttccccccaccgactgcacttcccagcctcaagtaacaaccattctactgtatcttcatgagtttaattgttttaatgtttagctccccaaaatgagtgtgaatgtgcaaagcttttctttctgtggctggcttatttcacttaaaataatgtcgtccggcaccagtccatgttgtcactaatgacaaaatctcattctttgttatggctgaatagtactccattgtatatatgcacattttctttatccattcatctgttggtggacacttaggttgcttccacatcttggatattgtgaatagtaatgcaataaacataggagtgcagctatctcttcgatatatttattttcttttttgtgtatatatctagcaatgagatggttggatcatatggtagctctatttttagttttttgaggaacctccaaattgttctccatagtggttgcactaatttacattcccaccaacagtatgcaagggttcacatttttccatatcctcaccagcatttgttattgcctgtcttttgaataaaacccattttaactggggtgagatgatatatcctcatagctctgatttgcatttctctgataatcagtgatgttggtcaccttttcctaagtctattagctttttgtatttcttctctgagaaatgtctattaagaccttttgcccattttaaaatcagattattagatttttctctatacagttgttttagctttttatatattgtggttattaatcccttgtcaaatggacagtttgcaaatatgtttccccattttgtggattttctctttgttgattgtctcttttgctgtgcagaagctttttaacttaatgagatcccatttgtcctcttttgctttggttgcctgtgcttgtggagtattgcttaagaaatctttccccagtctaatgtcctggagaatttccccagtgttttcttgtagtagttcaacctaccaagattgaaccatgaagaaattcaaaacctgaaccaaccaataacaaataatgagatcaaagccttaataaaaagtattaacaaagaaaatcctggaagcaatagcttcactgctgtattttaccaaatatttacagaagaactaataccaatcctattcaaactattccaaaaaatagaggagggagaaatatttcaatgcctgatacttaaatcaaagacacattaaaaaagaaaactacaggccaatatccctaaggaaaattgatgcaaaaatcctcaagaaaatttacaggcaaaacaaagtccacaacatattgaaaattattcataatgaccaagtggaatttatgccaagaatggaaggatggttcaacataacacaaatcaatgtgatcatcatatcaacaaatgaaggacaaaattcataataatgtgaattgatgctgtaaagcatttgataaaattcaacattttattgtaaaaacccttaaaaaaacagggtatagaagaaacatacctcaacacaataaaagccatgtaagacacacccacaagtagtttcttactgaatgggaaaaaaactgaaagcctttactctaagatctggaacaagagatgcccactttcaccactctgcctcctgagttcaagtgattctcctgcctcagcccctcccaagtagctgggactacaggcacatgccaccacacctgactaatttgtgtgtgtgtgtgtatttttagtagagatcgggttttaccgtgttagccagaatggtctcaatctcctgaccttgtgatccgcctgcctcagcctcccagagtgctgggattacaggcataagccactgcgcctggcccttcctgtcttcttctaagctctccaaactgttccaacctctgcccattacccacttccaaagctgcttccacattttcaggtatctttatagtaatgctctacttcccagtaccaattttctgtattagtctgttcttgcaccgctataaagaactacctgagactgggtaatttataaagaaaagaggtttaattggctcacaattcttcaggctgcacaagaagcatggctgaggaagcctcaggaaacttacaatcatggcagaaggtgaagagggaggtggcacgtcttacatggctggagcaggaggaagagagagcaaaaggggggaggtgctacatacttttaaacaatcagatctggtgagaactcactatcacaagaatggcaagggagaaatactccaccatgatcctatcacctcccccaagaccctcctcctacactggggattacaattaaacatgagatttgagtggggacacaaatctacaccattttcataaggttaatattaaaaattatttgctttcctatatgctagcaatgaaaaaaattggaatttgaaatttcaaatgcaatgctatttacatgagtacccccaaaatgaaatatgtaggcataaagtaaacaaaatatgtacaagatctatatgaggaaaacttcaaaactttgatgaaagaaatcaaagaaaacctaaataaatcgatagatatttcatgtgcaaggatagcaagactcagtattgttaagacgttaatactccccttcttgatctatagattcaacacaattccaatcaaaattctagcaggttattttgtggatatcaacacatttattctaaagcttacatgaagaggcaaaagactcagagtagtcaaaatgctgaagaatgacaactcagaggactgacactacccaactttaagacttactatccagctaaataattgagataacatggcattagtgaaagaacaggcagattgatcagtggttccaaagagtgagcccagaaattgacctaggcaaatatagtcagctgagctttgacaaagaagcaaaggcaattaaatgaaggaatatagtctcttcaacaagtggtgcttaaaaactgaacatccatgtacaaaaaaaaaaagaatctaagctcagactttacacccttctcaaaaattaaaactcaaaatggatcaaagatctaaatgtagaatgcagaatcacaaaggacagaaaaccaaacaccgcatgttctcactcataggtgggaattgaacaatgagaacgcttggacaccagggacggggaacatcacacaccggggcctgtcatggggtggggggatgggggagagatagcattagcagagatgcctaatgtaaatgacgagttaatgggtgcagcaaaccaacatggcacatgtatacatatgtaacaaacctgcacattgtgcacatgtaccctagaacttaaagtataataataatttaaaaaaatctagaagatcaaaggagaaaatccaggtggccttgggtttggtgatgtgttttcagatacagctaagggcaggtgcagtggcttacacctgtaatcccagcactttgggaagccgaggcgggcagatagctagaactcaggagtttgaggccagcctgggcaacatggtgaaacctcatctctaccaaaaatacaaaaaattagcaggtgtggtggtacgcatctgtggtgccagctacttgggaggctaatgggggagcattgcttgagcctgggaggcagaggttgcagtgagctgagattgtgccatggcactctagcctgtgtgacagagtgagactccatctctaaataaataaataagacacaaccaaaagcacaatgcatgaaagaaaaaaattggtaagttggactttattaaagttaaaaactgttatgagaatgaagatgggagcaagagatggggaaaatatttccaaaatacatatttaataaaggacttgtatccaaaatatacaagtcttttaaaactcaacaataagaaaatgagcaacatgattaaaaaataccaaaagaggccgggcgcggtagctcacgcctgtaatcccagcactttgggagactgaggtgggcagatcacaaggtcaggagttcgagaccagcctggccaatatggtgaaaccccatctctactaaaaatacaaaaattagccaggcatggtggggcatgcctgtcatcccagctacttgggaggctgaggcagaagaattgcttgaacccaggaggcagaggttgcagatcgcaccactgcagtccagcctggtcaacatagtgagactccatcaaaaaaaaaaagaagaaagaaagaaagaaagaaagaaagaaagaaagagagagagagagagagagagagaagagaagagaagagaagagaagagaagagaagagaagagaagagaagagaagagaagagaagagaagagaagagaagagaagggaagagctacttgggctgaactaggacggtcgcttgagcctgggagtttgaggctgcaagggagccttgattgcaccactgggtgacagaatgagaactggtctcaaaaaaaaaaaaaagaaaaaaaagagaaatgagctatcaaacaatgaaaagacatagaggatatccaaatgcatattgctaggggaaagaagccagtctgaaaaggttatatatagtacagatccaactatataacattctggaaaaggcaaaactatagagatggtagaaagatcaggggttgccagaaattttgggggagggggatagatgagtgaagtacaggggatttttagggtggcaagattattctatatgaaattgtaaaggcggatacctttatgcatttgtcaaaactcagagaattgtacaacagagtgaaccttaatgtgaagtatagacgatagttatttataatgtgtcaataatggttcattcattttaacatatgtaccaccacaatccaagacgttaacaatagaggaaacaggcagggaagtggggtgagcagatggaattctgtaccacatgctggactggtctgtaaatctaaaactggactaaaatatgaagcatttgactgcttaaaatactcagctgatgagctcaacaatagaatggaggtaacaagaaaagaattggtaaactcgaagatagagcaatatgaacaatggagagaaaacaggctgtaaaaacgaacttcaggacctgtgggatccacatggaatacctgacattcctgccattgcagtcacagaaggagagtacaaagaggtggtcctcgaaacatatttgaagaaatcatgaccaaaaacttaccaactctggcaaaagacaaagctatagacttaagaagcttagcttagtgaccaccaaacaggatgaacacaaagacattccaagggacatcatagttgaacttctgtaaacttaaaggcaaataaaaagtcttgaaagctgtgagaaagaaatgacacctcatctataaagggaaaacatcacaagtgacaatagatttctcatatggaactctgaaggccagaaggaagtggcacatttttccccttattgaaagaaaaaaaaccccatcaaacaaaaatgccctgcaagaatggacaaatgggcattctcagatgaaggaaaactaagagaatttgtcgctaacaaacgctctcttaagagtggctaagcaggccgggtggtggctcatgccggtaatcccagcactttgggaggccgaggagggaggattgctggagcccaggagttcaagaccagcctgggcgatgtagcaagaccccatctctactattaagaaaaaagaaaattagctgggcggtggtggaccgcacctgtggtccaaactactcaggaggcttaagtgggagaatcacttgagcccaggagtttgaagctgcagtgagccgagatctcattactgcactccagcctgggcagcagagcgagatcctatctcaaagggaaaaaaaagaaaaaaacaacaaacaatggctaagcacagtcggccgggaccagagaatctggcttcctaaaccaagaaggcgggccagcccaggacaggcggtggggaagaggcgctgcccaggcaggcgtctcccagcagggccgcctgcgggcgtccatcctctgcgaggccctttgccggccaatcgcgtgctgtggggaccacagaagtccctctctgcttgagtgagtgaacgctaccagcaactggtctccgtcctccaaagctgagatgagagcctcacagcaaaagcagcagcgttagcccgtacatttatttaacggaagagttatttatagcaatgcaccaaaaacaagcaggttggtactttttttttttttttttttttttttttttttttttttttttttaggtggagtcttgttctgtcgccaggctggagtgcagtggcgcgatctcagctcactgcaacctccgcctcccaggttcaagcgattctcctgcctcagcctcccaagtagctgggactacaggcgcccgccaccgtacctggctaattttttgtattttcagtagagacgtggtttcgccatgttggccaagatggtctcgatctcttgacctcatgatccacccacctccgcctcccaaagtgctgggattacaggacgctgcaggttcaaggccaaggcactggccagccttacgcccgcgagctggacccggcccagtccttgttagtcctcagctccttccccgcctcaggaaagtcgcgtcctggtcaggaggacctgccgactggtctgcgcccagctgcaggttggtcctttctgctgctgttgttgctgcggtctcacccagagttgcctctcctcgcccctgacagagcaggggcatctccatcttgtacaagcaccgccatcttaaagttccccttgatcaaaaactgcctaaatctaaaggtcatcagcctgatggctacggtcagcatgaccataaaccacaaatgacatctctgaccagaaacattgcaaccctaagataaacccctctccgaccagagacatgccagccctgagataacatcccctcccgcgggagacattccaaccctgccataaacttctcccccacacagaaacacttcaaatctgtgataagctctctcaccctaaaacactcctagtctgtaagacagaatgctcctgacagaaataggctagaagcccctcaggtttattctccaaaataaacctgtctttgactgttgagccacttttcatgtttctttcctttctttaactcttacagccccctcgccctaaggacacagtgtgggctgttgcaggtcctcctgaccaggacgcgacttccctgaggcggaggaggagctgaggacgaacaaggactgggctgggtccagctggtgggcgtagggctggccagtgccttggcctttaacctgcagcgtcctgggtctctttggcccagccagtcgtgaggactgtggcccaggatgctgccgaacagtgagggtgcccattgtggactggaatccagctagctattcctcattcgagaccccatagaaccccacaaacatgattggggttgacatggattttgaatattaaagttacatgagatttctgaacttgagtgtcatggagcaaatttcaaacgtggtgtgtgtgtgtgtgtttgtgtcacacttaagagacaaattacaagacaggacaccgagtccttcacccgcctgcagtccagccttgcaagccgtgggggcatggccttccactgggggcgtggcctcctggcgcgggcgtggcagggcagcacagcctggctgaggaaagcacaaatcctgctctgcaactgctggctccgtggccttgggaagtcagcaccaactccccagggtttttgaggaggtggtgtgacttagtgactgcaaatgcaaggcgtgccttgccttccactgaacatgcgcagtgttggcgctgttttactgttttcttcattgcttgcacttttgactttcactttctgctgtacccattcccaggcccaggattgggttcctccccacccctttcgttactccctgaggaaccagctctgaactgtggatccctggagtcccacatggagcccctcctcaagtgtaccatgatggccccacctcaggacccacacacacaggtggctgagaaacagggcaacatgcagagggaaaaccaggcaccacgttccgggattcaaaggcaaatttgacccaagcagttcttcatccagcaaggcattaggctgaaacccctgtctgcttctccgcagctaatctttccaggcttccctgctgatttcaggatccaaacctcctctcttaagggctctcaccactcccccagggacagtgccctctgccacaccaggtcccctctcctggccttccttcctgacatgggctttcccctctcccaggaagcccctcatgctcacctgatgtgattcactgaatcaccccagggcctcacacactgcccactccataaacatgtgacctgaagtgggtttattacttacagattggctgtgagggacaatagaagcctaggtttcaggacaagccagtcctccaagcctcaggaaagctgtccagagtggatggactctcatctgtttgctccacttgtaccacaactaagagaccctgcagagcagctggcgctgggtgttatactcaagggtagtgggaattgctgggctaaagcattggagaacactctgtttctagagggaacaagaacagagcctgggctgttttggtcagttcctccttatctcaggatgttgcattttcagcacattctatagttattctcgagaactataagtaaaaaagtgggggccgagcatggtggctcacgcctgtaatcccagcattttgggaggctgaggcaggtggatcacatgaggtcaggagtttgaggccaacctggccaacatggctaaaccccatctctactacaaatacaaaaaaattaaccagacgtggtggcaggtgcctgtaatcccagctactgtggaggctgaggaaggagaattgctagaaccctgggggcggaggttgcagtgagccgagatcacaccactgcactccagcctgggcaacagagtgagattccattcaaaacgaaaaaaaagaaaaaaaggtggggagaactgcattggcccaagccacccaaagaactgtcctgcaagcagcattaagctggtttctgttacatccaaggagtggctcttatcggctcttggtcatggtctgtgtcatgcagcaggatttggtgagccacagttataggcaaaagccatgtctccaggatgaaccacatgggtaccatgttcatagcagccaggacactggaaaccaggaacttgtagacctcttattgatggcagtggtggcctgtctgaagtggctgctgccatcacactggctgtggcaaggaggtgcagccagggctgcacattctgtggaaccagcagcagctggagacaaatgggagccccactcattcagagttggtggggtgggagctccctggatgcagccgcagccacccaactcttggctatggacccagccctcctgctccatggagcaagaaggagccacacccactctgggcacagctgtagctgcccaagttgtggctgcagacccaggcatccttgcacccttgggggccagggaaggcccccccttgcgggcttgaaaatgcctgctcccactgcctggcttctccttgctgttggcaccccctccaatctcagagcaaagtccagctaagcctgggtgctgtcacagcctagctgggtgtgcacctgcttggggcagtactgacacaccagcccgctgccacctcagcaccctccagactttaggcactgatgagcataggagggaagctgatgggggcctgagggcagcttggcgctgacctgcaggcaccccttggcacctacagccttggcgccatgagaagcagcaggaggcagacaggttatagggtgggggggcgggcaggtccctggtgaggccccaccttcaggtcagggatgtcctgaaggctggtggccaggacggcagtcccatggaccatagtgggaaattgtgatgtcttttccagcccacctgtggcggtccatggaccaatcagggtggcatttcctctcctctgaggcccataaaagccccaggctcagccagagctgagtagacatcaggacaactagctacagagaggagccacccacttcagggcctcctgtctgctgaacactcaacatgatgaccagctgcagggaggagctacccattccggtgcttcctctgagctattctgtcactcaataaagcacctcttcaccttgctcattcttcacttgtctgtgtacctcattcttcctggatgcgggacaagaactcaggacttgctgaatagcagggctgaaagagttataacacaaacagtgctgatacatgtcccttgctccccatgttgcagatgaagggaaggagagaagagctgcagcccttcagggagcccagacctgggagctccccaggccagggctttgactccctctttggggccttgtggttcctggaatcttcaagcttctgggcaccactgtgttccctggtggcagctgtggaagctgcttgcagtgtccctagttcagccacagcttcacagagagctggtgcccatgccggcacttggaactgcccatcccactgcagcagccggcatgcttgactgtgcagtgaccagaccccatgctcacttgctcacacacccctcactactccatgcctggcttacccttggcaggcctgggatccaggctggtggcgtgagctgagtgcagcctgccaggccaagtgagtggaatgagctgagtgagtggaacaagcccattggtcctgaacaaatattgggcaatggctccaccctccacagaggtttctggccagaaaagtgaaaccccaaggatcctgaaacattattggttctcagtgaggggtcccaggaccaggagcaacagcctcactggggaacttgttgaaatacaaattcccagcaccaagccaagcactctgaatcagaaacctgagtggagctggcaatctatgttttaacgagccttccagaatcgatgcataccagcgtttgagacctaaaggggtgcctagacaccctgggcagctttcctgagccttgggagtgccatccactgattgactggggccatcagcccctctactcttgcctcctcatatccacctccagcctgtttctgaaactgtttccaagaggcttgtcctgagtttacagcaaggcttgtccttctgtcttctcccatccctggaactgctcctcgtcagttcttttcctgctgtggaagccctgggatatggagacactcctgtccttcatgcagagcatctagatgccgctgcagggggtgagaccacacagactgctgcactctgttctgcgtgcccctgaccgactgcagcttcatcatcataagctcaggacaaggtggtcacactgaccagacctggcccagcactcatcctagtgagccacttcccaccctggtggcttctctgctgggcgaatggcctgcaagtgacctgactgcatcccatttcccagtggctgcccccctgagcctggaaaacagggaatgtggaggaagctgcccatcccacccacaggccctctggcttggacagcagctcctttctccacaggagcctcctgaagacttcaaaagcagactctggaaaagcatatgtaatcttggccttagtggggtttcctgggtccaaaaatatgtgaaattggatctgatatggtttggctgtgtcccctcccaaatctcatcttgaattgtagctcccataattcccatgtgttgtaggagggacctggtgggagataattgaatcatgggggtggttccccccatacagttcttatggtagtgaataagtttcacaagttctgatggttttataaggggaaacctcttttgcttggctctcattctttcttccctgccatcatgtaagatgtgacttgctcctccttgccttctgccatgattgtgaggcttctgcagccatgtggaactgtgagtcaattaagcctctttcctttataattacccagtctcaggtatgtttttattcgcagtgtgagaacagactaatactgatgtgagcgaaagcaaaaaaaaaattcatttttctgaacatgcatcaaattatccaagaaatctacaagttcagataagctacaaaccctttcttgaaggagacccttagcaacctcttgaagtttcctggatgtaaatgggagataacaatccataattattaagggaaggagatgtgggcaaaaaatgtaaaatgacaactcactgactacaaaatgcataacttaaaaacatgaaaacaattcaacttcatgaggaaaaaagtgcaaactaaggaagggctgggccatcctgggttagagccagcaggtggtaaattgcagaatcttttcacttaaatacagtctgtaagtgacttcattttgaccaaatatatatatatacatttagatacacatccagaggccagataaatagcttctcagctctcggagatgtttagactctgagccccctttcatctgtgaagttcacttccaccccctcagccttcagaggaaagctgcctctccctcctctgaatgatttcattctgtctcccacctgtcactcttagtgatccttcttctaggtctgtccccatcagaacctaagtttccagcatcagtgccacttcctcctcaaagctgcctcactcctcagtgcctggtctggttccgagaaccactcgtgaagtttaacaaaatccttgtgtgcacacctgaaatttagccagtggctgcactgatggcaggtgttttgactttaataaagtcacaacacactgcgttcctctcggacctcattgtcaaacgggctacacaaaactgacctcacaggtggttgtgagaaatggaagaatgcatgtagtagtggtcacttgtatcattatagtcattgccaggtgctttcaaagtttctatttcctgatgcagagatatgagctggcccctttaccactggattgctgtatggccttggcccattctccctgctctcttcgcatcaggctttctatctgtaatatgggtgtttgactaatgcgcagtatcctttgaaacagactctgatttcccttcatattccctgcttcactttccaagaggaagagggaaggggccctctcaccctgactctggcctttaggatgtcacaaggtactctggactgtttgtaaaccacccccaacctatacatatgctaaagcttaatgagatggaattaggaggtggggcctgtgggaggtgattaggtcataagggtagagccttcatgaatgggattagtaccctcataatgggctgaagagaaaagggcttcctcatctaccatgggaggaaaaatctagaagctgccatctataaggaagcagccctcaggagatgtggaatctgccagtgccttgatcttggacttccagcctccagaaatgtgagaaataaatgtctgttgtttataagccacagaaatttatggtattttgttagagcagccccaatggaataagagacaaggtaggtggagtttgggttcacctacctccagacactgcctttggatgagggctcctgcccctcccacttgaatcaatccctcctcaaggagggcattttacctgacacctccaatcagcccccaagtgaggctccctccctgcagaaatccctgacctggctctgatgaaccctttcctttcaaaaccaaacagcaggagaacagggcctttgatgggtctcgacagagccccctgagcagtgtgccagtgccaccgctgctatacagagctcctacctatggccaaagggccccacattcactcactaaccaaagttcccttttctaagatcccttcgtcctttctaactcccagagaccatgggaacccctacacgttgcccagcaatctcctttcttgatctctcacaaaccccacctgctaccaaactccccttcagggaccgttgctcggacctggtttccacgggctacttctccctgatgctctgccccctacaacctgctgtcagaaaaccttccatcctctgcctccatttctgccacgtctgattaatacccttgccctgtcattctttttctcaacacgaatgtccacccaatgcatgcttctcctaaacattctgccaatttcttgtttctgccagcctcattcccattccaaggatttccctggttagttacgtgatgccctcagctcccaccagacctctcacccagaccctgcctcccaccagctcaccctggtgggagctcagccactgggagctcattcagttggcttctggcctttttgacacaccaatatccttcagtttgtagcaattccttactttctggcactgcaagatgcttcaggctcctcttacatatttcctaccctagccctagactcagccatttctccaaggagctttggttccttttattggggaatggttttagaaaccgagatctgggagctcagtgtgcacactaatgctaggatgtcattgcttttgggcatactaggcaaacagagctaagacacacacacacacacacacacaattttgactctaatccagtaccacaatgttcattctagcttgctcactgtgacttctctctccaacagtgagaaatctggctctcactatccatgactcatttattcaaccttaatatgcaggtaaagccatctctgacttgttagtgcatatcccttggagaaacaaatttaccaactatagtacaatgtttgtggacaattccttttatccttagcctttcagtttctagtcataatatcactttccaaagttacttaggccagtttgttttttctccacatgctccagtgacattatgtcatacatttatagttcagttaggtcatttgttacaagctgcattccatcctgggattctccagacatcttggttaatttttaaatttctcatacattaaagatcccccttcctcatgtatggttctatgggtttgatcaggatacagtcatgtaagcacttcctcagtatgatacagaacagttccatctccttaaaattctctcgtgcatcctctatgtagttaatctgtccttttcctcagcccctggcaactgccaatctgttttccatccctacagtttttcattttctggaatgtaatataaacagaacctttggggatggcttttcactagcaaaatgcatttaaaatccatccatgttatagtgtgaatcaatagctcacttccttttattgccaaatgattttcattgtatggataccacagtgtgttcatccattcatctgcttaaagatatcttagtgacttcactttggggtagttatgaataaagctgctatacatatttttgtatggacaaaagtttcaaatcagttggctaaatagctaggagcacagtttgccacattaaagctcagtaaattgttacaaagtaaacacactcatcagctagcacaagcaacagaacagccctcacccagtcgtacattccctcctccacaaaagtcacaattatcttcacttctgttgccacacgttaattttgcctgggttcaagctttgaatggatcatctggtatgttcttctttgtgtctggcttctttcgctaagtatcctctgtgttggtgcatgtggtggttattttcattgttctatatccttccattgcaaatatatattacagttttgtctttaggtttttgctggtggatgtctgggtttttcccggtttggataatgctatgaacattccttttttatttttagacggagtcttgttctgttgccaggctgtagtgcggtggcgcaatctcggctcactgcaacctctgcctcccaggttcaagcgatcctcctgccttggcctctcgagtagctgggactacaggtgtgtgctaccaagcccagctaattttttgtatttttagtagagatggggtttcatcatgttggccaggatggtctcgatctcttgacctcgtgatctgccctccttggccacccaaagtgctgggattacaggcgtgagccaccacgcccagccaaacattcctatgtgcctttctgtatctacttctgttgctggctcataggtaagtgcatgctcagtaataatagacatgctgaaccatttccaaagcatttctaccaatttagattaccaatggtgccttatgttttaacaggagccctctggctgcttcattgaaaactgactgtttaagggcaaaggtgggagcagggaggccaagggaaaggtttcgcagtcatccatgtgtgactgcatggggcacagcccaaaggggtagcagtggaagtagtgacaagtggttggattctggttgtacttcaaaggtagagtcaacaggaattttctgatggattggaaatggaggatagaaaaagcgaatagacaaaggtgtgtgggaggcattttgactaatcatctttatggatggaattgccatcaactgagattataagactgctgatggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactagggaggctgaggcaggagaatggtgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaaagactgctgagcagttggtttgagagggaagatcctgagttctgtttggcacatcactttggaaatgtctattaaatatccaaatggatatgtcatggaggcagctggagttcaggttagaggtctgagtcattgataaaactttgggagttgttggcaaatgatagtgtattggtcagagtctaattaggaaagagaagctacacagtcatttgaacaggaaacatgtatataaagaagtgttaattgcaacagggaagtggagtaaccaggcacagactagtaggaagtataggaggagcaaccactagcctagggctgaggtagagagcccaggagagtcctctcctcctagtgcactgcccctacacctcatcagaggaacccagctatggccctctgcatgtcaggagagtcactggtgctataccactggaacttactagaaatacttctttaggtgctggggaaaggagcggtgtctcaaaagagttactctataacaaaactgcctggagctggtgaggggagtgggacctgctgggcactggccactgtgtttctggagaagtcacccacctgcaggagccaggccagggagcataggagaaccaggaacaaagactgctttcgcccacaaagtctctccattgctctctactgacaaaacctaacataatgtcagaggaaaatatttaaatggcccagttccatttttgcagagcaggcaatgaagaatgagtttgtagcagagatgcaataaattgataactgtattagtccgttctctcactgctatgaagaagtacctgagactaggcaatttataagaaaagaggtttaattggctcacgattctgcaggctgtacaggaagcatgacagcttctgcggaggcctcaggaaactttcaatcatggtggaaggtgaaggagaagcaggcatgtcttacatggctggagcaggaaaaggtggtggggggaggtgctacacactttttaacaaccagatcttgtgagaactctatcatgagaacagcactagatgaatggtgctaaacctttcatgaagactctgctcccatgatccaatcacctcccaccaggccccacctccaacattggggattacaattccacacgaaatttgggcagggacagacccaaaacatatcaataactgatacagatggcatataaaactgagacagaattagatcatccagggaataagtatagacacagaagaaaagaaaactgaagcccgaaacctatggcctcactctaatttaaacaggtgagagcaggggaaccagcaaaagcagctgagaaagagcatccagggctgcaggtggagtcctgtgagacaagtgaatcaaagtgaataggagaggggccagagtatgtattgactgttcttttgtgaagttttgctgcaaaggggaacatagaaaaggtgcaggtcctggtataggaaatagggtcgagtaatttctttgttttgaagatgagagaaatagctgcatgttatgtgacgatgagaagagtccagtagaaaggaaaatattgctgatgttgcagagaggataggctggctggagtgacaccctggagcagtaagagatgatgggatccagcagtccagtgcaggattctttgggtggacctagcagttgttcatccacagtcacagggaggcaataagaggcggatgggtggaggtggacgtgggagtctgtggaagacttttaccacttctattctcttagcaaagcaggaggcaaggaagggagaggcagtgggaaggattgaacagagaggaggaagtgcgaaatactcacttggaacaatgggagattgaatagaccaggcaaagaatgattaaagtgaggacggctggcatggtcctgttttcctccagccatgtttagttgcatcgtcgtggcatggaatagatggagagctgggtttatccagggctcccatcttaccaagcagataggagatgacagggaggtgcatgagttgaggaggtgtgcaagggatcaatgagaatggttggccattgagtttaagctggctcactagagagggtcataaaggaagaaacagtgaacaagtagtaagatcttgattggaggtgctggtaaggttgcaggagttttgtttcagggcagtatagggagtgacctggacagataggaggatagatagacctggtcagagtgggatactgtgggggttgcagtccttggacctgacaaggtctaaggtctgatcatggagggagggggaagctgaggtagggcagaggacaggagtgggcttcatgagaccaaaaggatgttggaaggattatctacctggatactgaaatcttcaagaagtaagaggtgtagtgtgaagaagttacaacactctaagctcttcagggataagggaagcatgtgccacgtgggtagcctcccaagtccagcacccagtatctagaatatgcagagtgaatacctgggggctgctgagggcaagaacaaggtgcctgtgagaagacctgacgcctggggttctcgtgacaggagtgggcctagtttttggtgtagaattgagccttgaatgcaccagcgggatcatattgaaaagaaaccctccaagactaaaggaagatgcatcctctgacaatgtacgctctgtaggctcccaagtagctgggctggggattagatggactccaaggcatttcctcaggtggcaatgggcggatccctgggaaggtaaagctgtgcagtaagaaaacggcaagatgctacgttcactcaggtaaagcccctttcccgggtttagggagggcgaggcagtttaggctgggtcagtttgtccctgccctcacggtttgttggtcctggcaaaagagggccttatgttatttatttttcttagagacagtgtcttgctctgttgcccaggctgaagtccagtggctcatctcagttcactgcagactccgcctcctgggatcaagcgatcctcccacctcagcctccagagtagctgggaccacaagcaccacaggcgcccggcacgatgccggctaattttttttttttttttttttaagagagagaggtaggctccctatgttgcccaggcttgtcttgaattcctgggctcaagcaatcctccctcctcggcttcccaaagtgtagggattacaggcgtgagccactgcgccctgccaaaagagggctttagggcaccccagaacgcgagatccccctcatctgtaatctttaaagaggaggaagtgtactccaaatcaagcgatagtccatccgtccttggcacggtgactgccgggaggccaggaccaaatgtgtctccttccggcttttgcaccacactaactaaccggcgccaggccgcagagccgccctggccttcggcgagaactcaggcgagcgcggcgcacgctgctccggagtcccaccgcggaagttgaggccgcggattccgagggcggggtggagaggaatctggaaggacctggacccggtggaacgcactgcgcggacggcgcctgcgtccgcactcagctgttcagccctctttcttcaggctctcccctgaaagccgtccccatgccggtctcttttttctgccttcttgtttccctccggcgagtcagcgcgactgtgaatttccgtttccggcggtgtccatgctgacctgaggagtcgcggctgcgagcaggttcggtgctgcgggttggggtaggcggcggtggggtccctggttctggggcactgggaagatcgcgagtcgtgcgtgtgggaaggtcctcccccggtcctccgggtcatctttgctcccgaggagcggcatatttctcatctggcggaggtgtcctggggtagttgggtgagtgacgtgatgaatccctgcagagagcccagacggggagggaaggtggctgggcgacgtcgtttcctggcgacgtggtcccggtaggagacttagacctgagctggatctgttgaccccaaattgtgcttttcccaccaagaagaaagacagggagagaaacattagtacaagtgctgaactaaaatatagcagagaagaaacataatctctgaaatcacacagctattcggtttcaaagcgttcctagcgcccagctctcctaactcctggccagtgttcttgacattatggtaatacataaagactttgtttccgctggtgtgtgtctgtgggaagcctctgactcacctccgtgctccagtagcaccctgtgcagccttccaatgtcgcccttattgcgtggcgcggaagataatagtttggatttcctctgcaagtcagataatagctgtatccacttactggcacagtgcctagcacatcgtagacagacacaaatatttattcaacggaatgaatacagtaccttaattgaatgaaatggcatcctgctccgctttttttttttaatcaagctgtcagattttatgcagcccgatttcctaaaataactcactaattcagtgattgccaatttattagccacagattcccaggtaactcagaaatcactggaagggtctctgtaagttcatggggtctccaggtgtcatctagaaccagtcctatctcacacgtacagctatttctatttttcaaatgtatgtagataagttgtaatttaggagttttacagagtcaacaggtactaaaagtaatactgcgatcatattggaggttcataaaaacgtttcacatttttttattaaaatttaagttttagtttaagttaggaaaccacttcatcagtccagttgatacctgggtctgagctgtccagtatggtagccacatgtgactatttggagttagaatgaaattaattaaaaactcattttttcagtttccctaagtatattgtaagtaaccacatgtggctaatggctaaatggctgaaaagtacagatatagtatatttctatccttgcagaaatagatactgctgatgttgacacttaagatgaataaaaagtaacttaaccataaaatgtaatcttaagagaggtaactcatctaatttatagcataacagagagaaatgaaattggggatggttaagcagtttctacccttgttcagtgaacaaatacatcatctcttcataaagaaataaatgaaatttactgtttttccctgggtattgcctggattgtaaaatgcttctcccatctccttaccccaaccttcttccttgtaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggtatgttaggctacggtctggtcattcttccattgattctttttttaaatagtaggagcctctcacaggtgacatttggattcacgagtctagtccagctccaaaggacatggagattcatggtgtgtggctttcactaaaacgtgagaagcttttcccatagaagctgccttgcctccagcatctgcatactggttagtgtttattgcccaggatacaagaatttatagactttgtttgttcctaaattttaaactgtttctatggtgataagtgtgctttttccccccaggtatgttttacatagttgtaatataaaatacaaaaattacaatatttaatactaacatagctttatttagtgagcccttgtgatatgcctagcagtgtactttaaacattattcaactaaatccttccagcagccttaccagagtaggaatcattcttgccctcattttatgggtaagaaaactgagatcaagaaaacaagttacctccaatcatataaccagtaagtaggagagctaaatgtaactccagcgcctctgctcttatctgctatgatgtactgcctcgctatttaccttttggttttttaaaaaactattaaaatcactcttaaaacagtcagatttaaggagtgtttaattttcgctctctatagtattgaagtcatcttgttacatctttattgaacagcaattatttggatggggccagaagttagcaagttaataattgacaagttaattatatttatatattgtctgttgtactctctataaaatgtgctaaagtactcatagctataagtgtaccaaaaaagtctacttataaggttgataccttttactctattttgaaaatgagtttactatttatttatttgtttattttttaatgaataggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaggagatgccaccacagacacagagttggcgtggctgttgtcatctgagggacatgcatgcgtttgttgttttcttgagtggaacatgttaaatattgtcatatcatgggacttctcttatacttagtattactaagttggctatagcttcagaaaagggtaagttcccagagataaggatgtgataatgttcacatttcctcccagcactctgggaggttccaaggcaggaagatactcgaacccagcactcgggctggaaaatcaagctttgctgctcgattgcgacaccagccacagtcctcttcctccgtgtagaaggatgtgtggtccagcctcttaaggtgatgctttccttttcttcctggtttcctcctccattttttgtatgagaaatgataatgttcactatgtcttatcctgactgctctttggctttgccaaacatgttccttggaagggcctagcaggcctagtcaccgtgaacacatcatttaacagatagcacgcacctcctatgtgccaggtgcatatgcttgccttatgaagccacattctggtggaagtgcgagttttctctttttcctgtgagaattgtctgctttgggagatggtgacctttccgagtttgagggaaaatgaaacaaacttccagtggtagaatggcaatgtacactctgaaatctcttgttattgcaataatatagttggattgaggcttttctttatctttggagcatccatattttcttttcccttttttgagacagagtcttactctgtggtacaggctggagtgcagtggtgtgattacggctcactgcagcctctacctcccaggttcaagcattcctcctaccttagcctcctgagtagtgtatgccaccacgcctggctaatttttcttttttttccttttttttttttttctgtagagatggggtttccccatatggcccaggctggtctcaaaactcctgggctcaagggatccgcctgccttggcctcccaagttgctgggactacaggcgagagctactgtgcccagcccatattttcttgactgttttatttttaccttaatttagaagtaattattgttatgaatattctgttgcattatgtttgaggatgtttgtagctctagtgggaatacgggaagttttgatagaggcaaagacattgggcctgcagctgaacagcaggatcatggttatcatggagtctgtgcagtcagaattttccctttttgagcacttttattcatctgggtagacttttgatgttatttaaatttagaacacagcaagaaaaacagaatggaatttattttattttatcagtttttgcctgtaaaaatgaacttcttgtatgctcctgtaaatgtatatgatgttttactggatgcagttaaaaaatgaaaattaagagttgatggttagagttttttcagggtctttttaaagtaaaattttcatcttttcacttataggtaaaaagcgcagactcaccattattgaatgtgggtgtgacattaacatgatgattgatctggctaaagtagcagatctggtaagtgagcaggggcagcctggggtgctgatggagacttacagcattgtgataggttatttaccccgtgatgaagggaagagagtcttataattattaaaagaatcatggtcatcatcagtgatacggtagatatgattgaattgatgataattatggtaataaatgttgttatgttaataataaaaatggaatgtgcacaatgaaatgtgttccaaaatctaaaagcaaatcacaggatggagaaaacctttaatgaacacaactaataagagctcattaatatgtatacatatatacgtacaaatatatcatagtaagtaccatttcttcttggactcttcctggcactgtgctaactgctttctacaaatttagcttacataaacccttgatacacccttgaggtgagtaggtattatctgtagtttacataagatgaaatagagcctgccagcagttaagtaacttgtgtgaagttgggacccttgttcctgatggttccagaaccttcatccttaatgataatgctgaagtaagtacatgaattgccctgaagaagtggtcagtttatcaataaaaagtctagacagtcctcagtgtatggaaaatgtaaatgctcttgcatttatggaaatgatagtgttcactattctgatagtctattaactatcttttaaattagcaaaaataaaatacaaattagcaaaaaaataagccatattgattaggaagtgtggggtgacagacaccttgattttttcatttttatttagttttttctagacacctgtttggtgacaaagagctacagattttatactttggcccaggaagactcctaaaatataaagtaaaaagtaatacagattttaaagttgtgccattgtaatgtcagaaaactaaataacattcaaattttgaacatgtaatgttaatattagtaaaaataagtgttattattaacgtagtgtaagcttactaaatcttgtatacttgaaatgattgaaatagttcatagaagtcatttgtttctcttttatttaaaatgtagcaagcttctaattttaaagacatacatattaagagatacctttacttttttttatttttaattattatggatacataatagttatacatatttatggggtacatgtggtattttgacagaagcatacaatgtgtgatgatcaaatcagggtaattaggatatccatcacctcaaacatttatcatttttttgtgttaggaacatttcaatttcattcttatagttattctgaattatataataaattatagtcaccctattgtgctgttgaacaccagaatttattctaactgtatttttgtacctgttaacctttccctctttgtccctccctccctgctccccttcccagcctcttaaccatcattgagagagatgcccattatgtaaatcttttaaagatttttcaaaaggaacacacacatttggtaaagtactctaactgtaatgcagggtgcacacaatgtgcattttctttttccttagtataaccgctggtctctcagatccctgcagagcagtatccttttagatacatataaacacacatgccaccctttaaaaacaaatggtagcttattttacacactgttctatgctttgcttttttcatataatgtattttggaggtatataatcagtaagtactgcagctctgtctcctttttaatataatattccattctatggaggcaccataatttatttagcctagcttatgttgactgctctgctgtgggttgccaaagcctcctgtgtacagcaaaggcacacacagtacgtggatttgggtgtgtacaggcgtgtgtagattaggggaataacactggcttagatgacaaagactggcagctgagggactgtttgctccctgttcttcctgaccctacaatcagctgcttgccccctggcactctgtggcatcaaatgtagtgtgaggatattccgcctgtcctttgagctggtccagtgttgctgaaaagctgtgcttgctgcctcagtccacagtagcagctgtgctttctcacaagcccaccttcatatattctgtggtttcggattttgaatgtttcctagtttaatcaaagatgggcatttctgtttccattttttttgttatttttagttatctatgcaaagataagaacagaaatgtttttaatacttaaactagaaatttccaggaatcaattctgaaattattttgcatctttgaagcatcttaaattttaaaaattggtctcatctgcttatattttcttatagactaccattcatcgtaatcttactgtttttttttttacctaattctaaactggtagctatttaaaaaaaatttctgagcaattgagttatccaaattaacatataagatagaggtttccactgcatacttctcaacaaaaaacagattgtggtttttttttctatgaggcgattgaaagaagaggttggttttctgtacatatttaatgtatttcattgattatgactctcttcccattctttggatgccagagacctgttatttggcttaaaaataccttacagaaaacttgatttctttaaattaggatttcttaggtaagggccaggttagacccagccttttctgagttacttctcatacattaaaattcttataatggaagtttatatcctagtggacattgtcttatgggttggcttttagagcaagtcagagggtggtggtttctctgtctgggtgatgcctgtgtagtcatttgatttagtctggagtgcaacttttccgtccagggccaggtagtagatatttttggctttgtggatcatatcttctgcagctacttagctctgcagttgtagtgcacaggcagccatagacaatatgtaaatgaattaatgtggctatgttccaataaaactttagttacaaacacaggtgatgggctggattttgcccgtggccagttgccaacccttagtgtaggtggtctgttttggtagtttctttgagaaattatgtgttctgcttttaggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccggtacgaagagaaataattgttggatactaacagtataatccttttaaaatagactgaagaggccgggtgcagtggctaacacctgtaatcccagcactttgcaaggcagaggcggtcggatcacttgagcctagagttttgagctcagggcaacatgaccaaaccccatctgtactaaaaatgcaaaaattagtccggtgtggtggcgtgcgcctgtaatcccagctactcaggaggctgagaagtgagaattgcttgaacctaggaggcagagggtgcagtgagctgagatcacgccactgcactccagcctgggtgacacagtgagacgcttgtctcaaaaaaaaaaaatactaaagagacattactaaacgtctctctaggattcgcctcctgaatttcctttgtgtgtgtattcacagtccctggcctcctgaattcctttgtgtgtgtgttcacagtctatggactgctgaattcctttgtgtatgtgttcagcctctggcctgctgaattcttttgtgtgtgtgttcacagtctctggcctgctgaattcctttgtgtgtgtgttcacagtctctggcctgctgaattccctttgtgtatgtgttcagtctttggcctgctgaattcctttgtgtgtgtgttcagttttctggaaggtttccctcaaaagagtgcttgtttggggcctcttggtgtatctcatttgtctctctctgtacctgctgcaccaggcagtgtctggctgttttggggtcaggacttaatagagtacctcggaagtttctcccagttacaggaccaggcactgccccttcctttctatactgctctggaccattggccacagaaccgtttctgtgctcagacgcctcacctccctctcctcaccatacttagatggatgccccggctcggctgcagagcagtctgcctctgtggggttctaataaatcctgaaagaagccagcaaggctctggaagcctcaggacagtggctttgctggaagtctcccttcttaggattgcttcttgtttagagcttttattttgttgcagtattgatgataatttaattgaaatttaatttttaattttcctctaatgtttagggtgccaagctgttctacctttctggaatggtgcatggagaatatcaaaaccaagaaatccacaatctgggccgttttattacagttatgaagtttaggcctctcacatggcaaacttctcacccttatatcctggcagacaggtaaaatatgattttaagctttttcttcctgggccatatatttcaaagctaaaaaggctagaaaaagaacagtgataggatttattttgtgccgatttgaataggggggatagaagtgtagttgatggaaaatgtctacttatatcattgctcaaagatgccgtgcctttgggagtaaattaattatgagatgttaaggaaaatgggagaacttggaagtatttaaggctacaggatgtggccccatcctacgttcagcctcagttttcagtgatgctgccttcatgcccgggtgcttgagtccttcgtgtgtgccttctgtttccttcctttgtgctcttcctcgtgtggttttctcagcctggaattccctttttccacctgccagaatccaagccacagtaaaaatcccagagcacaggctcgccctcttccagaaagggattttctgaatatgttcttcactcttccccgaccccaggtggacgtcatctccctgtctggtgtcttatggaatgaatatcactttcagcctagagacacagttgtgtgtctgccccttttcctctggtggatggtgaatggtgcctccttatttctgcattttctagttttctaaatgacgtgcttaatggacaagagtgtgatgaatcattgacacatgaaaggaggtataggaacttttggcattcatttctgctgtgattgaatttatttttctaggatggaagatttgacaaacccagaggatatccgaacaaacatcaaatgtgaccggaaggtgtcactttatggttatttaagaggagcacacttgaaaaataaaagccaaattcacatgccaggtattctcttgttgtagaacatactagaattacacataggattcttgggatggcttcatttctcaggaaaactgaaaaatgaccaaacaagggaagatggccttgctggaggttttaaaagtaagccacctatgtgtaggcctgcaaaggtgttactgaatcccctcttctctgacctcttgtcttgtagctagggggccactgttccagtgtggcacaatgcccttctttagtgttatgggttaagcccttggactgtggatcatatttaaccccctagtcaatggtagatgcttctgacttcttgtcagctgaagctggcttttgggttctgtcttccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggtatcggtgagacgggagtcatttctctgaactttcagtattctttctgaatctattttttaatcacaaaaagtaatgtactcagcttttatttattgaagatttttctcttgtacttataataaaggcccaaatgcatattgtaaatatataggataaaaataatactttttttttcattgtaccaagcagaagagtcctctccttcattcctccttgatccatggccccagcacaggcattgctgctgtgtggcgcctgcacggcccatccccgtttctacaaaatcagtgtgctttccagctttcattggtctttttctcattcacaatggtctcctcatgctgtattttaaagtggatttcaaatatttatttctttgttctgaagtggaattttattgggttaaaatcggcttattttaaaatattagaaaagctagcattgttgtagctttggagctgaggtttttctagctaggttgtttaggttatcaggttatatactccctgaactttggaaaagtttaatggagatggggatccatttcaagctttgttgtaaggattttcttctctgctttttgaggcattaagaaaggttcttaggaaatgtgtctaagataattttgagaaactgagtgaagctcgtgtctctccaggatctttgtgctttcctcacgtgccctttcttggtggtcttgacaggatgaagtggggcccacccatgagctggtccagagtctcatctctacccactccaccattgatgccaagatggcttcaagtcgagtgacgctgttttctgattccaagccacttgggtcagaggatatagataatcaagggtaagtctgctttttttctatttttaataaaaagatgtattacaaaagatcatatcacccataattcagccatcataacacatttcggtgggattcattctatgttgttttgtttttctttgtgtgtgcatgtgtctctgagggctcttcacttacctgacattacaagggagtcttttcttgaaataaattgcaggatgcatttttcaacagaccccaaatattcctcaaataccatgccatcttccataggttgccttttgttttttaagagacctgaagccacttggctttcttttggtggccaaaacactagagcaaagtcagggagtttgtggctgtccagaagccacatgccttgtctctgaaagttttatttagattgtgttgtattatctcctctgggtaggtttccgtggatgtatggctcatgtgaattattttccagtctgggttggggatttgtatacctttatatgcagtggatgtttgcaaaacattggttttgttgtattgatttatgactcccagtaaaatttatctgaaaattttgagattatctagtatgtaatttggtacaatgtgcataaactacctagcagaatgcctgacaggtacgaagtgttcgccgaaagatcactcctttataatgggattactagctattttcacttttgcatatccttctagtcatctttgtctacaagaatactctcctctaatatagttacagttaaaatacataattttatttctatattatcatttccttctttttttttttattatactttaagttttagggtacatgtgcacaatgtgcaggttagttacatatgtatacatgtgccatgctggtgcgctgcacccactaacttgtcatctagcattaggtatatctcccaatgctatccctccccgctctgcccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgcggcaataaacatacgtttgcatgtgtctttatagcagcatgatttatagtcctttgtcatttccttcttctatacagtctttatgtagtcatcattttgttattattggtgtattcttttttttttgtgacaagatcttgctttgtctcccaggctggagtgcagtggtatgatcttggctcacttcagccttgaactcccaggctcaagtggtcctcctgcttcagccccccaagtagctgggactacaggagtgcgccaccactcctagctaatttttttttttttttctagagattaggtctcaccatgttgcccaggctggtctcaaactcctgggctcaagcaatcctcctgccttggcctcccaaagttctgggattacagatgtgagccactacccctggcctattattgctgtattctaacttacccgtctcttatggtatgattttcagttttttcaaatttatgttttcttaattttatatatcttgctacattaaatagcttcatacagttttcttttatcctgtgattttagcttcctgatgattcttctgtatcagttatagcactggtgacttaaaatggatgttcttcctctgtcattcctcctacgtttgttagctggcatttttaacaaagagctttctcttctcccctttatttcggtatcactgctgactaatgcacttgtgttttgttccatgggttattttccatcactatcattattcttcctgatgcctatgctggcccagatttggctgcaggagccttcagcctgtctcctgtgtcctttcaactgtctctgttagtctttgagcatttctcactttctgacagaacaagaggatccaggctcattttgccttctttctgctttgggcctggacttacccatttctcttaaggatcatgtgtttttagcttagaaattaatcagctttccaaaagatctacaaaacagtaacttctcttttgagcaatttttttctaaaattagatttttgttttttaagggttattcctttattctctctataagttcttttgaagtgtggtgttagggaaccatgcccgagtttgcttcttaactcttccaatgtttatcaaatcatattttccctatgctatgtcatcttaaacaattccttgacattttctatttctttgtattttcattgactatattgccatttctagattagctgattaatgtacaaattgaattattttgtatttccttggtaatacaggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtaagcttaaatgtagttggttgctgctatgaacttggctctcgaaatggtaaccaaaggaatgtctacatttaggggtctgttgattctgtgattttgttaactgttgaaaagctgcattgtggatggatctcaagggaggggagacacatgaataagcctaactggaggttggcattggtcgtttcaggtgccctcaagtggaaggaagacctttccagaaaggcagctgaggcctttctgaggcagcagcaagcagctccaaacctccgaaagcttatttatgggacaggtaaagaattctggttcagaactagaaatgttttagtttctctgattatttagatgagggaattggttggaggattcggctggtattgttgacatccataattgctgtccatcacatttcatatttgacagatgtctctaatcatcagcttatgaggaccacacattggtcttataaagtagacttatgggtttgctgtaaaacttgatgcaaataccgtccattgcatcatgttatgtcccctatttaaaagtccttcatgagaatttttttgtagattagtgccagaaaaatattcctgcccataaaaatatttatttttttcctttctgagaatgagaaccctgtataacacattttgttctcccttttgcccttgtcctctgattttatgctttactaaacttaccaatatgttctttctggtagaattaatgcaaaaataaatatatagtggtgaactttacattgtgctccctggttactgcatggtgagatcaaggccacatggtgagacatttgggctcagcccactgaattgggaaggttgttgtatactgattttcattcaggttttgtctaggtactcttagtgatgagaggctcaacactctttagagctcttctttaataatctaaagctctgcctttaaattcccttccctcccttcaccgctaatattctcactcctcggcctcttagctgctcccgtgcaggagcacaggagccccacacatgtagagcaatagcttcctggctctcttcatctgtggctgccctgccctctcaatgcctaactcttatgtggccattgccatacccaccacagacagagtccctcagttcctgagttcaaagactcatggcctaactggttgaaaatgatgagtcctctagggctgtaatttttgttctcacttttctgccatggtgtgctctttagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggtaagtctgggtagtacatttgatttattagagaattagcgaattgttctagaataagattatctgatgtcaatattgcttacctgttgttggcttcttatttttacaggattacaggtcattctcccagatattgtagtgggcgcttcatgcatcctaagcagtaacatgttctgagtttagttagaccatgtacatggcccacagaggacaggttcagctttcagtgtggacagtagtgtgcatctttattttgaaacatcacacataagtttttatacatcagatgtattttgtgtcttatcactaggatatatgtagcatccctgagttaacatttatagtttctgctatttgtaagcatagagaaatctgtgatacctgtatatgttcttcctgcagcttaccattttgtagtcacactggaattcattcagtactcaaactcaccacagcttaccctcctcttagacctcttctctttctctctctctctctttaagatatggtctttctctgcagcccaggctggagtgtagtggcacaagtgtatggctcaatgcagccacgacctcctgggctcaagggatcctcccacctcagcctccagagtagctgggactataggcacgagccaccaggcctggctaatttttgcattttttgtagagataatgtttcaccatgttgagctagtttcgaactctgggttcgaatgatcttcctgccttggaacttcccagagtgctgggattacaggagtgagccatcgcgccagcccctttctctctattctcttctggaatgttctgattttccaaaggctgctttctttttgtcaattcagtttggcttagatgtcacttctcacagaggcccaattgctatcatactgtctattgtaattcgccagataacacttaatgtactttatgagattttatttaaccatttttttatggtgaaatttaatacagatatataaaaccacgtaaaaacaattgttcagcctaatgggttgccagaaggtgaatatccctgtactcagcactcaggctgggaaatcaagctttgctgctcaattgtgacaccagccacagtccccttcctccctgtagaaggaggtgtagtccagcctcttaaggtgatgctttccttttcttcctggtttcctcctccatgcttccataagcatcatagtttacttttacttggtcttcattactgtttttcagtctatcttttaacatttttagtcaacagtctttccttcccatttctttctttggttacattttatttaataaaccaagtctttggtctgtagagtttcttgtattctggattttgtggattgctttgcatccctctggagtttcccaggccctcctgtatttcctgtgaatgggtatggagcaataccaatagaacttctgtaatgaaaggaatgtatatctgagctgtgggttgtggctacttgtggctactgagctctttaaatgtggctaatgagactggagaactaaattttaaatgttatttaatcttaattaagattaatttaaatagtcacatatttctagttaccctgtagacaaaacatctagcagttggatgggatttaaatttgatttttatttttcggcgaaactgcttcccaggtgatggtgttttctcattaggaggcgcataaagactggttgtgtccttttaatgctgttagatgttatcagttgttggtgctcaatgcctagaaccataccaatttcttaagaatgtagagtggtgatgttccattcaatcatttctctttatgtattagctgtaacacttctttaaagagaaacttttcctcttctattcggttatccactgccatatatatagggtaaatgcttgatttttttttttttttttttgagatggagtttcgctctgtcgcccaggctggagtgcagtggcacaatctcagctcactgcaagctctgcctcccgggttcatgccattctcctgcctcagcctcccgagtagctggtattacaggcgcccaccactaggcccagctaatttttttgcatttttagtagagatggggtttcaccacgttggtcaggctggtctcgaactcctgacctcctgagccacgtgcctcggcctcccaaagtgctgggattacaggtgtgagccactgcacccagcccatgcttgattttttaatcagtttgtggagtgattctccaaaggatacttgtttgtaagtttcactgtgatgtcatggatataaatgtagttgatgtgccttgtgctcctgcacctgttatcccttattgaagctcctctttatcccacctgtggcctgtaagagtctgtgcacaccagctcctgagtccttatgttacaatcatagtcattctttatcaattcttgctctatgatatgagagagcgcttggaatcacccataagaaatcctgatttcttttagtaggaaatggtatttcaacgtgacagcctaggcataggaatgctactgccatgagttggtcattacttctaggccttctcagtgacctgaaccaggagagctcatatagatatttccagttcacatacaggactacatcttactcattcttccactggagaattattccttggttgaatcagcagatgatgaaattagagaatcacataattactcatttgctttatcccatattacacacaaaatagtgtcagaataatatgactactgaaaacagttaaagatttttttcccttatatactgtctcatttctcttttcaaaagtgactgtgccattttacttacccactggcactgtaggtgggttccagtttcaccagttcttcaccagcacttgctattatctgtctttgtgattatagccatcctagagggggtgaagttgtatctcattgtagcattgacttgcattccctgatagataatgatgttgaacatcttttcatgtgcttattggctatttgtacatattcttcatattgtttgcccatttcaaaaattggattacttagttgtatgcgttgtttatatattctggatataagtcccttatcaggtacataatttgcagatatcttctcccatgttataggaattcagttttcaaacaggtttagattaacaaatagcaagaccaactttgtaaactactgtctcattgcattgccttagaaaccttaataaaattgaaaatcagttgaattagtaattatctgtttgtttacttatgaggtcagtagagtagtagtatttaatactttccctgtctgctgcttaatgtgttttatctctgtggttatactgtctccatcaaaggtaaagttattttctgggctcatttggaatgagaatatccatgaaagtgggaaatatttaaaggcaagttgtcacctactgccatttcttagagttgttttgctgagtgattggaacacctcacctaagtgctgacttttctgcgtaaggttatgaacagtatcagagattgcttcgtgactggaaagtgggaagatgataaagatgcagccaaggtcttagcagaagatggtaagtaaagagctgggttcttcaggaagactggcttctctaaactttattttcttcagtatcttagacaatagtcaaattgaaaataatagtcacttgtcaaatgctttgggaattcagacaggagtaatgaaccaggtaatattctgggttttccttttatgatgatcttattttctcagttggctgatttactgcgtatggactttaaaagtgagaaactttccataaattttaatcatgtgtttgttaaaaatagattttgtgtgatgtgaaaaatatatacaaataacatttatatttttttcataataaaggtagtatgcattgtggaaaatttcgaatgaaaagtacataacataccagaattctaccaacccataaaaaaacctttgttagcttcttcaactgtttccttctagtcatttaaaaattgtgtgtttaaacctttttagttgtactttatataatttttggcaggaggattgcttaagtgatgtactttttataaattttgtcattaaattttttcaaatatttcatttttattatttaaaattaaaaaatattttatttaaaataaataaaatattatttattattatcataccattattgaagtcacaattttttcaatatctaagtagttttatactttgttcattttataaagaactccacactgaacaactttgaaataattcttggctcacacttttttattttcataagacagattcataagtgttagaattgagtcatttttatggattgcaactgccacatggttttttggaaggtcattctttttgttttgtcttgagacaggatgtcgctctgttacccagactggagtgctatggtgtggtcatggcccactgcagcctcaacctcgcagactgaagcctcccgagtagctaggaccacaggcttgcatcactacacccagctaattttaaaatttttttgtacagacagtctttttatgtttcccaggctggtctcaaactcctaggcttaagagatactcctgcctcagcctcctgagtagcttgaaccacaaatgtataccaccatgcctggctaatttttaaatattttgtacagatgggggtcttgccatgttgcctagctggccttgaattcctgggcttaagcaatcttcccgccttagccttccaaagtgctgggattacaggcatgagccactgtgcctagtctgtagtatgtgaatgtattctttatatatatataatttttttttctgggccttctagttaatatcactgatctctgttggttcatttattattactataatttagtactctatgcagctttatcacgttactaagataccagttattaaaaccgtgtctcaacagtttccctttttgttctgctggggggcttcttttaggattctcctgactattctcaccttctcacttgcttattgttttttccataggaacttaagaatcggcttttctgttttcaaaagaaagtgtggtgggtttcttttttaatcacttcagtgaggtataattgatggtaaactacagtatttaaagtatacaatttgataagctttgatatgtgaatataccatcaccacaatcaaaataatgaacacatttgtcacccccacagttttcttacaccactttgtaactctccatcttgtcctcttccatcaccaggtacattcagctgccttgtgtcactattcagtaggttgtgccctttagaatttaattgaaatgggatcctacaatatgtactcttttctgtctaacttcttttactcagcatgattatttcaagattcatccatgctgttgcatcttcatttctttttgttggctagtgggtagtccattgtatgatgtatagcaatttatttatctgttaacctgttgataaacaattatttccaggttttggctattatgagtaaagctgctatgaatgttttttagaagtctttatgtgaaccaccgcttttatttcttttgggtaaataagtagttcagaatggactaaatgggtcatatgataggtacacatttaattttttaagaaattacccaactgttttccaaagtgtttataccattttccattgccaccataactttatgcaacttccggttgcttcactctacatctttcccagtacctgatagtatcagtctttttaaattgtaggccttcttttaggcatagagtggtatcttgtagttttagtgactaatggtatcgaacattttttcatgtgcttatttgccgtctgtgtcttctttgatgaaatatctgtccaaatcttttgtacattattttaattttgttgaattctaagaaattttgtgtatttttgatacaaattctgtatcacatgtgttatccaattatttttgcctagcgtgtgccttgtcttttctatttttaatagtgtttttcacagagcaaagtatttagttctggtgtaggtcaatttatcaaaaaaaaatttttttttttttgggatggagtcttgctctgtctcccagagtgcgatgtgatctcggctcactgcaacccctgccccctgggttcaagccattctcctgcctcagcctcctgagtaactgggattacaggcgcccgccaccacgcctgcctaatttttgtgtttttagtagagatggggtttcgccatgttggtcaggctggtcttgaactcctgacctcaggtgatccatccgcctcagcctcccaaagtgctgggattacaggcatgagccactgtgccctgcccaaaattttctcttatggactgtgcttttcatagtgcatgtaagaaatctttgcctcacccaatgtcacaaattgtctcatatattctgtaagtcttacagtttcaggttttacgtttaggtctataattctttttgagttaattttttatagagtgttgggtatggatttaggttccttttgacatattgatatctacttttccctgcaccatctgctgaaaatctatttttttccccgttgaattgccctgtattggttggccatatatgggtgaatatttctgggctctctgttctgttccattgatatatttgtttatttttgtaccaataccaacactgtctctgttacttacagctttataattagtcttggaattaagtagtttttaactttaggtagtttttcaaactttagtctccttttcaaagttgttttggttaatctaggttctttgcattttcatataaattttaagatgagcatgtcaattgctataaaaaagcccactgcaattttgattgggatttcatggaacttgtaaacaatttgggaaaattgccatcttaaccacattgagttttctgatctatgaacatagtaactctccatttatcttgttctttaatttctctcagcaaggttttcaggatacaggtcttatacaactctcaacagtttattttcatatcaacttgtatttatgtatggctaatatataagaaatgcagttgattttttttttaattgatcttatatcctgcaatcttgctaaattacttgttagttctgtttttgagacagagtctcgctctgtcacccaggctggagtgcagtggcttgatctcagctcactgcagcctctgccttccaggttcaagcaattctcatgccccagcctcgtgagtagctgagattacaggcagccattatcacgcctggctagtttttttatttttagtagaaatggggtttcaccaggttggccaggctagtctcaaactcctgacctcaagtgtgtgtttggaggggaggggtaaactttgactaaacagtattcatggttttctaagtaaatacttcttactatcccaaggattctttttcttttatgctgctttttctcctgttctgcacaataaagcctgggcttccaattctgctttgacctttcaccttggtccaatctcatatggttcccccagtttctgtgcaggatggttctgggagccaagcaggaaactatctacagaaaggctgagatagatcccagtggttttactttctttctttcctatctggatgacttaatttttcttgccttactgccctggtttaaacttccaggacagtgtggattagaagtcaaagtaaacaaccttgctttgtcctgattttgcttattttccaagtgaacttaagaatcacctttctggctgggcacagtggctgacgcctataatcctagcactttgggaggctgaggcgggcggatcacgaggtcaggagtttgagaccagcctggccaacatggtgaaaccccgtctctactaaaaatacaaaaattagccaagcgtggtggcacacgcccgtaatcctagctactcaggaggctgaggcaggagaattgcttgaacccggaaggcagaggttgcagtaagctgagatcgcgccactgtactccagcctgggcgacagcacgagactccgtctcaggaaaaaaaaaaaaaaaaaaaaaatcaccttttctatttccaaaagaaaagtttgtggtgtgttttttcctaattaaacttttaagtttgaggtaattgtagattgacatgcacgtgtaagaacaaatacagagaaaaaaaaagaacgaatacagagagatctcctgtatcttgtactatagcagtatctgtgtatatatgtactatgtatactatgtgtactgtaatacaaggtcacagcctggatgccaacattgatacaatctgttgatcctatgtagatttctccagtttcacttatgtgtgtgtgtgtgtgttttacgtgtgtgtgtgtctatacttctgtgctcttttatcacatgtgtaggtttgtgtgtctaccaacagttaagatacggagcagttccatcacaaggattgcttgtattgctgttttataaacacacccacgtccctgctgttccccagcccccagttccttcccttgtgaaccataatgtgttttctgtttctacaattttgtcatcttcaagaatgttaaataaacagaatcatacagtctataaacttttgtgaggggcttttttcactcagcataatttcctggagatccattcaagttggtgcatataccataggtcattcctttttattgctgagtagtgctccattgtatggatgtaccggtttgtttaaccattcatccaagatcaagctgggttgtttacagtttgttttgttttgttttgttttcagacagggtcttgctctgatgcccagtctggggtgcagtggtgtgatattggctcactgcagcctcgacctcctaggctcaagtgatcttcccacatcagcacccccaaggagctgggactacaggcatgcaccaccgtgcctggctaatatttttttatttgtttgtttgtttgttttgtagagacaggatcttgctgtgttgctcaggctgatcttgaactcctggcctgttttcaatttttgactattagaattgagctactatgaacacttgtatagaagtttttgtgtaaatatgcacttcccatttttctgggaaataaatgcccaataatgcaattgctgggtcatatggtaattgcacagtttcataggagactgccagagtagttgggccatttgatgtttctactagcaattatgtgagtgatccagtttctttacatccttgacaatgtgtggtgttctcactgttgtttattctagctattctaataggtatgtgatatttcattgtggttttaagatatacttccccagtggctaataatggtgagcattttttcatgtgtttatttgcatttttatatcttctatacagataaaaaatgtctggggatgtcttttttttgcacttttaaaaattgggttgggttgggtactgtgagttcattatatgtttaactccatcgtcggatgtgtgatttgcagatactttctcctaatctgtagttttcattttcttaacggggcctttcacagagcagaagtttttattttttatttatttatttatttatttattattattattatttgttttttgagacagagtctctctctgttgcccaggctggagtgcagtggcgcgatctccactcactgcaagctctgtcccccgggttcatgccattctcctgcctcagcctcccgagtagctgggactacaggcgcccaccaccacatccggctaatttttttgtatttttagtagagacggggtttcacagtgtttgccaggatggtctccatctcctgacctcgtgatccgccttacttggcctcccaaagtgctgggattacaggcgtgagccaccgtgtcgggccaaaagtttttatttttgatgaaatccgatttaccagttttttatagtattttttgttttctctttacacccatgatctattttgattttttcattttatgagatatgaggcttagctcaaggtttatattttcgcctgcaattgtataatttttctagcaccacttattttattgaattgcttttgacttttgtaaaacattagttgagcatctttctgtgaatctgtttctgggttctcttgtgttctattgacttcacatgtcaatcccttggccagtaccacccttgctgtctacgttcctgtagctttatagtgagtgttaatgttgagtagagtgactcctcttactttattcttgtttttcaagattggttaagctatcccaaggcttgtgactttccctataaattttagaataaacttgtttatgtctacaacaacttacctgggattttggtagggattgcattaaacctatagatcagtttggggggataatctttttctattttgagtattaaaatagatgaacacagtatatttatttattttagtttttatttctttcatcagtattatgattttcagcataccagttgggaatatgttttgataagtttagacctaagtatttgattttgattgattttcatttgtttctcttttgtcctgctaaactcacttattagttgtaggagggttttgttttgttttgtctttgtagattgcctgggattgtctacacagacagttgtgtagaaaacatagagacagtgttatttctttcttttcaacctgtatggcttttccttcttttttttttaattaaattttttaggggtagtgatggggtctcactatgttgctcaggctggtctcaaactcctgaatgccagtgatctgcctgcctcagcctcccagagtgctgggattataggcgtgagcgaccatgcctggccttctttctgttttaaaattttctgccttaattcagtgactagacttttagtacaatgtggagtaagagtgctgagagtggacttcctatgttgttcccaatcttgtcactgttatttatttactaacatgattggatgttgaattttgtctaatgccttttggtgtcagttgatatgatcatctggatatgggtttcattctttactcttttgatatagattacactgatccttttattttttgagacatggtcttcctctgtcacccaggctggagtgcagtggtgcgatcatggctcaccacagcatcgacctcctatgctccagtgatcctcctgcctccacctcccacgtagctgggactacaagtgtgtgctatcatgtctggctaattttttttttttttttttttttgtagagccaggtcttactgtgttgcccaggctggtcttggcttcaagggaactcttggcttcaagggatcctcccacttcagcctcccaagcgttaggtttacaggcaggagccaccgcacctggcctgattcattttttgaatgttgaagcagacttgcatacctggaataactctcacttgatcatgaatgaaaatgaaaatacaacatatggaaatgtgtgtgtttttttgttttgttttttcctttcatgtcagatggttaatgtgctaatgttgtaacaagggtcaagggtggcatatcccacatacatgcatgaatacccagtcatcacacttatgaactacgaaaagatcaccatgtgaaaatttttatacaaatctttttatgtgttgttggattccatttatagtactttgttgaggactttttgcattcatgagagatactggtctgtgagtttttttgttttgttttgttttttctttttgtggtggtactgtcttcatctggttttggcattgggataatactagcctcataaaatgagttgcaaagtgtcccctattctgttttctggaagagtttgtatagaattgggatgaattctttaaatatttggtgtaattctccagtgaaatcatctgggcctggagatttcttattccagaagctcttaattacaaattttatttctttaatggttataggacgattcagattatctatttcatcttgcctgaattttggtagtttatgattttcaaggtgtttcaagtcttgttagggaagtggaagttgcactgagtgccttcttgaagagaccagcttgggtagtctgagggtgatgtttagagtatttgcttaatactctttaacggctgcaggagcctttttgataacccctgttttattcgtgatgttgttggtttgtgtcttctctgtttttatctttgtcgtaaaatttattaattttgttgattctattcaaatgaccagctttttgtttcattgattttctctgtttttctgctttcaatgttattgatttctgccctttatttattattattattttttttttgagactgagtttcactcttcttgcccaggctggagtgcagtggcacgttcttggctccccgcaacctccacctccgggttcaagtgattctcctgcctcagcttcccaagtagctgggattacaggcatgcacccccacgcacagctaattttttgtatttttagtagagacagggtttctccctgttggtcaggctgttctcaagctcccaacctcagttgatccacctgccttggcctcccaaagtgctgggaatacaggcatgagccaccacatccggccaatttctgccccttattatttctattcttctgcttgtttggggtttattttgttctttttgaaatttcttaggttattggtttatcttttctcatttctaatgtgagcatttagtgtttaaatttccttctcagtactgctgagctgtaccccacaaatgttcacgtgttgtattttctttttcttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcacgtgttgtattttcattcatatttcctttgggacttctttttggcccatgcattatttataaatatgttgttttaattatcaagtatttagagagtttcctgtttttctgttatagatttctagcttgattatattatgttctgagaacatattcttatgagttgaattattttagatttgctgtgatttcttttattgccccaaatgtacttcatcttggtagatttctattgactttaaaaatgtgtgtattttgctgttggagagtagggtgttatacggatgtcagattttgctggctcactgttcagatcttttgtaaatccttgctccttttctgcctagtttcactctgtcacttacgctagagtgcggtggcatgaacatgactcactgcagccttgacctcctaggctcaagcagttatcctggcttaacctcctgaatagctggtactataggtgtgtgccgccacacttggctaaattcaaaattttttggagagacaaagccttgctatgttgcccaggctggaactcctggcctcaagctatcctttgtctttgcctcccagagtgctgggattacaggcatgagccactgtgcccggcctccgcctagttttaacagttgctgagaggagggtgttgaagtagatgtcttcttggtgggttaatccttttgtcattaagcagatgttacggtcacttccttttcaccccattggtgaaggaggggtccctgccctaaagtgtaggagatggctgaacacgacacctggcgtggatggatgagactgacagcagtgttttagtcacatatacccacagctcagaggaggacactgcatgccacgcagggtcagatgggcaccatactctgtagtggagtgagggctgggggctgaggaaggaggcaggcttggtagtaacaagagcacacaatgaccaatggttcctgagggggaatgcaattggcttgtttgaataaattcatgggctggcagacaggtgaagtgaaacttcttaggctgaggtgcaaccgttctggctgataaaagaactagccaggtggggagcctttgctgctgggtggcggggtagggggtgtctggtagaaacaggaaaacccacggctaggcctttggggccctgtgaggctcaaagatgtccaggcagcataggaaattttagatcttaaaattcagcgaagaccctctccagctctggtaaattattttgcttgaagtctacttcatgagatattaatatattcactcctgcttccttaaaaaattaatgattacataggatatctttctccattcttttactttcagcctacttaggtccttaagtgagtttgaagtttcttatgaacagtatttagttgggccatgtgtttattataggctctccatccatccgtcttttggtttatttagaccatttacatttaaggtgcttattgttacataattgcttatgtctgatgtttttattatttgcttttttgtttcctttttctttccctccatcttgatctatttctgtataatgttgttgcgtgtatctctttgtatagtcttgaagtgtttgctctggatgttacaatatgcatattgtaatatagtagtctactggtaccagtatttaccacttcaaagtgtggaaacctgccttgcatttatgtctctttaccttttccgcttgtatgaatcactggcttgagtattaggtggtggtatagtttttgtttcagttgtcaagtgtgattttaagaactgcggattgtctcgtgtatgtatccacatttctggtctttcctttgtccctcctcccatagtcccatattcatcccttctgcataagaactttctgtagccatttttttattttgatttttttgttttaattttttgtattgtggaaatgacagaacatatttctgtagccactttttagcatttctaaatttaccagagacaaattcctatattctcttcctctgataatgtctttatttctctcttcatttctgaagggtagtttcatgggatatagaatttgcaaccaacagtttttttgtttgttggtttggtttttttgtttgtttctttggttggttttttttaagcacttgaaaatgttgtgccacttccttctggcctccatggcatttgagttggcatgtccctacaggcattctgccatttttggtctttgtttttagttttgaaagtttaatcagtgttgctttcttttgttatactttgaggtttgctcagcttcttgaatctgtaagtttatatctttcactaaatgtgggaagcgtcaggaattagttatttgcatgcttttgcagctctggtctcctgtgggactcagataacataaatgcggggtcttttgttattgtcccacaggtccgtgcagctctgttcatttgttttcaggttattttctctctattgtttagactgggtgaattctgttgatacaggtttcagcttctctgattctctcctctgtcgtctccacttttactcaatagagcccatctagatagatttttttttaatttctgttactgtattttatatttctgtaatttccatttgattcttcttcagtttctttgctgacgttttcagttctttgtttgttgccataggatttgtagttgcttgttgaagcatatttatgctgactgttataagtgatgagtcagatggttccaacatctgcctatgtaatttttttatttttgcaggcagtcctcctatttgggtttagtctgtaggtcctggtctactttgtgggctgtgattccaatggcaatttaatttcagagccttcatggtgttattttggtctgtttggcttatatgtatcactgggattctcccaccagtccctgctgttgcccacctgagggaacaggggagctgccccaggctgggccacctgctgcagctaggtgggtggggagtggtggttgtcttggtgtgtggagctggttttcttgttatggggaagatttcctttgatctggggggactgagtctgcctgggttgccttctattgctacgttgggagttgggaaactctgggcctggtcaacttcctattggatgaggtccagggagacacctggccactatgcattccctagtcctagagtccctcagcagcctttttctttccacctttcagaattctcctttgatcatctcctgtctattatttcttaggagggtataatgtgttatcttctctagaccagaaatccttaatggtggtttcaggttgtaactgtgctaaagggagaattggcgtatttttgatgttgagtctttcttttcaaatgaggacatatcattattcagtagataatatttacaacacctacttccttgggttgaagaatgtggttaaggcaaggaaagtacttaacacagtgcctggtgtggagagcaccgatgagtgttggtggtgatgctattccttttgtcctttggtagcatattaaagcttttcttcttttttaaaaaaataaagttctggtgcatttcttgttaggtttattcctattttatccttttttgcttttattacaaataggagcttcctatctattataacttctacctggttctttggcccttatgtgaaaatgttttaatagccttctaaacattgctctcccaaatgagttttaacttgcctatttcttttattttcctttttttgagacagggtctcactctgtcacccaggctggagttcagtgatgcaattatggctcactgcaacgtctgcctcccgggcccccaaagtgctgggtttacaggcgtgagccactgcacccagccttacttgtctgtttcttttaagagtgggaactataattgagcccagagctccaaaaacaaatgaaggaatgaatgagtgaataagctcttcccatgggtttggtgtggtttggggctctactcttaatctaaatgctatgttttatataacctaaaatttcccctaggtgtgttacacgattgtgttgtgttgaacttacattgagactccttttcacatgtgctggtatcagcgtggagcttttctattcattccttgaactattcgtttgggggacacacatagacctctgtgtctttcataaagagtgtccattggccaggtgcagtggctcatggctgtaatcccagcactttgggaggctgaggagggcagatcacgaggtcaggagttcgagaccagcctggccaattggtgaaatcccatctttactaaaaatacaaaaattagccaggcttggtggcgggtgcctataatcccagctactcgggagactgaggcagtagaattgcttgaacccgggaggcggaggttgcagtgagctgagatcatgccactgcactccagcttgggtgacagagtgagactctgtctccaaaaataaaaaacaaaaacaaaagagtgtccattgtgtatactggaaaaattgagattgggattttgatgtgaagtgcggaaatgtggattgggtccatttagtttacctaaacagatgatgaaatactaactgttttacaaagcattccctagtgcaaagttttgcctgtgtgtgtagtgacaggaacagtgagaatgaggcttggaacgcagagcacactgtgggcctgtggtaggtggggccagcagcacatgcatacctggctcacagagcagcctttgggtgttcttttcccagaggagctctacggtgactttgaagacttggaaacaggggacgtgcacaagggaaaatcaggccccaatactcaggtatgactttgtcgtagctggctgttcttggtcattgtgttctgagagaggcccacattgagaaatgcaaatcttacttgtgatgtgtgaagattgcagactggatagatagattccttcctaaagggtggggatgtggggaccaaagagaagctttcttgtttacttgttaagttttggatgacagttactaccgtttcttgccatagtcatttgccaagtccactgtgatttttcactcacggaagtcttagcttcttggacttacattcaaccattggcatcattctcctttttttaaatttaagtgtcatttaaaagaatgaagtccctgttctccctagtatttctttagaacagggtctgggagcatctgggtgagggacacgtctgttatttttattctagtttgtgttcccagccagcttaaggattagcagctaattgtaatgcagatgtaaccatttcctgtagcagtaccatgttattcagagacaaaggttgtgttgtgttttcttttgttttattgataatgataacagatttttgctaagattcttgtttaaatagaactttaaaaaagctaatgtttaaagaaaagaccttcataaacatacacaaaattttttcttctggaaatttaagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacaggtgagaaacctcagttcctctcagccccttgtcaagactatcatatagcgcaggaatccctgactttgtttgggtccctacgtcctatcctgcttctgtgtatcctgcttctgtgcctttcattcggactcctgggtagagatgcatgtgagtgtgtttattcatgcagtgagctcattgtttctgcagtcagagggtcaccagaaaaagatccatacctattttgtaacaagaattaggaaacagaaatgactgagacatggtctctacttttgagacatggtcttacaatgtagtgatctgagacagtgtgttcatttcagtgcaagcattggcggcctattccaatcgctgctccctgatttgaatggcaggtgatcagtggcccctgtggcttatagacacaccagagctcccaggggaagtgctctgaaaactcatcctggtcagagttcagaaggacatgtggagtataaggtcagatgcagaaataaagggagatggtgtggccctcctgcctggggatgctgagcaggttgctggaggcggtgatctcactctgaaggagacagacacagaaacgtgtgtacagttgatggtgagcatctgagttgcgtcttgttagtgaggccaggagtgcctgtgtaagctggaacagattaggtatatgatttgtgaaacggagtttcatcctaggtcttcatctagtcaaaggactatttcctgattaggcattagcttagtggttgctagtctgtgttgacctttgaaaggcatgactaggctaactctgaagtttttgcttcacaccatttacaatttaaaattacctagagccttgtgggccattggaaaagactgaatgtttcactctgaaatgggagtccttggagggttttgagcagaggagaggtaatcagatcactctgccaagagatcagtcgggtggcacaaaccagaaggctggcagtggagatgagagaaagagtcaaacccggatagactttatttggaagctgggtcagtaggatttcctggtggactgaatgtggggtgtgtgagaggaaatgaggatgtcgactggaagttcctggaaggacgggttgttgtaagttagataggaaaccctctgcagatgcagttttgggaagatgatgtttggttcggctgggtatcatgcagacaagtgaaatgtcaggtctggagagaggtctggccagggacttagatgtagatgccctcagcatgtagatgccacttaacgctgtgaggtggccgggagtgagtgcagagtgagtgggaggagcaagactggcatgggcgagatggggcgattgtggccgtgagtcctgagcagtgcctaggagggagaagcagtgtgagcatgcaggcacacaggaggccagttgtacatggaggcgaagcattgttcagatcctgctgccatgttaactacggtgaaggcagagttcaccactggaggagtccttcagcgtggaggccttcagcaatcttggcaagcaccaattttcatggatgtaggagaatgggagcagaggaactggaggctgcaactgcagaaaacttttgtggggttttgctgcagagagaagcagagaaatgaagccgttgttggtggaagaagtggaatcaaaaggttttgagataagagagagaacagagggaagagctgttggaataaagtccaggaagagtggatggtgtctagtgagcaagtgatgtgtggccctgagtagaggcatggacaaatattctgtgcctgagctgcctgtagaactttctgtgatcatcgagatgcacgtcagtgcttcccaatattgtaacactggccgcaggttgatatggaccacttccagtgtgactagtgtgattgaggaactgcattttaaatattatgtaattgtaattaattttaatgtaaatagccactcatagctcccctatgggccaggtcagagctctgataaggctggatatgggaggaaaccctggtagagggctgaccgtggaggttcttttggttttggagtgaatcaggaaacagccatcagctgagtgaaggtgagggtggtggtgggtgtttgaagacaagggaaaagtgtgaaagaattgttcagaaaggaaagaaagaagatgtggactggggacgtttccagtgttcgggcatgcagggctccacagttatctacatttgctgtcccttggagcaggagagaagaaaacggttgggacatattctgagcagactgtagaggtaaaatatgtaggtctttttttttggttttttgttttttgagatggaatctcgctctattgcccaggctggagtgcagtggcacgatctcgactcactgcaacctccgtctcccgggttcaagcaattctctcacctctgcctcctgagtagctgggactacaggcacgcaccaccacgcccagctgattttggtatttttagtagagacggggtttcaccatgttggcgaggctggtttcaaactcctgacctcatgtgatctgcccacctcggcctcccaaagtgctgggattacaggcgtgagccactgtacctggccaaatgtgtagtatttttaatagggtaaagcctacataattctgtccacagttcctttacttagaaattgctcatttgttcatgttaatcttatgtttattacagataacagcatacaggtttttttattccccatcatgtacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcaggtgggtccctttgctacatatttggtgcctgaggctctgtggatttcccctccatcaatcatcttaccctctcgtcccctcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggtaaaatatgattacaataacttgcctgttgccaagattaaaccttacaggctgcgttattatagctttgtgcttttctttcataaaattccactcctaagatttttctcttttctgggagcggggaggtggtttggagtatatatgtaaatctatatccaaatctaaatgtccatatccagtatgttaaactagaatctaaaatttgtggttcgctatatttctttttttccttttcctttaaggccctatcactccacagggaactggtttcttggcaatacagtctgtcagtggcataatggtaactatcttggatgatttcttttacagattggtttgagaaatatatcctgggtgtgggttattatgtacatgagactttaagttgaaaattactcatttttattaatacaaagtaaatttccctttgcttttaatcttcctacatcgttttcagtagggtgtgggattagaggaggggaggtggaagaattataatggtacatttcctatttttgtgcatcttttgcatttatttatctaagcaagtacttaagcagtgctcaccatgtgctaagcactatatgaggttgtgaggagccatcagagactccctgcagccgtgcagggagtccattttcatttgaccagtcaggcagggcagggtttattggtcccatttaacagagaagaaagcagaataatgagcagatggaatctgccctggagttccaaattttaatttcctaaacattgcaactgtatttttcttttccatttcattccaaataaatcattatagtgaaattacattcctctgaaatcactctcaggaaagtactcaaggcgccttttttttttttttttttttttttttttgagacagagtctcactctgtcatccaggctggagtgcagtggcacgatcttggctcactgcaacctctgcctcctgggtttaagcggttctcctgccttagcttcctgagtagctgggattacaggtgtgcaccatcatgctgagctaatttttgtatttttagtagagatgggattttgccatgttggccagactggtcttgaacttctgacctcaggtgatccacccgccttggcctcccaaagtgctgggattacaggtatgagccactgtgctcggcctcaagtcacccttgttagtttggcttaccaactttaaagttttggattgcttttgtcaaaccactgggttgcaagttcacatggtctctcttgtttttcttagctaattgtaagtaaaattcactttggtaatttattgtgtcacatagaattgaagtttttctcttgctgatattattcctattttcaaattttggggttcctgttagcctgattttcggatagctgctacaggagttgtccttgatctggataaatccataaaaattgtgaagaaattaaagctaactggttttccatataaaattttcaagaacacttcatttattaaggtctgtatatctatatattctcatatttataaatgtccatattgtttgagaaaaggaatgaaatacctttaaaatatgggcctcatatttttataaaagtgtttgaaatcttttataaacttcatattttgtttgctcctttatattctgtgttacttaaatatgctctaaaaagcagtggtaaaacagctatttaggaattgaggctgttattcataacttccatgtgagactgccacatattgaactcatattgaactcatattgaaaatatgtcattttatccactgggttttgtttcctactttttttatttgtgttaagaaagggaaaaaaatcacaagtttgtctaaccattcagtagaaaaatcgacaaagcatttgcagacaacttggcaaggttacagagaaacggatatactgtttttcagtatttggggaggttggtttgagcagcatttattgagaatttcattagtggggatgtttctattgaaaacacagagttagaaagtcataaaatgttcttgcaatataaggtaataataccaccagcgtttatcttactgttttcatgttctaagtgcatgcacctgagtaaaagcatctgggctgcagtccagtctgagagatgccaggaaaggctgcctaggccagttcagtccagtaaatccctcttcgatcttctcttccacacagacagcggtgatgagcatgcccatgaactgacatgattattttggggaaaatgaaagacttgtattctttttgagatagtaattccactttcaggggcgaatacattttgtttattttatcacccttcagtgagttgtttttgttctttaatcaaggatgtatgtttgaagtaagaagtaaagcataaagtatatgattttgtgtgtgtgtgtttttatcttgctatacctgtagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcggtgagtgtcttgagtagtgttcagggcagggtgttaccattcatgcttgacttctagccagtgtgacgagaggctggagtcaggtctctagagagttgagcagctccagccttagatctcccagtcttatgggtgtgcccattcgctttgtgtctgcagtcccctggccacacccagtaacagttctgtgatctatgagaatagtttccttagcgagcttttccttcaaatactttgcagccaggtagagaagtttggagtgaaggttttattctttgtttcttcgcaatatggatatgaatcttcttttgaaaatgttaaagtaaattacctctcttttcagatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataaggtactggtcgcgtgtgtgttagtggagatgaagcctgtgctctacagacagggagtcacacagacacttttctataatttcttacatgctttgaatgttcaagtataaagtctaacgttaaatttgattgaacagttgtatatttgtggaatattttggaatggaacaccaaaaaatgataatagtggttctttctggattgaagacaaacttttcttttttaaaataaattttattttatatatttgaggttgaccacatgatcttaaaggatacatatagatagtaaactggttactatcgtgaagcaaattaacatagctaccatttcacacagttagatttttttgtgtgtaacaggaacagctaaaatctacttacttaacaaaaatcccaaagacaatacatttttattaactatagccctcatgatatacactagatctctaacttgttcatcctacatgtctgctactttgtattgttttaatatacatctccccatttcctattggtcatttcctatttggcccatttttcaactgggttgtttttctgctattaagttgtaagagttctttactgatttttggatattaacactttatcagatatgtggtttgcaaatatttctcccagtctataggttcccttttcattttgttggttgttcctttgctgtgcaggagctttttagtttgatgcagtcctccttgtttatgtttacatttgtagcctggcttgtggtgcgatatccaaaaaattattgctaaggccaacgtcaagaggctttctccctatgttttcttctaggagttttatggtttcaggtcttatttgggtcttgggtcttgtatctattttgagttgatttttgtgtatggtgtatgatcagggtccaattttattcttttgcatgtgaaaatccagttttcccagcactattattgaagagactgtcttttttaccattgtgttgtcttgtttgcccttatcaaaaattagttgacagtatatgtttggatttatttcaaaggtctctgttctgttccattggtctatttttttgtttttatgccagcaccatactgttttgattactatagctttgtaatacaattttaaatcaagaggtgcgatgcctccaactttttctttcacagtaatctcttggctgtttggggttttttgtggttccatatgagtttcaggattgttttttcttttattttctttttttttgaggcaaagtctcactctgtcgcccaagctgtagtgcagtggcataatctcggctcactgaaacctctgcctcctggattcaagcaattctcctgcctcagcctcccaagtagctgggactacaggcacgtgccactatgcccagccaatttttgtggttttagtagagacagggtttcactatgtttgctgggctggtctccaactcctgaccttgtgatctgcccgctgtggtctctcaaagtgctggaattacaggcatgagccactgcgcctggccaggattgttttattctgttctgtgaagaatgccaacagaactttgatgaggattgtgttaaatctgtatatttgctttgggtagcgtgaacattttaacaatattaattcttctgatccataaacataggatgtctttccatttgttcatgtctaaatttctttcatcaatgttttatggttttcaagtgtacacatctctcaccttcttggttaagtttattcctaagtttttgtttttctttgctgctattgtaaattagattattttcttgatttgtcacctaggttatttgcatacagaaatgcaactgatttttatatattgagtttataccttgcagcttaactgaattgatttagtagttctcacacttttttgtggaatctttggagttttttatgtaaaggatcttgtcatctgcaaatagagataattttacttctttaatttagttgccttttttttctcatctgattgctcttgcaagtactctattgaataaaagtgatgaagctggccatccctatcttgtattcaatcttagtggaaaagcttttagttgttccccactaactattatgtagactgtgggtttttcataaatgggctttattacgttgaggaactttccttctatacataaactgttaagaggttttatcaagaaaggttgctaaactttgttaaatgctttttctgcatcaattgaggtgaacatgtcgttttatctttcattttgttaatgtgatatatcacattgattgatttacatatgttaaaccagccttgcatgccagggataaatcccacttaaacacgatgtataaagtttttgatgtgttgttgaattctatttgctaaaatttttttaggatgtttgcatcagtgcttaatttattggagaagttgacctgtagtttttgtttgttgtgtgtgtgtgtgtgtgtgtgtgtgtgtgtgtgtgtgtgtgttttggtttggcttaggtattaaggtgatactggcctggtaaaatgtgtttggaattatttcctcttgctctatttttgcgaagagtttaagaagtaaactcccaggggatgggagtgactctggacatgggagtgacataatagtgactctggaccctacagtggtgggacacagcagcatctcagtctctacgaggccaggcgcagcatcagcaaggaccccagaatgatggagcactactgtggcttgggccctcgggggcagggaccagtgcagcaactacttctctccctggggaggcaggtgcctgggcaactcagattctccagggctagtccagttccaaggaagcagggttctacagttgtttgtcctgaagggcaaggtaccccagttcaaccaatgccattttcctgggacgtgggggtgccatgttggctcatccctggcaggtgtggctgctcagctcagccaagacactgattccctgtgaagcaggacagtgcttcagctcttgtgcagtggggagtgtgactgctcagactggccaaggcactgattccctggaaagcagggcaccaagtcaactcaggctccaaggggcagggcgcaatggcagctgggaggggaggggcacggcagcgtggccccgcagggtggggtgcatgctgtgatgtggacatcgtttgttcccaccagcactcatgttgaaatttgattccaaatgtggtggtgtgggaggtggggcctagtgggaggtatttgggtcacagggcagatcctttatgaatagattaatgccttttcatgggactggattagttaccaggagtggattgttaccagagtgagttcagcttcctagactctcgtgtttcctctcttgccatgtgagccccttgcatacacctgtttccccttccactttccccatgaggtgaagcagcacaagaccctcgccagatgtgctgcctgatctcagacttttcagacacaagcagggtgagccaaataaaccttttttataaaataagttaccgagtctcaggtattctgttacagccacactaaatggcctgagacagtgtaacagcagctcagtgtaacagtggcccaccggccactaggtgggggtgatatagagcaacaaagcctgaggatggaagaagggtgtggtggctgctcaccctgggtgggacatgctcccgaagtgattccaggtccaggagggcacgttgcagcagcagctggtccatgggggtggggcacaacgtcagttccttctctgaggggagtgctggggctgctgggcccctcttgcttccttatccccacagggagacatcccctctgcttcaggctgatccctctgggggatgggtggtggggggcagatatttccttctctcctttatgtgaccatcctagttttctgtgctctactagatttctgctactccttgatgcactctggggctctcctttagtgactttcatcaaaatatagttgtttgctgctttggctgtctttgtcaggggatgagcgcaaggggctattgatcggccccttgctggcatcactccctcttaaacttttcactgggtactcttttgaactatttttttccccaccatatacatgtatttttaaaacattaatgtgctaatttctattaaagcaatgtggatttttctgaaagttttaatgttttaataagctttttattgaaatgttaatgtacatacagaagagtgcccaaatcataagtgtgcagctagatgaactgtagcacaccagctgccacgccctggaccaagcagtagcctcgccctgtggcctctcccaggcactgcctccccaacccacaaaatagctactttgccagttcctgacgtagatttgttctgcctggttttgacttttataaaatacagcacattctatttagcctggcttctttggttgagtattacagaacacatccatgttcttgtctatggcagacattgatttattgtcattgttgagttccagtatatgactgtgtcaccatttatccattgatgggtaaaatgatttcctatttttggccgttatcccacggcccttaacactaaggtctggatatgggacttgcaggtacggaggggcacacacacttctgctggaggatccctgggtagggtggagactccagggcacctgtgctctgcttcagtgtggaggcttctgtgtcgtgttctgggagcacagcggcttggcctccaccaccagcagcagcttaaagagttcctgctgttccacgtgcttgctgacaattggcctcttcagtttttttttttttattttaggttttcaatgcctgcctggacttgtgttttcatttagattttggtttcttagaactgttgttattctcttcacagcttaacaatgcatttgaaaagatttgttttcatgtggagtgttcagttttgtaataagagggttgttcaaggcatcagtctgccactctgctagaaacagaagtctcccaggcatttctttttatataaagtagttaatgaaattttgaaccgtcttacatgaatttttattaaaatacacttcaggatgtggtgcccattatccattctactcttttgtaacaagtagatttctctgaattcttgaattcaaaaacaatcggggttcctaaacaaagaatatggaatattattggggatgatgtctttaataatacatttcaagataggagaaacttgttctatatagttgactttaacaaaagcctagggcaaaactttcaatttattaacagtatttatgaggcagttaagaatttgggtcatcctccgtctccactaaaaatacaaaaaattagccaggcgtggtggcgggcgcctgtagtcccagctactcgggaggctgaggcaagagaatggcgtgaacccaggggcagaggttgcagtgagccgagatcatgccactgcactctagcctgggcgacagagcgagactccatctcaaaaaaaaaagaatttgggtcatctcaattaaatatagaatttaagattaccttgaaaattcagtgcagagtattttgccttcatctgttgtttgagtctcccttcttttagccatccttccatcagaaatagaataccaagttaaacttcttaattagaatcaggaatcaggactctttggctgctgattgaaggaagaactgtccttaaatccagagtgggccagttgtggtggctcatgcctgtaatcctagcactttgggaggccaaggcaggtggatcacctgaggtcaggagttcaagatttcaagaccagcatgaccaacatggtgaaaccccatctctactgaaaatacaaaaattagccgggcgtggtggtgtgtgcctgtagtcccagatacttgggaggctgagacaggagaattgcttgaacccaggaggtggaggttgcatgagccgagatcacggcactgctctctagcctgggcgtcaaggcaagactccatctcaaaaaaacaaaacaaaacaaaaaaaacatccagagtggttgatagtcaagacaaaaagctagattatttttgttagtctgggaaataagcacctcagtggcccaaagacaaggcctgaaatttccatgaaaagaaactgggatctattcatctgttctgttgagaccccatagttccataccatagaaatgggcacagtgggttttggggggagagttgtaagtgtaagctgtctgttcctctgtttactgagaattgtgggtgtccactgaggcagttcatatttggcagatgattgagtcctgatttctcagggccggcagactctggtgttactaatcttgtggaaaagtcaacccattgagaagattttatgcagaagttttaaatgcacattgatcataatttgaatatgtcacagtctttgtttttcttttcagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaaggtactgttgcccatgctgtactgcacgctgcgtttagataggaaaagaacactctcaatagcacacttcctgtttctactgtagtctcagttattcagggcactggaactaaagtcagaggaagagccagagtccatttccctttctttgcctggtcctgctctgccctgtgcttttcatgggggataacaggtacatggctggggaacccttctgtctcggttagctgcacacagtgtccacagaatgatgaacagaggtggtaaaggtaaaatgggatcacacctgtgtctccatgccaacaatgacttcctagcacaggatgcattttcatgcagttaatattcatttggatcgtgggttgcctctagtcttagtgcttaggatgcgagtgtgtggtgtctgagagcattctgatactcaccggcttttgtccttgtcagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacaagtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttacttttggcttagtagttttcattagggatgaatgcctgacaattctttgtggataattatttatactaccaccttcatgaggagtcttccagaagagaaagaaatattcacttgaactctgagctcccatggaagattttagagaatagtgtgtagtgtttttgttttgttttttgtttgagtgacacacaaacctagatggtacagcctactgtgcacccaggatctatgggctcctttgatcactggcccttgtggacattttctatcttatttcatatgttctgcacattagtatagtgacaaggtaacagtaagtacttttttaaagctttagacttaggagattattgtctcaggtgcagagaccaaggaaatcgtatgtatcagtgagataggcttcccgtattatgctcatgcgttatacctgcctagctacattgcctttttttaaattaaacattatgttgaagtaatcatactattacataggcgatgtatgtattttatgattgtatgttgatatagttatggggaatctattcctatacgatgtaatcatagattcacatatagttgtatattttgcccaatttctctcagtggtaatgtttcacacatataacaatcaggatgttgacatcaatacagcccgctgattttattcacatttccccagctttactttccccaacgtatactcctccatgtatgcatgggtgtgtagaaatatggaacgcagctgggcacagtgactcacgcctgtaatcccagcactttgggatgctaaggcaggaggatcacttgagcccaggaatttgagaccaacttgggcaacatggcaaaacctcatcgctacaaaaaataaaaaattcgccaggtgtggtgggtgcacacctgtagttccagctgcttgggaggctgaggtaggaggatcacttgagcttgggaggttgaggctgcagtgagccatgatagcaccactgcactccagcctgggcgacagggcaagaccctgtttcaaaaaaaaaaaattatacatatatgtatgtagaacacttcatgaatttgtgtgtcatctgtgcatggggcccatgctgacctctgtgttgtgccagttatagtatgtgtgctgctgatatgagtgccacattgcctttacaacatcataggggccaaagagggttggcaggattatgagcagttggcctagtctgagaggctctctaaaagcctaaagtctgtaggcaggtgctcagctttgtatctccataagaagggaagaggatgtgaggatcctgtcagggctaggtccacctgggaagtgacaattggaacactcccagacctctctgggcaactctgggtgtacattttcctctgttcctcaagagctattatgaatttcatcatccattatgctgataggcctggggactgacacatagtaagcccataacaattataatttaaaactaatttgttatatagcataattgatatattttaaaatgcaaaactataattcaactaaaatatacaaggcactcaagtcataccatgttttaagtagcttacaaggtgatcagcaagtgtcttatacaacaagcaaatttgttcaaagagaagcattgcaaataagtatttataattgtatagttttatattttagccagaagagtggaatcctttagcaatgggggaaataaaagaatgtttaattacagttgcagataattgccttttccaaagacaatgtatgtaggcagaactcatacctgttaatattaaaaatcttggtttatcatatttggagaacaagggaaataaaaagtttgcatattaagattatttaaactaaagttaaggaatctctaatgtctgaaagaaacaataaatagcatttttcatgtagaatttttattggtgaaggttccacctggccaggttagtaaaatacagtcacacatcagttaaggatggggatatattctgagaaatgtatcattaggcaattttgtcattgtgtaaacatcatagagtgacacacaaacctagatggtacagcctactgtgcacctgggctctatggtatggcctgttgctcctaggctacaaacctgggcagcatgtgactgtactgactactgtaggcagttgtaacacagtggtaaacatttgtgtatcgaaacatagaaaaggcgtagcaaaaatacagtattgtggaaccactgccatatacgtggtccatccttgactgaacatcatgcggcatgtggctgtatgtatacacatagtttttgctgtgagtttgcatccatctcataggaagacatatatcaaaataaggaccagactggagagtgtgtaaattacttttcaatactaatggcttattaatttgatattgtcagcaagtatgttgcaaaaacaaattccaccagaatgtgagttccatgagagcaggaactgggttgttcaccttgttggcacttggagtagagccactgagcttcgtgctgcataaaattgcttggaagaaagaagggagggcattccaggtaactgaagcattgctatgcaaagtaagcatttgccctctgaaatattttaacaatgtttatagaaacctttctcaattgtattaaactttgtaaattgtaaaaattattctgttataccttttctatttactaggcacaggcagccataggtgctaggtatgttttgaaaacatattgaacctacagtgtacatatcattccatgccattaaatattcttatttaatcatagatgtgttcaggtgtgtttggtttcctatttgtggatgtactagattgttttctttttttaacaaaacctgtgaacttgctttaagtattatcatttggtgacatgcccgccatttcagaaataaatgtttgagcaaagaggaaagccaccgggtctgattcagctctctggaggctccagagcttacctcgctgatgggaaaaagagcatcgatttaattgcccttggtaccgacttctagtatctagtattttgccagactcaggtatttcttaaagccattattcagagtcttcagcaaggacattgtattttacttgtgtctccttagttttacctagtttatttcatggttttaaagtattgtacatttttataatcctttaacaagacaaaaggttgagatgttggacatttaaatgccaaaggtgttttattatgagacttagcatttcatatttggggatggtaccttatcgaaaatcagataaactttggttggatgggtatttggaggaatcttttaagtcttttcttaagcaaagtttggacactctaaaataaggttgccaactggcatgtagagagaaaaggatgtgtcatacatttagaccaggtggcctgtcctgtaaatttttttgaggggaggggtgggcttgtttttttctgtgtttcggttttttccaatttttgttttgtgataaaatatgcataataaaacttattttatcaatttttaattgtatgagtcagtggcattaccttcacagtgctgttgcagccatcttcagagcctttccatcatcctaaactgaaactttgtacccactaaactacatcttctcattccctccttcccccagcccctgcaaccaccattttgttttctgtctctgactactctagatacttttgcaaatggaatcatacaatatttgtctttttgtgtcttgtttatttcacttagcatactgtcttcaaggtgtgtccagttgcagcatgtgtcagaatttccttcccttttaaggctgaataatattcccagtgaatgtctttaccacacgttgcttatccattcatctgctgatggatgtgtgggctgttgggaataatgttgcttgaacattggtgtgtaaatatctgtgtgagtctctgctttcagttctgtgtgtaaaagtggaattgctgggtcaaatgtcattctgtgtttaattgtgtgaggaactgccacactgtatccacagttgctgtggattccttacatttcttctagcaatatgtacaagggtttcaatttctccacagcctagaccaccctcattactctgtttttttgttggttggttgattggtttcttaaaaaacaggcatcctagtgtgaagttgcatctcgttgtgatctgtatgttgggaatgactagtgatgttgagcatctttctgtgtgcttattggctatctatagaccttctttggagaaatgtctattcaagtcctttgaatcagatttttttgttgttgaattgtaggagttctttttatattctggatattcaaccgttatcagataaaccattcacaaatattttctctcattctttgggatgtcttttcactctgatagtgtcctttgatgggcaaaggttttttaattttgaagtccaatttattttttcttttgttgcctgtgcttttagtgtcatagccaagaaataaccaaattattgtttagttttttaaaagtatttatgcgattatttggctgatacctgtctctaatgattgacggcacttcttgagggtggcttttaaacatgcaaatttgatgtcactttccgaggctccttccatggcttccctttgcttctaggccgcagcccttgtccttgctgctgctctggcccctgccctcctctagggcctctcttctgctgcctccagctctggccacagtggcctttcattcgtcggtgcacttgcctggggtcctcaacacatgcagttccctctgcctggaatgcggcagctcctccgccccctcccggcctccacctcctcgctgctccttctgaggctggccctgagaccactggtcggtgcggccttccctggaccctctccgaactccccagtactcctccaaacttttctccaataaaccagtggcactcagttgtgctgtccagggacccctgggattttcacgacccctgtcggcggctgggtgaggtcaagaatgtttcatgacaataaggagatgttattgacctcttttcactggaagtgggagcgtcttgcgggggggcagcgggctgaggatgcggctgtgttaggacgtgacagctcgcacaactgaagcaccgccactttcccacaattttttttttttttttttgctttggaaaacatttctcaagaaaatatgcgacttatgttaccatgtaatgggcttgcttctgttattttaaaacaaactaataagtctcctaaatgtttctcggctttattttttgttgttatggttccttttcttctgtttcccccagctttatgaaggtgtaattgacaaacttgcatatctttactgctcacagcgtgctgttttgctgcatgtgtgccctgtggaacgcttcgtggcgctgctgcaaacctccatcacctagtgctgtgagggcccctgggatccgctctcccagctctgcgccctctaccccctgctgtgcctgaggcccccccacctccctcggacccgcgcccgccgctggaaccgcacccatggcccgcgccccgtccccgacccggctttagtttccacccacacgaagaaactcagcctcggtcctgtttaggcacggaaagggctggagaaccgcgtccttccgaggcgcccccagcgcggctccccacggcgtgcaggacccgggactgtcgcgccgcgcccggggacgcacaggaggtgggaccccggagcgaagcccctgcagcgtcccgggctggacgtggccctgcacccccggctgctgggcgggccggggcatgtacgagatcgcgcgctttacaaactgtcggtcgttctgggaaagttaaagaacgcgctgcagctacttcacctgctgctgaaaggagcccgggcagggctggtcactccgcgccacgccccgcgcgccaacaccggaaggtgaatgttcagaacatttttatcatttaaagccagtatattggctgggcacagtggctcacacctgtaatcccagctacctgggagtccgaggcaggaagatccgattgagcccaggagttccagagcaccctgggcaacatgacaagaccctatctctacaaaaaaaaaaaaaaaaaagccgagagtggtggcgcgcacctgtggtcccagcaactcgggaggctgaggcaggaggatgacctgagttcagtaggtctccagcctgggcgacagagcgagaccctgtccattaataaataaagccagtgtacctaaaataccatcacaacatggaatcagcataaaaatgattattgaactacttgacattcctgttttgtgctaagtctttgaaatttggtgtggcgttttgttttgttttgttttgttttttgagacagagtttcgctcttgttgtccgggctggagtgcaatggcacgatctcagctcactgaaacctcagcctcccaggttcaagcaattttcctgcctcagcctctggagtagctgggattacaggcgcccgcgaccacgccgggctaatttttttgtgtttttagtagagacagggtttcgtgatgttggccaggctggtctcaaacccctgacctcaggtgatccgcccacctcgacctcccaaagtgctgggaccacaggcatgagccaccgtgcccagcccagtgtgttgtactcttatagcacctctcaattcagatctaaattttgtgggaaataatctatatttagatttcacagtattcacagttgaaaaaatagatgtatatccccttgtttcaaatgtaactgaacctagtcacttgtttgaaattcaaattaattaaaattaaaaatttccagttctcggcaccagttacacatttcaagggctcaatggccccatgtggcagtggtcccgtagaggacggcacagctctagacatggtgtaggaagttggagaaggcttccttagggaagcaagtgacggttgagccatgactagaagttggttaacttggcaaaggctgggagttggggaagcagaagagtgtgtcaagcacaggaatgttatgtggaaaggcctgtgacacagggcagcatgacgcctgcaagccagcgtagctggagccaggacagcagcagagagtcctaggagctggagaggaaaatagagaggcaggggatgaggccgccttaagaggctatcttcatcccgagacaccaggaagccctgggagaacatttagctgggacagcgtggttagatttccatttttcaaaaagcccctttgctactgggtggagatagtttgcaggaagtttaggggaaggaggcacagagagggagaagtggtgggtgctagagctctgagaggtaacattggaggggtagtaggtctgggggttgtgaggaacaaggggttttcagggagtaccccagggcccccaggtgtctggctgggatgccaggtggagtgatgggcacctgtgggacagccaggcagagacatctgaggcggcagctggggaactgtctggaactccggttgatgtgctacctgggcttaagatgtactcccaagagttaccaacacctacacttgggagtgggtgcattatccagggaggagccaaggttgaacacaggtgggtttttgttcagcattttaaaaaattttcatttttttttgtagagacaaggtctcattttgttgcccaggctggcctcaagagatcctcctgccttggcctcccaaagggctgggattacaggcgtgagccactggtcccagtctgttcagcactttttccactagcttagtatctccacatacctcaaagagatcaccaagtccaactcatacatgcaaaccagtgctcaggaagtccacatgatcctgctgtggttcatttgaccaaaactgagcggtggagctaagcaaggctgtttcacagaagccagatatataagtgtcctcaatatggagggcagtcaccatctcccagtgtctctgactgctgcaggcacacttggcaaactgtgctcaggtcagggatggtctgggtgggggctccagtttctgccactcaccagtgatgtgactctgggcaatgtacaaaatctcttgggttttaagtttcttagatggggataataaaccaatcttgcagcatgtgaggatttaatgagactacagttcccatgaaggggatggggtgctgaccttcccacacagtcaaaaatccacatataggccgggtgtggtggctcacgcctgtaatcccagcactttgggaggctgaggcgggcagatcatgagttcgggagtttgagaccagcctgatcaacatggtgaaaccccgtctctactaaaaatacaaaaattagtcaggcgtggtggtgcgcacctgtaatcccagctactcaggaggctgaggcagaagaattgcttgtacccaggagatggaggttgcagtgagctgagatctcaccactgcactccagcctgagggacagagtaagactccgtctcaaaaaaaaaaaaaaaatccatatataactttcaactcaccacaacttttgttaatagcctactgttggccagaagccttaccaataacataaacactcaacacatattttgtatgtgatttgtattgtatactgtattcttacaatgaagtaagctacagaaaagaaaaagtactaataaaatcataaggaagagaatgtattcactatcactaaatggaagtggatcatcataaaggttttcatccatatcatcttcacattgagtaggctgaagaagagaagaggttggtcctgccatctcaggaatggcagaggcagaaaaggtgggggagatgggaaggaaggcaggagacgcacacatgctgagaaattcatcgttatttctgtctgacatttttgctttttcatttctctaaatatgtttctttgtgataccaatcctccttccaccatttgctttagttttggtgcccgtaccatagaaaggtccatatggtaaaagaagtcacaagcagtcttgaataatcggaacccctctgccagattgtcgaatgtcaacttattttctggtactgcgtctacatccacttcttcatcatctggcactgattcgaaagcactcatctccatcaagtggtcttctgttaattcctctggtgtgatgtctattcactcttgaatttctccaagatccatatcctgaaagcctacattccccaccttttttgccacaggcacactctctttcatgatttccttgattggccctattgtaaatctggacacagttttctccagtaggaaggctgggcactgagagccttcgaaccttctgcttcaccttttgacatttagggcccaattttaatgcatttaaatgttgcctccactctgaaatgaacatgggacgtctgtaatgtgtgaaataggtgtgtctcacccccttcatgaatattcatagagccttctataacctgttgaatatgtacatttagccaaccctttcagcataacttcctgtctcacctttctgtccctggaagtgcctacttttggtctttgctggaggctagacttcccagcctgtcaagacagccaggctgcaggctgcaacctttctaagaaataacgcttttgggctggcccagtggctcatgcctgtaatcccagcactttgggaggctgagttgggtggatcacttgagaccaggagttcgagcccagcctggccaacatggtgaaaccccatctctacctagaaaaaaatacaaaaattagccaggtgtagtggcatgtgcctgtcttcccagctaaacgggtggctgaggcaggagaattgcttgaacctgcgaggcagaggttgcagtgaactgagattgcaccactgcactccagcctggatgatagagctagactctgtcagacaaaaaaaaaaaaaagagagaaagaaagaaagaaagaagaaagaaagaaagagaaagaaagaaagaaagaaagaaagaaagaaagaaagaaagaaagaaagaaagaaagaaagaaagaaagaaaataaggctcttggcctggcacagtggctcatgcctgtaatctcagcactttagaaggtcgaggtgggaggattgcttgagctcaagagttcgagaccagctgggcaagatagtgggacccctgtctctacaaaaacaagtttgaaaattagccaggcatggtggcacacacctgtagttccagctacttgggaggctgaggtgggggattgcttgagcctgggaggttgaggctgcagttagtcatgattgtgccactgtactttagcctctccaaatttgtagatctcataattttaagtcaccatcctccaccagtctttcgttttaagttgttgtataatgatatcagtttttcttgaatcatattagaatctatagatatgcttttcttatagatatcctgcacccacataaaagctgcattttctctatttctctgtccttccttccttccttctttcttcttcttctttcccccccacccccctacagagcctcgcttccaggctggagtgcagttgtgtgatcttaggcttacttcagcctccacctcctgggctcaagtgattctcctgcctcggtctcccaaagtgctgggattaaaggcatgagccactacattcagccaaaagctacattttcaagactagacaaaaaggtatttggcaaaaagagcaaagtttcatgtctgctagcatggctgcagtgatgacactgtgaatttccttttctttttttacaatggttcttacactggattaatttatcttgaaatggtgggcaaccgcagctgcagacctcagtctacagtacatatcaatcaatccacctttttcttgtactgtcaagacttttctctgctttttggcagcacttccagaatcactagtggcgcttcgtacgcgtctcgatgtcttcttcagatttatggtattgcactaaacatgaaaaatacatgagaaccacgagagattacttttcactgtgatacacaatctacaggagagacaagtgctcacacggagatggctagtgtcacatggcattttaagtggacactcgacacctgagctcactgcaatagtagcaggaggggcgacagaattactacagtagtacagtgggctcccattaatttatgcaattatgacttaatactgcatctttacatttgtttacatttctcttgactgaatggcaccatgtactgtgtttgtgtgcataacttttgataaattttaactgtttatagttgatttatgtatgttttatggtggtaaatgataaaaatatgctagtattttatgcattcatgacacacctttttcttaactttttcaatatttctaggctacaaggttcatctgcaagtttcttcaaatggttgcaatgcttactgcaacctccatctcctaggctcaagtgatcctcctgcctcagcctcccaaagtgctgggattacaagcatgagctactacatctgtccaaaagctgcatttccaagaccaggtaaaaaggtatttggccaaaagagcaaggtttcacgtctgctggcatggctgatgtgaaattttccaatacatttttccaatatatttactgaaaaaaaaaactgggccaggtgtggtggttcatgtctgtgatcccagcaatttgggaggccaaggttgggagggttacttgagtcctggagttcgagaccagcctgagcaacatagcgagaccccgtgtctctttttttttttttttttttttgagacagagtttcactcttgttgctcagactggagtgcagtggcatgatctcggctcactgcaacctccacctcccgggttcaagtgattctcctgcctcagacttctgagtagctgggaccacaggcacgtgccaccactcccagcttttttttttttttttttttttgtatttttagtagagacgaggtttcaccatgttggccaagttgttctcaatctcctgaccttgtgatctgcccatctcggcctcccaaagtgctgggattacaggcatgagccatcacacctggccaaccccgtgtctgtttaagaagatttaatttaaaaaaaaattttttaagaaaaaatctgtatgtaggtggatccatgtagttcagacttgtgttgttcaagggtcacaattgtatctgtggtgactgatacgaaacagatgaccaaaaaatgatagttttatttccccatctggtcccatttaaaagaggtgtttaggtctgagaattttcacacgtacaaggttccacagtcaggatgccaagaagctgcacccctcttgctggagtccagccctccccacccaaccctgctgactgctgatgcgccttccatccctgtcacaccgttgtctcgggaaggttgtgtgagtggagacacacagcatgggatctttgtaactggctgctttcgctaagcatcatgtttttcagatccaccccaatgctctgtgtgtcagtggcatgttcctttcaattgtggaatggtgtttgcctgcacagggagacacaggtagttacctcttcatccatgggaggacgtgcggttgtgtccagatttaggcgattatggatagagttgctgtaaacatttgtgcagaggttttcatgtgaacacaatttttccttactccagggaaaatcgttatgggactgctgggccatgtggtttaacacaactgtcagagtgctttccagtggcacctcactatggttttgatttgcatttccctaatgactagtgttgatggtctctcataggcttgctgtcttccacatacagcgtcctcttcggtgagggtccaagtcttttacccacttttgtttggatggttttctaactgttgattttgagagttcttcatatatgtcggactactttctttgttggatatgtggtttgtagatattctctcccagcctatagctgtcttttcagcatcttttaatagtctcttttgcaaagttatattttttattttgatcaagtctaattgatggatttttgcttttacatgcatttggcatcatgtctaagaacaatttccctaacctcaagtaatgaagacttcttcctatgttttcttccaaaactttaaacactctctctctctctcagcaaatacggaggaaacattcatgacaattgcaattctggtttctgtagctggtcacgtggtcctataactaccttcttccactccccagtctgtattccctttgccttcaggaagcctctgctggttgtggtttttaacctggtggggaaccttcattcccaaaggttctggacaattattaatcctgcctagattgggctgttgtgcttttctattgatcttaatcacagcgcatgccacgagggccctcctataccccagacatgctcttccccagtccattgtgaagcagcagggcagtttctccttggtggtctggaccagccacccccaccagcgtagttaactccttctttacctgttgatccagaggcatgaagagcttggcgccatcaggtggcagcctaaacttccagcgcaatggatcatccctgtgtctcttgggggcagcattcctccctctggaactaagatctctaggccagcagagcataaggtggtggggacaaggagcaaaacttttgctagtgggtcactaggggtgatggtgagtagtgctatgctaggagtcttggctatgggaggaatagcaccatgtattggacactgattccgagcatatccagccttctgagagccttgccccagccttgaaaggcactgccaccgagctgcactgtcactgagtcctccaaaggccattattccaccatctgtcaagccagctgcctcaggacagtgggagcctggaaggccagtgaattccatgaacattgggccatcgcggcatttcttttgctgtgatgtgagttccttaaccagaagaaatgctgtgtggataccatgacagtggagaaggcgttccgtaaacccacaggtggtagtttcagcagaagcactgtactcagggagggcaaatccatatgcaaagtgtgtattccacttagaacaaatactgcccgttccatggtggaaaaggtcgtaggtaatcaacctgtcactaagtggctggctgatcactctgggagatggtgtcatactggggactcagtgttggtctctgctgctggtagactggacatattggtggctgtagagagttcggccttggtgagtgtgagtccacaatcctgagcccatgcataacctcatccctgccaccatggccactttgtttctgagaccctggggtgatgacaggggtggctggggaaagagactgacatctacagaatgggtcatcttatttacctgttattaacgtcctgctctgctgaggtcacccttcagtgagcattcacataggcacacatatcatcacattttctgccccttcagtgaggtctatccacatacctcttccccaggcttgtctgtcacacatctacctatcatgttccctgcaagtccctaaccagccagccaaattattggccacaacccatgaattggtatatataatctcacgtctggccatttctccttccaagcaaactgcacaatcaggtacactgccccaagctctgcccatggggagggttactcttcacctttgtcctttagggatatcctagaagggggctgtcatgctgcagctgtctgctttcaggtggtacctgggtatcacacagaaccatctgtaagggccaagagaaggcctgagccttctctccctctgtcatctgatcctagagaactccccatgaggccattggtgcaggctgggagagagaaggcagtgtactaggggtggggaccatgggcatttgggccacttatgcagccgacttatgccttcagggcctgctggggcctgttcacacacagacccctttcctctgatgatggagcgctgccatgcatgcccacctcatgcttcatgggtcagataaaactcagttcatgttggtcagctcaggtcacatgggaacttggtgatccccagttaagcgttcagcctagtggcagatgaacagatgtttctcaaaaggaaaatagttctccctctccctctccctctccctctcccttccctctccgtctccgtctccccacggtctccctctccctctccctctttccacactctccctctgatgctgagcagaagctggactgtactgctgccatctcggttcactgcaacctccctgcctgattctcctgcctcagcctgccgagtgcctgcgattgcaggcgagcgccgccaagcctgactggttttcctatttttttggtggagacagggtttcgctgtgttggccgggctggtctccagctcctaaccgcgagtgatccgccagcctcagcctcccgaggtgccgggattgcagacggagtctggctcactcagtgctcaatggtgcccgggctggagtgcagtggcgtgatctcggctcgctacaacctccaccacccagccgcctgccttggcctcccaaagtgccgagattgcagcctctgcccagccgccaccccgtctgggaagtgaggagcgtctctgcctggccgcccatcatctgggacgtgaggagcccctctgcccggctgcccagtctggaaagtgaggagcgtctctgcccggccgcccatcgtctgagatgtggggagcgcctctgccccgccgccccatctgggatgtgaggagcgcctctaccccaccgcgaccccgtctgggaggtgaggagcatctctgcccagccgcccagtctgagaagtgaggagaccctccgcctggcaaccgccccatctgagaagtgaggagcccctccgcccggcagccaccccatctgggaagtgaggagcgtctccgcccggcagccaccccgtccgggagggaggtgggggtcagcccctgccaggccggccgccctgtccgggagggaggtgggggggtcagccccccgcccggcagccaccccgtccgggagggaggtggggggatcagccccccgcccagccagccaccccgtccgggaggtgaggggcgcctctgcccggccacccctactgggaagtgaggagcccctctgcccagccagccgccccgaccgggagggaggtgggggggtcagccccccgcccggccagccgccccgcccgggaggtgaggggcgcctctgcccggccacccctactgggaagtgaggagcccctctgcccggccaccaccccgtctgggaggtgtacccaacagctctttgagaacgggccatgatgacaatggcggttttgtggaatagaaaggggggaaaggtggggaaaacattgagaaatcggatggttgccgtgtctgtgtagaaagaggtagacatgggagtcttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcattaagagtcatcaccactccctaatctcaaatacccagggacacaaacactgcggaaggccgcagggtcctctgcctaggaaaaccagagacctttgttcacttgtttatctgctgaccttccctccactattgtcctatgaccctgccatatccccctctgtgagaaacacccaagaatgatcaataaaataaataaataaataaataaaaaggaaaatagttatctgctgaggatggcagggctgtgcaccaaaatcttaagggcctgtgctgcgactcacctataggcgcctgccaaaggctccaaacttatctgccactgatgcttcgagcaatattggatctgctgggtcacatggtccctgtggcagagtagcatgcacggacacctggacctgctgcacggccttctcttgttctcaacaccagcagcctttcaggtcacttgttacatgagctggagcaacacacccaaatgaggaatatgcttcatcaaaactccaaatagttcaacttgcattataattcagctagccacaggatgagattctgagtttgattttcagcaatctcagctgaggggctacctgggctaagggtttacttgagggcacacaaaggagttttcaggtcatttatgtgatacttgagttgggaattggaatccctgagctcattcttttatttcccctttgtctagtgacaatagaagcaaccatctagtattcattagtttgctgaaaatgtttgaaatgccctatacacagtcacccagatcctagcttcttataaagtggttgataggagtctccaatggtgatatttgtgtatctctattgccagattatgccatgaactatcagtgctctattattggaaatagagttattaacaactttaaatgaaatctgtttagagaaccaattccagaaaccccagaacaaacccagaacactcattctcaaaattctgttcctctagaaccattatctgtaccaaaatctgtattagtcagagtttttgagaaaaacagaaccaatatgatatataatgggctcacacaattatggaggctgagaagtccagttggcagcctggagacttgggagaaccaatgatgtagttctagtctgtgttggaaggcttgagaaccaggagaactgatggttgagttccagtccaaaagtcagcaggctcaagatccaagaatagcctatgtttcagtttaagtccaaagacaggaaaagaccaatgtcccctctcaagcagtcagacaagaggagtcccctcttgctcaggctttttgttgtattcaggtcttcacttggttgaattatcctgcccacattggacagaacaatctactttactcagttcaccaatccaaatactcatctcaaggagaaacaccccacagacaaacccagaaaatgtttagccaaatatctgggcaccctgtagcccagtcaagttgacacataaaattaacaatcacagctgttgtggaattaacctaaatgtctataacgaatgaataaagaaagtgtgtgagtgtgtgtgtgtgtgtgtgtgtgtgtgtgtatacatatatataaaatatacacaatggaatattatttaaccataaaaatgacatgctgtcatttaggcaatgtggatgagcctggaggaccttatgttaagcaaaataagtcagacacggaaagatgttctcattcatatgtgggagctagaaacattttgaactcatgaaagtagagagtagaattgtgggtattagaggctagaaagggtagagaggagagaaggctgggggaggctgggtaccataccaaattacagttagataggaggaatgagttctgttcagcaacactgtagggtgaatgtggttaacaataatttattgcatattttcaaaaagctaggagagaggattttgaatgttcacaaaacaaatgaaaatgtctgaggtgatggatatgttaattatcctcatttgatcatttacacattgtatgctcatatggaaatatcactctgtatcccataaacatatagaattattacatgtcaactaaaactaaaaggaaaaaattaactatcacagagatgagccagaagctcataaacacctttttgaagtcactgtcctgaactcctcacatgctatgatttccctggtactttccagctcctaggagctctccttttcagcgctccagctgagcaagggtattatttacttcactctgcaccttgcttgtcatgaccatgcccacatccagcgtcaagcaataaaaggacagaaagagtaaaaaagcaatggagtgcacccacctgcttagaccatctctctagttatcaggaagtgaggtgccagtgggctgcaggggactggggcataagaaaatggagtaaagagaaaagagtttcttgcactctctctgcatgttaggagactgtttcctgctcctcagccagatcaggaaggcttctcctgagccctctctgtttgcacccaagtccacttccaagttcaggcgtccttgaagacagactaagagacaccaaagaagggaaatggtaaaactcaatgccagatcagtgttactttgaattatggtgttttgttttgttttgtttcccaattctcctggggttatttggttttaaaactcttcaaatagcttctttatgtattctctctgatttagtgggagggacacagtgaaacgtgcttactccattttccccaaaactgaaattcccttaatttttttgaaactaaaaatgaattcctacaaacatatgaattttttttaatgctcattgttttgaaataattatagattcacaggcagttgtgcaggagtgtacaggaaggttccttgtgccctttacccaactgccccagggctagcatctgacataactacaatatcaaaacaggaaactgacattggtacgatccacagagcttactaatattcaacgaggtagtgatgtgctcacttgggtatgcgtgcatatagctgtctgtaatgttatcaagtatgtacttgtacctatcatcacaatcaggatgcatacctctgcaccacaggcttccttatggtaccactttagaggcacacatccacacgtccttcactccatccctaacccctggcaactattaatcttctcttcatctcagtaattatgttatttcacaaatgctatatacgtggaatcatatagtatgtacctttttaaaactgacttactttttaagattgataatttatttgaggttcattcaagttgttacatgtatcagtagtttgttctttgtaatgctgggtaatattccataatatggatgtaccacaatgtatccaatcattcaccattaaaggacatctgggtagttttcagtttggggttattacaaataaagctgctatgaacatttgaatataaaattctgtctaaaaacaagtttttatttctgtactagaaatgcccatgtttgcattttcttggtcctatggtaagtacattttcagttttataaggaactgccaaactttttccagagtggctgtaccattttacattttcaccagcaagtgtgggtgctctggtttctctgcttccttgccaggatttgctgttattctgttgttgttgttgttgttgttgttgttgttgttgttgttgttgttgttggagtctccatcgcccaggctgaagtgcagtggtgtgatctcagttcactgcaacctccacctcctggtttcaagcaattctcctgcctcagcctcccaagtagttggttacaggctcataccaccacggccggctaacttttgtatttttagtagagatggggtttcaccctgttggccatgctggtctcaaactcctgatctcaaatgatccactcgcctcggcctcccaaaattctgggattacaagcctgagctactgcacccagcctagtgctaatcactttttaaaaagccattctaatatgtagtgatgtctcattgtggttttaatttgaactttcctgatggctaatgttgctgaccatcctttcatttacaaagaatattttctttggtcaaatatctgttcatgtcatttgcacatttttaatttgattacttatttattttatgttgagttctgagagttctttattcttgacacaagttctttgtcagatatgtgatttgcaaatattttctctcattctgtaacttatctttccatcatcccaacagggtcttttgcagagcaaaaaaaatttaattttgatgaggtccaatttatccattttttttcttttatgaattgtattttgatgtcaagtctaagagctctgcctagttcctggtcctgaagattttcttctatttttttcctgaaaatattacagtttgacattaagcccatgatccttgtgttatgttttgtataaaatgtgaaggtcgggccaagcctcatctctttgcctatggatgtctgattgttcctgcagcacttgttgaaagggctatcactcctctactaaactgctgttgcatttttctcaaaaattaattaagcatatttctgggtggggggtctctgttctgcaccagtaattaatgtgtctatccctccaccagcaccatactgagttgatcactgtagttatagagtaagctttaatacttggtacagtgatttcttccatttaattattctttttcaaaattgtttcagctaacctagggccactcccttttaatataaagtttacaataagtttgcatatgtatacaaaaaacaatgccaagatttagaattgtattaaacctgcaatttgggggaagctgacatctatgttgagacttcccatccctaaatatggcatgactctccatttatgtagatatttgatttctttcagcagaattttgtaatttgcactatattctcctgtatatgttttattagatttatacctacatattaatacttcatgtatttcgagcagttgtaaatggtattgcagtttttattttggtttccacttgtttattgttaccatagagagatgcaatttgtgtacgtgtgttattcttgtgtattgcagccttgatattctcactctttatatcaaggatgttttgtttattccgtgggactgtttatgtagatgattatgccacgtgcaagtagtgataattttctttctttcttttcaatctgtgtactttttatttctttttctggtcttattacactggctagaacttctagtactatcttgaattaaaatggtgaaagggaacattcctgccttgttcctgctcttaaggggaaagcattcattctttcaccattaagtgtgatgttaactgtagatttttgcaaatgctgtttatgaagttggaggaaattaccctctattccaagtttgctaagagtttatatcataaatgggttttgaattttgtcaaaaccttttcctatgtcaattgataagatcatatgatttttcttcttcagtttacaaggcagaatatgttgattggcttttcaaatattaaaacagtcttgcataacttgagtgaaattcctcttgattgtggtctactactctttttatgcattactaaatttgatttgctaacattgtcttgaggatttttccatctaagcttatgagccaaatcagcctgcagtgttctttcctctgtcccttcctccttcctccctcccttccttcctttgtgctgtctttgttttgttttgatatcaaaataatgatatcatagtcctttctcttctattttctggaagagattgtgtaaaactggtgttgattcttctttaaatatttggtaaatactccagtgaaaccatttgggtctggatacattgtgttcaggagctttttagttacaaatccaatttatataatggttataggactattcaggcttttatatatttcatcttttctgagttgtggtaatttgtgattttcaaggaattgatccattttttcctaggctgtcaaatgtatgagcataaaatttttatagcatttttcatagatgcagcctcttttgtgatatttcttgtttcattcctgatattggtgatttgtgtgttatctcctttcatctttgttgatcatgctagaggattatcagttttattaatttttttaagaacctgttttttatttccttaatgttctgcattgctttcctgtttttaatttcatcaatttctgctcttcactttccgtcctatttgccttaactttattttactattcctcttttagttttttgactactggtttgagaactttccatattactaaggaaataatataaggatttagtgctataaatttctctctcagctctgctatagctgaatccctcaattttttttttaagacagggtctcattctgtcaccgaagctggactgcagtagcacaatctccacttactgcagcctcaaccttctgggctcaagcaatccccccatctcagcctcccaagtaactgggactacaggtgcatgccaccacacctggctaattttttgcagagatagggatttcaccatgttgcccaggctagtcttgaactcctgggctgaagaagtgatccacccgccacagcctcccaaagtactgggattataggagtaagccattgcacccagccgcatccacaaattttgatatgccatattttcattgtgttacttgcgttttaaaaattccctttgagacttcttcttgtccacattgtatataaatgtttactgcttaatttccaagtgtttgcagatttttctcctgtctttctgcaatttatttctagtttgattccattgtggtcagaggacactctttgtatgatttcggtttttaaaaatttattaaggtttgttttaagatctagagtctgttctataagagcttgaaaataatgcgtattttgctgttgatggatagagttttccataaatgttaattataccctattggctaataatattgttcagttatcctatattcttgctgatttttttgtctagtaattttacaaattctgaaagtgagatgttgacatatcccaactataattatggatttttctatttcttttttaagctctatcaggttttgcttcatgtgttttgaagctgtgttgtttggtgcacatatatttaggatcaagatatactcttgctcttttgttattatgtaatattcctcttttgtcctagaaattctttttgccatgaactctatctgatattattatagcatctcctgcttttttgaaagttcctgtttgtttgcatgaaatatttttttttctgttctttcacttccaatctgttaaatacctatgccatggtattagaactgaatatcttatggacatcctataatgggtcatatttttgcatttactctgctatttctgtgtttttcccagatttaaccaaactgcaaagtctgagggcatggttcctaaaatttccctcattcctgacaccaacagcaagttttggaggtttccaaagcaccttaagtttcaatcatttgctggaaggactcattgaaaactgctctacatgtggttactgtttactgcagggaaatgatacaaatcagaaccagcacagagggcagggctaggagggtctgtgaagcctctgttgtcctcaggtgcattactctcccagcatccacgtgtgacaataccatgaagcactgccaacctaggaacctcacccaagccttggtgtccagagtgtttcctggaagtgcattgtgcagccataattgacagatctgttggagactggttggaactctgtcttcacctctccctttcccggaatctggggctgacagcacattcctaggggggcccaccatgagccagctggtagcataaacttcaggtatggtctgaggggcccactatgaatagcaaagacccttctgtcacatgggcttcaggactacttaccaggagccaggacaaaggctagacctctctttgggctaggccaaattctttaccacacagaaattatatttaggactcaaatgtgccatttttatttgctttctgcatgtttcttatgtttcctttatcctgttttgtttcacttgtcatggattagttgaacagtttttagcatttcattttgaattatttattcttttgggtgcattgctttgtatcgttttctaagtggctgctctaggattgattataatatacacatgtaacttatcacagcctgctggcatcaatgtttcaccatttcatgagaaatatcaaaagcttacttttatttccccttttcctcccccacttaaacatgtaattatcataaatatttcctcttcagatgtagagcaccgcagcagatgatgttattattttttgcttcaaccataaaatacaatttaagaaactcatcatagtctattatatttaccacatgattaccccttctgttgttgctatttctgatttccttatttcctttttgttaggagagcttccttcagccatttattaagggtgggttttctggtaacaaattatcctagttgtccttcctcttagaatgtctttatttccccctcatccctgaaggatacgttcactgaatagggttctgggcagacagtttttctcagcacctggcgatggtgtgttgcccccctctacctcgtggttttagagaagcccaccatcctcagaaccagtgtatcttaatgcatcatttttctctggtggtttaaaaaatttttttctttgtctttcctttcctgaagttccattatgatgtgtttatcctatttggggtttgctcagattcttgaatctgcaggtttatttctttcaccaaatttgggacgtcttcaaccactgtgcctttgaatactttttcaccacacattccttcctctcctcctgggactctggtgacaggaacgctgggccttttgtcactgtcccacccatccccaaggaggcattcatttctcagtctcctatctctccgttgttcctatgggccagctctattaattgtctttgaatcaacagactctgttctctgtcgcctccactctgctattgaacccaactgcacattttttcatttagttattgtatttttcagttgtatgattttcattttgttcttgtttcaagaaaattcaccattgttttctgaagcatttttatgatggctgctttaaagttctaatatctgatttatcttgattaatcttattttgctatttaagttgttttttgttttgttctgttatgtttttgagacagagtcttactctgatgctcagactggtgtgcagtagcatgatctcagctcactgcagcctcaaactgccgggctcaagcggtcctcctgcttcagcctcctaagtagctggcaccacaggtgtgtgccaccacagctggctaacttttaaattgtttgtagagacaggatcatgctgtgttgcccaggctgatctcaaactcctggactcaagccatcctcctgattgaccttccaaagtgctgggattacaggtgggagccccctcacctggcttcaagttgctttttatgtttcctgatgtgacaaataatttcaaatatattctggagatttcggttattatgtaaggaaactttttatcctatttgaacattccagttcagtccatggtacccttatttggtttaccatataggccccagcctgctttaggggaaatgtagagtcaatgacaatttggttttcaaagccctccccgtgctattctggtcgggtttgttcttctggatctgctgggcctctggttcaatccctgcgcatgttgccggggttgccctgtgcggtgggggtaggttaaggaaacgctgggtgctgggtgtggtctctgagccacggtcagcagagcctgttgtggcctgggtgtgatgctgagggccaggcctgaacggagctgctgtgacatggatcagggggaatctcctcgctgggtctccagtgagatgcccttttcagtcctttcaccagagagaacaggctctttttcttttcttttttccccctgcaggttttggcagttacaggttgcagggttctctgggcccatccaggagatgagagagaaaaagaaaactcagggcctggtacagcgtcacccccaaagtcccaaggttcctggacagcctttcttcctctccatctcctagagtcctcttacgtctgttaaattatttccagggtgtctagttgtatttagagggcagatgccacctcgtcatagaacaccagggtccactctccaggcatttggaaagagttgccacgaggtcctcggaagggtgtgacagttcacacgcccaccagcagcgtttccacgtctccatttcctctgcccctgacagcatctaatgctatgatttttgtttgaaaatttggcttttggttcctttatgaggtgattaattaatacaggctgctggctccttcccatgaatccaaaccttggagatgccatcaaagggatgacagttgatggagcccagaacctaagaggaaacccctgagagcctcgcagaggctgggcaaatgtggtggagtctggggcaggaggggaaccacagtctgagtggaggaggccacacagcacagcccgggccagtctgcagctctctgctccggggcccacctggggctgtcatctgccggccctgctttcctgtagaagatcccacccataccagccccaggaatccaggcaaggccagagcacctcaggagcctcctggagtgatggccatgacacctggtcaagctggctggtagcccctgggcagccctcctccccagcccaaggacagccaattacagcacagggcagccctggacagacagcaccagctagaaggacggggcattccctgcagaccagagcagcccccggggatgagcaaagagggccccagtcatcctgccagaggctctgccccgaggagcccctgcctgcctccctgaaacccaccaggaaggtgtcaactggggcctaggacgaaggcagctgaccgtccccagggaacagagagcggcctgaggaaacgagacagccaggggagtgaactctgggagggaaaaaccgcaaggtttttccttggaggagggagcagatgagcgggtaagaccggcaaatccgtcacataccctcaggacgcagggagcgcggctggaatcagcagttatgcagaaaacgcaggccaggttactggactggaacatgcgggcgcttaagtgatgaacttggtgggaagtttggagagcagaaaatgaacgagtgagacaagtcaggctctgagctcttttagaaggatctgaagggattgaggaggcagaggtgagggaggagaaatattcagtgcttagaagaggaaaaatgaatagataagaggaggtatctgaaaaatgactaggaacttcccccaattaagaaaagacgcacatcctcaaactgaaaaggcctgcagagcgttaattacattttaaagttaaaatgttctgtgtaatttcaaagaaaagcatctacattttgagtcaaaattgctaaaaacttccaaagagaaaaagcaggtaaccctcacaggaacgcgagtggtgctgacattagaattgcagcacagacaacggatgcaaaaagaaagggggtgacagcttcagacgcgagaggaaaggaccctggaacccagggctgcgtcctgctcaccgccatgaaatatgggcacgcaggaagccatcctcagtcctatcagcccccttgagagtcaaccccaaaaacactcttggagaaatatttcagcaagaaaaaggagccagggagaatgctgccaggtctggggaggagtggtgcttcccgagcgtgaatggttcactgccatctaagtaagcaatgacctacgcgtgtgccgcacagtccagcttcctcagaggcggtggtggcctggtggaggaatgtgggctggctgggtggccacagagaattactgtttccattaaaaggaaatgtgttctggccgggagccgtggctcacgctgtaatcccagcaccttgagaggctcaggcaggtggatcacttgaggtcaggagttcgagaccagcctggccaacctggtaaaaccccgtctctactaaaaatacaaaacttagctgggcgtggtggcaggcgcctgtaatcccagcactttggaaggcggaggcgggcggatcacttgaggctaggagttagagaccagcctgaccaacatggggaaaccccgtgtctactaaaaatacaaaaattagcctggcatggtggcacatgcctgtagtcccagctactcgggaggctgaggcaggagaatcgcttgaacctgggaggtggtatgttgcagtgagcggagatcacgccactgcactccagcctgggcaacagagcaaaaacctgcctaaaaaaaaaaaaagtatcacatggagacgtgtgtccgtttgggactgttttccagcctttccacactctctccctccccatctgtccctccatctccaccaagctgtgttttgatgttgtgtttgcatgatttggtgtatctggcattttaacatttgcagggcaaatttctcttcattttgggtttttctctgcctgttcttttgtgtttattctttcagataaacttaattctttttcctttaatgtcctctgataaaaatatgcttcagagaccactgcatgtcactgggttatcagttttaatagctgcaaaaattacatggagtgcttagaccatcatttatttaaggagtctattttggttgttttcacttttcccccatgcccagtggcgatggcttttgtgcagtgtagaggttgaaagaaagggagttccactgcttaaactcaaaatgtgtttctactatagtgggccctccctacctatgggttccaattcatggattcaaccaaccatcagttgaaaatattcagaaaaagaagtggatggttctgtctgtactgaacatgtacagacttttttccttcctgttagtccctaacagtataacacctgtttccatagcatttacagtatacgaggtattacaggtaacttagagatggtttcagctctacaggaggatgtgcgcaggttacatacagatactatgtcatgcacaaggacttgagcttcggtggattttcatatcttcaggggtcctggaaccaatcccctacagaatcctagggatgaatgtatttgccagtcctgtgacttggaccaggcatttaatctttcccagcctccatttgctaatctttataatggtgataagtgttaaacccttcactgtttcagtggggcacatcccagcacacgctggtgaccacttttctggagtagattatttgaagcaggattggaatcatcagtcagggagtaggtacatttcccctccacatttgcaagtcacttcgtgttcctaaacggttgtaccagatcccatgtcctcccacagggcaggaagtgcccatctcctgactccactggtggtgaaggggctcagggcttttcatcttgccagtctggtgagcacaaggcgcttttcattattgtttacatttgcatttttattagacagcaggagggttttagcatctcttcaagtgtttattggccattctcctgtctcctgcaatttgtgccaatcctctgcccatttttctgttgggttggttgcctttcacatattgattttgtaaaagctctttatatattctccatttaaatcccgtggctgcttataaatgttataaaagacttttccctggtatgatgcttaccttttgacgtgtccatgaggcctttctgtattcagaggttttcaatactcgtataatcaaacctggtagttttccttttggttttgaggttgtgtcttgtttgggtgagtctttcctacccctttgactacagaaatgccctttcatttataatatcctcctattatgaaacatatttccacattttctaaatttttaatttttagctgagaaataaattagtaatgattaaagtattaattacttttatcttgttattaattattggttttatttatttacatgtagttggcttacatttagtttagtttaacttaattactttaaagtaatgtataaatatcttcagtttgtaccgcatgttctcactcataagtgggagttgaacaatgagaacacatagacacagggaggggaacatcacacatcagagtctatccgggggctgggtgcaagggaaaggagagcatcaggacaaatacctaatgcatgcagggcttaaaacctagatgacaagttgataggtgcagcacatgtatacctatgtaataaacctacatgttctgcacatgtatcccagaacttaaagtaaatttttaaaaaaattaattaattaaaaatatatatcttcagtttgtaaatgtcccggcaacacgggaacagagttaaaagagtgtgtgtcgtccttagctgctcccaccccctcatctcctccctagccatcccagccaccagtctggcctgcgcctttcaggtttcttcctagacgctggcatacatagatcactattttctgccatgtggtatcttttaaacacacacgattgttttgtgcagaaactttctatttttacctctcataagtgtcctgtgggttctttccatgtcactgtgatgtgtgtgcgtatgtgagattcaagttcagcttgctaatcttgtagaaagaattacgctccacttcccctgtgctctggccctccctaacacagcagcccatccctggaggctgatggagcccctcgagcacttctgcttaccatttctctttgttctgtttgttcaggttttctgcctcctgctaagccaatttatacattccaagaaaatcttccatttcatccaggtgaaacagaacctactggaatgaagctggcctcccgtctccttgatttgaagcagcttctccacattggttattatgccatttttctaaatctaacgttttaaaatttgtgcctttcctttctcttttgcttgacttcccagaggtttttttaaccgtcttttcaaagaagtggttttgggttttatttatcaagtctacttttattatggctgttttaaaattaaatatatttatttcttgtttcccttaaaaaagcttcttgtatgtttacttagtttatataattttatatgtcttttgttgaagcatattaacaaacacttgcagctataacatttcccctgggaactgctttggacatatccaaagattttgataagtcacacacttattgtagtttgtttctgaaaagtttttcattttagtttttattttctcttttattcaaattatcatgcgctttctccttttatcctgtttctgacaaattaatctaaggatataaatctctccctaaatgtcaattttgttgagtttcataattttaatatgtaataccctattgctattgagttccaggcattttataattttcattgtgaaaactaactttgtttccaaaacacactttttcttttttttgagacagagtctcactctgtcgctcaggatggagtgcaatagcacaatctcagctcgctgcaacctctgcctcctaagtttaggtgattttgttgcctcagcctccctagtagctgggtttacaggctcttgccactatgcctggctaattttttgtatttttagtagagacagggtttcgtcatgttgcccaggctggtcttgatctcctgaccttgggtgatccacctgcttcagcctctcaaagtgctgggattacaggcatgagccaccatgcctggccccaaaatgcacttttaacatggtctttgttactgcatgtttctaattttgttgctccctggtgagagaatgtgatttgtataacagcaattctgggaaaggggctgaagcttcctgctcctttagcacagctaattttcccaaacgctgtccatgagcttggaaagagcattgtactctgttgggatgggctcaaatctctctgtaaaaatgagtgttcttctgttgttattgttttggtttttgtttgttttgttttgttttttgtctcacttgttttgtttgctcagatcttttgatgatctggataatcttttaatttatgcaggatgtttctctgcttgtgcaggctggtgggatgggggactggatagaggacaggtgtctgcttgcccaggactggcaaactgtcacttgccctggttgtgccttgccaggagctcccgtgcctgtctctgagagtgtcatgagctcagtggtggtagttgtgtggtggatgcacttccccctgggttggggggtgggtggctggtcctaactgtttgttgttgcagatgagacacgggcgcacttctgcttcctgatggatcttgtcagtcgtttgacttcttcctggtctgggctcctgagttggccctctgcaggccaagcaggaatggagctggctgctacaagagttccttcactagagggcatctctcctctctcctcccacacatgggaacacgcgggtgggctttcctccgcccactgtggtccacagcccggctttccactcctcaccctctgctctcagacagacctgcttttccctggtgtctgtgagaggtgattcttcattgtgccaagaatgtggatttttttgagagcagggactctcacagatatttgcacacccatgttcaaagcagcatgattcacaagagtcaaaaggtagaagcattctgagggtctatgggtgagtggatggacaagcgaaatgtggttatgcatacagtagactgttactgaacctttagcaggaaggagattctttttttttctttctttttgtggagaatggggtctcgctatattgcccaggcaggtctcgaactcctgggttcaagctatcttcccacctctgcctccctaacagctgggataataggcatgagcctataatatcacccggccaggagggaaattctgagaggcatgccaacacgcatgagccttgaggacattgtgctagatggaataagccaaccacaaaaggacagatacattgcgatttcacttacatgaggggcccagaatgggcaaattcagagacagaaagagcaatggtaacaaaaggagggagctggtgttcaatgggttcaatgctcagtggtgttcaatgggtatggtttccttttgggaagatgaaaaggttctggagatggacggtggtaggggatatgcgaaaatgtgagtgcacttaatgccagttaacccacactaaaagatggtacaactgtgcattttatgttaggtatattttcaccacaattaaaaaatttgaaaagagcttggattttggagctgatctgcctgtttcagatcctgccatgaagttctacgagcttgagccagttcctgggcctcctggtgcctcagtcctgcatgtaacacggcgagcgcgtgtgcacacggctctgggagttctcgtgcagcactcagagctcagcgtgggcgagggcgtcacccttcagggggcgtccatggggccttggagaagggaggctccggggcgccacagcagtctaccgggagaggccaggccaagcgcttgttcacccgcagccctcttagggaactttcacatgcttctcccactaggcctaggcacccctccccaccctccctgccctcctggttccctgatcctcagtgaccttgtccttcaagactgaactccagagtccccacccgaggacccgcagtgcccggccgccgcgagctcgcggggtgtatgcccgccccgaggctccaccgcgcctgtgtgccgggaagcctggctccacaggaccctcaggcactgggcgcgccgtcgctgcagctgccaggagctcctgaggaagtggctcgaggccccggggcgggtcaggcgtagggtgggcccgctgccctcacacccgccccggccgcacacaggaggcgcgatcagcagagtcgttggacaggtttggacaccggctgtctctttcgggcctcggttttcgcgtctgaaataaaagcgcgcatcctggccctggcgcggtgcctctgccgcggtagaggtttccaccatgagcccagtgcgccttccaggctcgagggagagggagtgtgcgtgcgtgtgaacgcgtcacactcttgtgtgaacgcgtcatacgcttgtgaaagacggtgcttgtgcacacgcgtgtgcgtgcgtgtgaacgcgtcagggtacccgaggatgcacacacgcacgtgtgagtgtgcgcgagtgcgtgctcagaggacagctctcagcaggctggggacctccttcctctcacccctgagggttttgggggaccagcccccgtatccgggtgctgcgggatcccctgaggcgagcgcgcaccgctgtgctcgggctccggctttgtggggacccggccttcccggcccgcaccacgaggagttccacgcagtagccacgaggtggcaccgcagactcgctaccgcggagcgcggcggctcccggctcccagcagcctcgcctagggctgtggccagggcggtcagtctcaggcccaggccgctgctgccaggaaaagcaggaacaatcgccagtcacgcctgctgatgcccctgaagtgcttatgctcccaggcatgggctgaccgcaacgtgcattctctccttttatgtccctactgtttggaaccctgtttttgtttttgtttttgtttttgttttgtaaatctgccgcttaaaatacccagggtggagctaaaagtacagacactgctcaacttacccctggctgcggcccgataaggccgctgagagtggaaaatgactgagtccacctgactaccgaatagcacagcgtgggggcctaccttggcctgctgagaacactgccctgagcctgcggtgggcagaagcatcaacacgaagcctgttttgtagtcaagtgtcggatacctcatgtaatcattgactactgtactgaaagtgaaaaaccgagttgccgtgtgggactcaaacgagggtttctgctgactgtggatggcttttgcatcactataaagttgaaaactgttaagtggaactgcggttaagtcggggctgtgtgcactagagacctgagttctgccgctccatagctgtgtgactttggacacatatttgagcctgagtgtcttctacacaaaatggatttcttagcataacatacacatgtgtacgcgcccgtgagcatacgcgtgtgtgtttgcatgaacacatctgtgtatgcacgagtgtgtgcacatctgtatgtggctgtgtaagtccgtatgtacatttgtgtgcatgtctgtgtgtgcatatgtttgtacgtgtgtgtgctgtgcatgtgtgtgttaaggccctggggtggagctgagttgttgaggggagatgctgggagggcagccagcaccaggtgtttgttggccaggagagaagctgccatccaggtgcactctggggctcctgcttcagtggcacaaggcttcgggattgaggaagctgggggctggagcagggcagtcctgcacctcatgggaggtgcagagtgaggtcaggaggatggagagagtgccagagaatggggggaatctgaggcatcaggaaaggaagacacaggccacggagagggcagctgggccctgggtgaggccggccctcaggaaggaggtgccacaggtaggggagtgcccagatggagagcccaggggtatggacccacgggtgtatgacagtgggggtactcctgaaaccgcagtattatccaacaagcagggttgggacaactagttatttcatttaaaaaaacaggtcaatgtcagtcctcattctatgctttaaaataagctccagatggactcatgctttacatgtaaagaagaaaaggcaaaaagaaaataaagaaaaggcttgtaagcaggtagttaattgggggcaatcccaggatgcaggagagaggggatggagccacagcaggtctggggaagggagaaaagccggccccgagaccagggcccaaggacccattcaggccagcagtgccttctgtgcacttccgcaaggtcacacgttcttccaaagttgccatcatggagaggtaggcttccacgtagtcttgactccactcgatttcaatccttgggtggcttttcctgtgatcacactcagccctgatacagccattgctggggcctcccctggctggacgttccgcttttggtccacattctttcctcctgccctgaggctggccatgggcctcctgaaggctagctgggaggacctcccttccatggctgtgctcttgctctgcccacgctgtcgcctccatctctacctccctttccatcctcaccaccagcgctcgagtcagtggggagcttttcactcaccaagcccaggcaggtgcgtcacgtgaatttctcttgagcctcccactagaggtagtggcactgttgtcaccctatctgctgaggatatgctggggctggcaggggctacccaagaccaaaggtgtcgctgtctccatcctgtgcccacccagccctgccccctgggatcccttcaaatctttttttttttttttttttttgagatggagtcctgctctgtctcccagcctggagtgcagtggcgtgatctcagctcactgcaatctccgcctcccgggttcaagcgattctcctgcctcagcctcacaagtagctgggactacaggcacccaccaccacacccggctaattttttttttttttttttgtattttagtagagacggggtttcactatgttggccaggctggtcttgaactcctgacctcatgatccccctgccacagcctcccaaagtgctgggattacaggcatgagccaccacacctggcccccttcaaatcttaacagagaagccaccaaagtctccttgggtccatcacatggatggacctcctgggcccttcagcccctgggcttcccttgaggtcctggagctatgtgggctccagctctgggaaggtggacccccacgtgtgtgtcctgccgtcactgtctctaaggagtctggctcacactaagtgagccataaggccttgttcaaggtcatctgtcccactgatttcagacgcatggtggagtctgaaatcatctgtcccccacagtgcattcagagccctgtctggactagggcacacacacatgcatgctcatatatgcatatgcacatacgcacacacatatgcatatgcacatacgcacacacatatgcatatgcacatacgcacacacatatgcatatgcacatacgcacacacatatgcatatgcacatatgcacacacatatgcatatgcacacacatgcaaggctgcaaggctcatgcacacacacacatgcacacacatgcacacacatgcacatgcacacacatgcacatgcatgctcacatgtacaggcactcatgcacctagagccttctcatccttcactttgagtcccccctccccttgcccatccttgcccatccttcaagggctcagtcaaaagccatcttttacaaattgtctctggttgactttcttttttttcccctcttagaagaagcgatgctgtcctcagtcatcgagcattcactgggcgcttcatgtgtgccaggccccgacatgggtcttgggcatgttccagttctcatgtcctcagggctccttggtgagtcgagggtgaggaggacacggaggcacaggaggccacggggcaggtctaggtccactcagcctccagagttcagccctccctgctgagtcggggtgagcaggacagatgcctgctcctggaacttggtgggtgaggtggacaggcatgcagggaggcgccaggctcaggggctgtggaacagagaaaggaagcttccaggacatcaaacaattcctggagtgccagggcaagaggggaatctgggtggaggaaaacgtgaacagggcagaggttggaggtggatgtggcccccgagcacgttggaggcgactgaggtgcttcttgactttgggcatcttcgttcatccctgcatttgcacatttgttgaacacacctactgagacacttgttttctttccatggtccatacattaggaacatagagttagcttcctggggaactttttaagaagtattcttagagaagaaaccaggaggcatcgttgtgggatgttggtccaggatcttgggtgtgtcctttggtcttttgtgggtcaggttagcaggaattgtgtcctgaggtgttgggactgcaaagtacaggttccctcctgcccacactgatgccttcagggaatgacctgtctgctcttctaagaagaacacttaactcagccttggctgacctcagctacctgtgctttcttcagccaggctctgtgttttgtgcttttactctcaaaacaaccctattattatccctgtcccacagacgagatgctgagcccctgagaggctcagtaggtgcctgaaggtcttccagccaggaggtggcagagccagggccggcctggcctgaggactccgaagctcccatgggcacagctccttcatgccagctctgtgttgggattttctgtggttgtcacagccatcttcctggtcagctaagttacagacagggtgaaactaggatggccgagctggaaccagagctcattcctgagcagggcacctgggccctgcctacggtgctgggcaggctcctggtgtggaggtcaggctcagatcctgcagtccctgtggccgtggggcttttctaggcaccctcctgactgctaacaccaggagggcctatgatatgggaccgctgccccatgacgtgtgccaggtttctgcacgtgaccactgggaaaggctggccctgggctgggtggatccgcactgcctgctggcccctgcacccagatggtgcagcccacacccctctgatgcccacccacgcccggctctgggacttccctccttccgctgtgtctgaccctggttgcccttgttctgccactggcttgtagcagcccttccggaagccatgtcctccagggagatttgattatgtcctggtggtgcgacctcgctaatgcaatcaggaagttttctcaagacttcagctgctttgttggcagccaggcctggctctcagcagctctgcaggctggaagggcccaagagacccttcacccacccggtgtctccagcagcagggaggggtccggggcacagcctattgctgctctgctctcctcccttcttggggtaagctcctttgctctgattttatttggaatcatcgagagcctctatctgtctagaaaaagcgcttagcaatgaggaatcagcactgcagagaatactccagaaagcagccattttccatcaagattaggctcttaattgaaaattttaagaggagaggaaattaggggagaatccagatattctctccattatggtaatcagctgtaatcagagcctgagagctgtactcaatcccgggggttctcccaggattaccagagctgccacagtcaccttcaccgacctgcactggagtcagtgggaggggctggcggggtcaggggcactctggcaagtggatccaggagggctgggctggatccagggggctgagttcagagggaactctgcttagcaagtgtgaaacacaggactgggccttccaggcagagggaagattgagaactgcggctgagcgagtgcgtccaggggccccagtttagttgagggtctaagttttcccagcagggcaaggttgagggtgaggatgctgcaggccagttttctatggcctcagagtgaggacaagaagggggagatgggccacagggatgagggtgcctgctccctgcagcagggtgcacatcatggctgtgcagaggcagcaggcggcaggtattaggaagaagcccttcccgtgtgtgtcctaggggctgggcacaggctgggcacaaccctttgctcacggttgcagaagcccatccacatggggtcctgctgaactggcttcgtggggctgggaaggactggcctggcctctttgctcacttcaccttatgggcagtgtcctgcaggtttctgtgagcagagcagacagaaaggagatgcccagtgacgccagctgtcccccgcagagcttcctggagcctgggctctaggctgagggtccttgaacagacgtcatctccctggcttcagcagaatcacccacaaacccaccctgtgcccaccctcccatcacagagagcagctgctggagaacaaggcatgagactttggagacctggaggagcaggagacacaggagacaatggccagggtggtcatggtggcacggctatgccatcactgatttctgcccacccgccccctaagtctcacttgctgctactctcaatttcctacttaatgcttcggagagcaccagtcctgagatgagaggcgggatgttcactctctgggagttgagatggaacccaggcagttagaaaaaagtgccacaaccacgtgccggacctactacttgccaggagcttcgtgagtcatccaattcctaaaacaattgtgctgcgtatgctccaccacgcctgggcgactcggggaaatggggctgcgggaggctcagtgacctgccctgggtgacacggatagcgtggatgccctgtccatgcatggggctgtgctaggaggacaggaccatccccggaagctggtcctgtgtccactgctcacggtggcagctgcttgggctgacaaccgcccctccctcctgctggtgagtccttggatgtattcaggcacatggcagcaaggtctcctgtgtcccagaggcgactaggacccacaagtgagcagcaggtgccccactccttcatgctaaggctcatcacgggacgaaacccaaggtggtattggagccaggggctgtggccatgacagccacccactccagacgatatccacattcggaatagttcagagtggcctgccttgatgacatcacgaacttctccatggaaatgtgtcacagaaccagaacttaagggcatttggatgaggttgaggtgagatcaggtcacagaagaacgttctcaagttaggtgggaaacagctggagactctgggatgtcctcaggacctttatctaagcaaacacatgataaggtctttcccaagaaataagcgtggctttttgtcctggttgaggagggttgttgtggatcttttcccccttttaccttggcttccaggaagctcagtgccaagttttatgctccacccaggcctactatccttggactggtcctcaggtgcagcccttggtctctcctttctttatcgcatgagcccgcttggtttctgtacattttgtccgctggtgctgacggctggacaccctttcctgaaggagatggggcatagagtgagtggatgatgatgggctgtgacagggcccactaccaaggatgtgggctacgaggtgtgggctgggaaggaggaggaggaccctgcacctcagggggcaaccaggagcacattctggggagcacacacctgcggtgttatcacggccactgcccatgtcttggacactggaataaacaggatgtggcgaagccttctgtgtatgggggaagacttccttactcgccactgctgtcacgctctatggccatcttgacccatcactcaggcaacatcagacgcgtctctctgttcaagggctctgcccctaaccttgtgccagaaagaggcttgacagtttgtcctgtctcgaggtttcctctatatctcttgctggggctcccatagactgttctgatttttactgatgaagacagtgccatggtgagcctagcagtgcacacagctcttctctttcccaatcatttccatgggcgaacccctgagtgtagaatgaccactccagtcagattgtgaatacagtgaactgtgggccatgggctcccaggacactgctccggcctggctcctgcacccagactcattgctgttggctttgccatggtaacactagtttggtataaaactgcaccgtctccttctgtctgagtttccttgactgctgtggtggttgagcagttcgccctactttgggttttggtcttggtttcgttgcttttagtatttcacccatgaaagatctattcatacccatcacgcatctatctatccagaatttgaattcgttaaaatgcaagggaatttttaatatataataatgttagcaattggtctgtcatatttgatacaagcatctttctggcctgtttccatcttacttttgtttctttttcatccactcataagttcagactgttttctagtcagtcacggccctggttccactaaggaggggaatgtcccttgagtccccggctggcctccctgggagagtgccacacccccacccgagtccagaggctcaggagctgctctggctgcacgtgttccccgggacaggtcttgggcactggggggtctgtgcctggacactggcattttgcttcattcccactcagggcccctccgcagcaggcttggtagctgggggtggccggacacctggagaagggctgggggcactgcaccagtctcccaggctggaggggccacagtagggagttcccagctcagccccaggggatggccacccctgaatcctcaccgaaggcatccaggctgtcccagatcctgcccacacctgagacctcggctcccgcttctctccgcaggcaggcagagcaggcggcgggatgtgtgggttgaaccctgatggcaatgggaagggtcttcgtgacacagcttcccagcacccaggcagagacaggaggctgggctgctaacccgactggaggctgtgctcacccagtcccctccctgtgcttctggggtctccagaccaccccacagggtacccagatcagtgtgggctcagccccctgcccactgcaccctccttcggggtgccttcctcgtctgtcatgatgttcctgatcctgcacccgtcccctcttcctccagccttccctggctggctgctgtagtcagtctctagggctctgcacagcacttcctggtggtgcatcctggaggacttcccggtagaggtgtctggcaggcacaagcttgctgtgtgcctggcctgcagaaatgcacggtaggcatgcatttgttggatggttgtaacactgactctgggaggtggactgaggttccttatgggtccttctagcatcccctctccccttcagagatgagtgttgaaatttggggttctctgggtgtggcaggaggctggggggtgctccgctcatggccacttcatggcgggcttgggcacagttcggaaggcagccagctgtgtgtcccctgtctccggcctccttgtgtatgagtcaccattgggaagtcgccggcatttgttttaatttaacaggacttggctcatccccggagctctgccactggctcgtccttccttccactgtggagaggaagggggtggggtgcagagtgcttgcaagaaagcactttcccctcatcatctcaaaaaaaatttcttagcagaagcaatgagagaaatttactggcctgtcacaaagagtcactgctcatcagacgagagaaaggaaaagcagaggtcatcaattcatgggcagtgtctcaggaagggattaaatcatttagagacacgtccttaagaaatcattgaaggctcatgctgctgttttctttcctggccttcccatcgcatgcagatggcccctgtccagctgttcagatgctgcaccagcaccattctttttggaaatttgggcagacctcgtgtgtgtatgtgtatgtgcgtgtgtgtgtaatacacgctcatgtgcctacaaattgttatctgtgtgatatggttacataaacacacacaactgttgtctagccatgatggtttcagttttcttgtatttgtgttatgttgcgagctgctaccaattcattcagataaataagggcagaaataaatataacccgccagctacaggatgctggaaagctggttagagtccttggggggtggggtatggggggtgggggtggtctctgtcaccgcagtgccatgcagcgcctggcacggtggcgtcctcgctcctgtcatgagacagtgggaagccataaggcgcctggggctggcgcatcccttgggtcactgcacagtggtggggagctttagctgggatgccagctgggcctgggttcaggtcccagctccccactagtgacctgtgtggccagctgtcctcaaccttcagggctgtgtgagcctgaaacatgtggtgctgcatctggcatttagattgatgtgtgagggtccttttggtcattcgtgtgcctgctgctcaggtgcctgactcagcaggacagcccataggtcccagcatgacagcaggcatggggcatgaggtgggcataactaagatgttatgctggttaatttatgtgtcaacctgatggggccctggggtgcccaggtcagatatgattccgggtgtctgtgaggacatttctggatgagattagtgtcggaatcagctgcctgagtaatgcagacccttcccatgcggttggggagcatccactctgctcacggcctggagagaacagaaaggccaaggaaggaggacacctgccctttgagctggggcatgggtcctctcctgtccctggactggggttcacaccatgggctcccctggttctcaggccctcggactcagactgaagccaaacaatggctccccaggctccagcatgcagacagcgggtcctgggacttcttggcctccacagttctgtgagacagttcccatgacaaatctgtgccatggacctgggtgtctcctacaggttctgttcctctggaagaccccaacacacacatgaaggtggtggacacagcccagccagttgtgaaaaacaaacaagacagacagataagaggtctctgttggaattaaatagaagactttccaagcactaatctcctccttttgctcatcctagaaactgtggctgagcacccccctgcaccagccctgtgtccaaggatcactgatggatcccctgccctgcccagctcagtccaggggcggtgcttgcgttcttgggggatgaatagagatgctcagaggccaactgcagggccatgcctgggggctggatggtgctcccctgtctagggcactcagctgcatagggtgctcctctgcatagggtgctcccctgcatacagtgctcgcctgcatggggtgctcagctgcataggatgcttggctgcatacggctctcaactgcatagggtgctcccctgcatagggtgccccccagcatgggcacctgggtgggtccagagccatgtggctgccaccctctccctgtggaagggacccagtgaggagagctcagcaagaccacataacagaagggggttggagaggtgccagcctctgccaggaagcctcagtgcacagagcagccatggctgggctgatagactcatcttcagtcttattgccttcttacgggagacacagaggcagagatcatgcagggcagggtgaggagggcccaagcttttctcagggcctagggcccggagcatggccctcctgcccacccaccccggagtgccttcctgtctcttcacatgatattagcttccctcaccatcttctggtcccccagcagtgtcacctgaggcctgcctggagctatgtcaggagtatcaaccgcactgagagcttggtgagcaattcatagccttgcccagtgggagtctgagcatcccctgtggccacctgagtggatgtcaagtggggctgccctgcccccagcccatgcttgaccccgggatcctgagcagattcctggggcaggttctgccttccttccctggggctgtgtctctgtcactgctcaggagtgacagtgcctggacatgctccttgggcttctggggtgttggtgggtggtccaatggcagggacagaggagcagtgtccttgggatggccagaggcatcctcctatggataaagtcggtggccgatggctggagggctgactgcgggcctgctggggccctgctcactcactgcagtggaacaggagcccccgatgcagccccatcctcagcccagccaggggtgggagggagaggacagggcccttcgatgcacacccttttcccgtcccggagagaggggaggccgctgcatcatggcgcaccctcctggggcttgggtgaatgagtgcttactgctctttggagaggcaggtgacccatctgctttctgcattggttacgcagccccacacaatgcctggggactcagggcaggtcctgaaggtattgggcttctcttctgtccttctcactcccccagagagactgggggttgagtgtagccatagccagcccccctttcatgataatcagatgggctctgagtggagaccactggggctgcaggcacttatgagatgaggatgcagagataaagcccatggtcccttctctgcaggggccagagcccacagttgtgcagagaagggataaagccaggggagcacacgagcccccggcccacctgggagggcccagcaggctccccgagtgagccctggggtaggatgggcagcctggaggggaagaggctgaaggggccacagaccagcctgggcatagagcaggctgcaggtgaccagctcgtccctctgcccggaacctacctgggaaagtgcccatcccagcccaaatgggacggctactcccctggtgggaggcagggtgtgggactaaggggagatgctcagatggcgacaagccacctggagcttagacttggacctatggggtgtggaccaaggaaaggttgggggctccaggcctgggctatgcctggaaggacgatgggcaggggagatggggtccatcaggggcttctttgatgcaggcacagagtcggagccgggcttccggggagtacacaccctgaaaggtgtggagggggcaggatcagggactcggcgctggatggtgttggggtgaggcaaggcttggcccaggtcccggctctgcatctgggtaggtggctgtaggtgggcaactgctcctcatgggaagctgaccatctctgtgccgggctggcggacaggaggtgtccagaacagggcagggctgaagtgcagggggcccaggctggagactccccgattggagggcccccagtgaggggtcatcgaaagcaaagagtgcccctcagtgctcagggctaaaagggccaggtccaggactgctggaggagggcccaagaagtgggtcagggctcagacgccaagaagggaggggggcacagggcagggcaccatcagggccaggaagggacaaggggggccagggtccttcagatttgccagtcagcgttccatgaggagacaagcgtgagccagcaagacggtgggcatggccggtggttctccaaggcttcctcagggcacgcggtgggctgtgtggggtgtcacgtgagaaacggcactgagattagtaggcgtgacaaagctgaattcctcacaaccgctcccctcagggcccaccacgggctcctgcaagggcggggaatgcaggtgctgggccccgcgggaggagcagccacagcgggggacagggaggccagagccgagtggagaggagtgcgggactgaggaggcttttatcccccgaccttttctgaagagagaagagatagaagcagagtcatgagtgctagagacgggcagggaaggaaatggattaaaggagctggaggagagggtcccggagtgtacggaggagtgagaccctggccccaccgcctccctgggtgtgcgagtgggagtgtccaggcatgcatgtgcgtgtgggtgtgcgagggtgagtgtgcgagtctgggtacacgcgtgtgtggtagggagtacaggtgggggctggcgcagtgagaggtgggggctggacgaggcaagggtgagggccccttggtcagggccgcccactgcccgcagaagcccagggcagtgaaggcgcccaggagcaggtggttgggttgactcaggttggagaccccgctgggggtcagcagaagaatgaggggtggtgaggggcgctccaggcagggtggtgaggtagagagaagagaggcctttgcattttgcgtattctgttggtggaggaaatggtgagccatcaagggctgctggcagcctccccctaaaccagcccaggaaatgctggaagagagagactcagagcaaatatagacccacagggatgcctggagcacagacagggtcaggttcaggttgctggggaggccatggcacaggtggaggacagctggaagcctccacgtggtgctggccccctcctgctccctgggctgagccagcccaaggggcacgcaacctctgagctggcagtggccgctctgcccctggctacagcaggtatcagagcaggcagttcagacccaacacaaaacccaaacatgcctgcaggagcagctcccagttgcgcccagctcctaaagaacacacctgtgccatagaagacagacagagcaggacttagaacaagtgaccaaagtcctcagaggacttcgtcgtaagggagcatgcaatgaacatgagctcaaaagaagcggctgtcatgacaaaccagttggggatgttgggtgtaaaaaacataatttatagatagaatagaattcattaatataatgtatgaaactgtaatataattctaaataaatataattgttgaaaggggctagaagattttaccaagggactccccagaaagcatcaggagggtataaggaggtgggaggcaggttgagaggtgaggaaggtggaacaagacggcccctgcccgtctccaaggagtcctgggaagaaaggaagaataccgggtaggagaatatatttgaagaagggttggcagagaatttccaagaactaaatacagacacaagactttagatggaagtgttcacagagtggcaagcacacacaccagaaaaattagaatcacagagggaaaaacagttacagagatacaagagtgagtctgacctcagagttctcaaggcccgacagaaggcaggagaccaagtcaccaggtcagtggggagcatggacaggaggtgtgaagtgggcatagctaaataacgagaaggatcgaattggaatttcagcccaatataccattagtgtacaccactaacacccacataaatgatgctttgtatttttcttatctacaaatacatggaaatacagctgacccttaaacaatgtgggggctaggggcactgaaccccctcacagttgaaaatttgcatataacttttgacctcctcaaaacgtaactattaatagtctactgttcactgaaaccttactaataacacatacagtcaatgaacacatgttttgtaggttatatgtattatattctgtattcttttttattttattttttgttgtttacccacactacacagatgtatcacatgctatattcttcaatgaagtaggctagagaaaagaaagtggtattgagaaaataataagccagagaaatttatttactcattaagtggaagtggagcattgtaaaggtcttcatcctcatcttaagcaggctgaggaggaggaggaggaagggaaggggttggtcttgctttctcaggggtgtcagaggcagaagaaaatctgtgtgtaactggatgtgtgtggttcaaacccatgttgttcaagggtcagctgtaagtaagtaagtggcatgtggcctggagaggtaccacatatatggggaggctgctgatgttaagtgtgtgaggaaggagatagggacacgggagaaggggttagaccaacacaacagtatcaggggctgaagtggggccctcacagacagatgaaaaggagggggaagggaggcaccctgccaactggggaccacatagctttgtgcatctgaaagccactgaaaacagggaaattttatcacctctagacctgtagggagggaaaggaaataaggaaacacagtccactggggaccaagaaaaaagtggtggaaagaaaataagatggtaaaagtcattcaaaatatccttaagacagtaaaatgtaatgatgttacaggaccaccaggttcctacacctgctgcgcagttacagaccaatgcaccaagacagcaggctttgcagcagagaaagagtttcctgatctcagggcagctgagtgaggaggcaggagggaccctcacttcatctctctgaggagttttgggctggagtttttaaaggatcgtggaggtcaaggggtggaaaattggggccactgattggtggggctaaagaggatgcaatcatcggggtgtggacactgtatgttctggtgagtcagctgcttgtggggtccctcagaccagatggaatcagctgtttgattggtatgcaggacctagaaggatatctcaagtggacaacttaacacttcacaatgttcaagttgctatctatagaggatagttgttatctatctgaacttaggggaactggggccttgtaacggattacaaggtgattctgaggcagtatgcatggaatggtagtgaggaagggtcagagagcaagctggcctagaagccaacactcaggacactgcaagcttggtttattttcctttctctccctcccttctttcctaattaattttataaaacgtatagggatggattcaataagattaaactcatctattcgaaacatggattctcaggctgtgtttttttacatttttgttttgttttgttttgtttttaaagcaagctatctgctatgaagtgttaacagaaaggaagtgggtgtgggaagcgaccagtaaggcagggagaggtgcatggggtggggtggagggcagtaccaggtaacttggaaggaggtcatgcacctggaagatgcagccaccagcctcagtgagacaacagcaaacctagcatgtccccaggcatggtgggaactttgaacatacctcactctaaaatttgcatcaaacagaataaaaatcatgaaaataaatagatctgaaatacagattttaagtttgggctgctgggcagatacagaatcctgtaccccatgcgccgggcattaacattttttccagcacagatggaacatttataatactgaccatgaaggtggccacaaaggaggcttcaacaaatagcagagatgataagcaggacatgctctctaatcacaatgcaataatgttagaagtcaatcacaggaagactgccttgagcccagttacatctggaaaacacaataactcacgggcccgaggaaaaacggtaatggaaaatacaaaagatataaaccaagcaatgatagaagcagcatatattgactctcatgggatgcaggtaaaatggcactagagggaaatttataaccttaagtgctgtgttagagaacaagatagaaggcaaattaatgagctctgcgttcaacagcagatgttaggaaaagaggcacagaacaggctcagggaagaggccgaaggcagagccgggctggagaaggagagctcagggaggctaagagcagtggcctggggaaggggcctggggccgtgggtcaaggatggagtcctgttgggagtgtggggagtgggtcagggatgctggattcagcatttgaggatgggctgtgctgtgtggatgaaccatcaagatagacatcaggccccccagaatttggcaagactggaggtagagccaagtgaatccacgccagagtcctggattactatgggccatggcagtggtgtggagagaccactcagacctaatgagcctgcaagactgtgggttccgtctgcttacaggggagagctgggatttaagggaacaaaagccttggggaaagggagcgggctgctcaggggaagtggatatcagtgaaagccaggttttgtttaaggtgagatgtccgtgcaagttgagtggaggggtcatggggcacctgtttctctgagtccccagggggcagggagagggatgggttagggctgggtggggaccagggtggctggtggtggtggttatacccaagcacagcagggttgagactgacaagctcatccagcttctgaatcctgatggaggccccagagcctggtgccctggggactctgcggagggtggtgcaggagcacggccctcaggtgctgggagtgaggtgagcagggtcaccccacacctggcctgcccctcctcccttgaaaccagcggtgtgtctgagcactgggcctgaaagcatggcatctggaggcccaaggctaatgcccatggcctcctctgcctgctctgcttgtccaggggctgagctgtcctggtctctccctctgctccttcatgcagaggtcttcagagcaccctaatgtgtccaatcaaggccaggcttgttggtgagacactctcggtccccagctccatgctagatgtctccaccctcaaaggacccagcatctcatgacttcatgtcccactagcagtccctgtgcccagttcacccatccccactgaccaccaatgtttgatttttccttcagaagcatgtgaggaaatggattgttgattagcctgattcaatcattctacattgtaaacatatcaaagcatcaccttgtatcccataaatgtatacaattattatttgtcaataaaaaataaaattaaaaaagattcagttcccagctgcctcctccaggaagcgtgcagcactctcccttgctgaggaccaactttacaccagttcttaccctggaccctgcagagggcagagggcacttgggctgcccatcagggacacatccatgcctctctagctttctaggaagcttcctgtctcagcccaggactttgggaaggtggaggtagtcacctcctacagtcaggacagctgcagttcagagggaagaggcacaaagtcctcaggttgaagttacccagctggaatttcctttctcccactgaaagaggatggtgatatttgggactcagggttgatgtcaccatgggaggtctactgggacagatgctgggatgttgagctcatgcctgcagctgtacacagtgggcagtgtggctgtggctctgggcacctctttccttggtgccagatgtgctgcctggccctgtatgtaggaggctggacctgctgggccttgtggcagggcctcagggtccttctggtcacctcttcctccctgcaggtgcctctgcttttgagaaactcaaagccaaggacaggtcactggatgtgctgggggcaccaggactggtggggtagggggtccttggtgccaagttcaccccaacctcagcagggagaaggggctttggaaaggccctggcccagggagggggcggccaagcaggcctggctggggaggcccaggcattgcagttgggccaggggcccgtgtgagggaggcagcctccccttctctaggatggggccagtgcccagctctgcgagacccgtgtcctgcaccccacaccccagtggagcacagcatgaggccctcaggcccgatcccgtggttgctggttctgcgaggagattttgaatccccactagattgtcttaaggttcataggcatttttgggttttctatgtctttttcagacacgttccaagtttggtctcttcaggttactgtctgttttgtcagttattggcagaataatgttgtatagtaatttgtaaaatgtctgttatatttaaagttatgtctccatttgatttattgtgttatatgctgtgccatccctcttttcattttcttggtcaattattctagaggttggtttacttttattagtattttcaaagaatcaccattttaattttgttgaccctttctttttttaatttttaattttcgtgggtacattttagtaggtgtatatatttatggggtatgtgagatattttgatacaggcatgcagtacacaataatcacatcggctgggtgtggtggttcacgcttgtaatcccagcactttgggaggtcgaggcaggtggatcacaaagtcaggagtttgagaccagcttggtcaacatggtgaaacaccgtctctactaaaaatacaaaaaattagctgggcatggtggtgggcacctgtaatcccagctacttgggaggctgaggcaggagaatcacttgaacccaggaggcagaggttgcagtgagccgagattgtgccactgcactccaacctgggcaacagtgcgagactccatctaaaaaataaaaataaaatcacatcagggtgaatgggttattcatcccctcaagcatttatcctttgtgttataaacaatccaattatactcttagttatttttaaatatacaattgaattactattgactacagtcaccctgttgtactaaatagtaggtcttattcattctttctaactactttgtttgtacctatttatcttcatcatttctcttactcccctactacccttcccagactctggtgaccatccttctactctcttcctcaataagttcaagtgttttaattttcagcttccacaaataagtgagaacatgtgaagtttgtctttctgtgcctggcttacttcacttaacataatgacctccagttccatccatgttgttgcaaatgacaggatctcattcttttttatggctgaacagtactccattgtgtacatgtactacatttgctttatccattcatctgttgacggacacttaggttgcttccaaatcttggctattgtgaacagtgctgaaaacacaggaatgcggctatctcttttgatatactaattttctttcttttgggtatatacctagcagtgggattcctggattgtatggtaactctatttttagttttttgaggaacctccaaactgttctctatagtgattgtactaatttatattcccatcaaaagtagacaagggttctgttttcttcacattcttgccagcatttgttattgcctgtcttttggataaaagccattttaactggggtgagatgatatctcgttgtagctttgatttgaatttctctgagatcaatgatgttgactccttttcatatgctgttttgccatttgtatgtcttcttttgagaaatgcctattcaaatctatgctgagacacctggagctggaggtgggatgacacaagcacccctgtggctgccaccactaggattgtgctgggccaaacctgaaaccagcacagcactgggtctcacccagggcccattgtaaccactacctggctattacctatgtttgcttaaggccctagagctctgcaatcagtaggggtgaagccagccaggcttgtgtccttcccttcaggatggcaagttcccccaagccctggacaggtctagatacactgtctgggagccagtgactggagtcaagaaccttagaaatctgcttgatgctttattctactgcaggtaagccagcactcaaatcacaagacaaagtcctcacttttctctctgctttccacagaaagaggagcctctcccatggtcatggccaccacaggcctacatgggatactgccaggctaccaccaatgttcactttaagcccaagcgcccttcagtcagcttatggtcaatgctgccaggcctggtagtcacccttcagggcagtgggctcccctctggcccaaggcaggtccagaaatgtcatccaagagccaaggcctttggaatcagggatcccaggagcctgcttggtgctctgctccactgaactgagctggtacataaggtgcaagactaagtcccctttactttcccctctgcttttctcaagcagaagcagtctcttaccataaccaccatagctgggaatgtgctggttctcccctgaagccagcatgtctcagagtctcacccaaggcacatggcatactacctggatatcactactggttcttcaggacccaagggctctttagtcagcaggtgatgaatcctgccaggactcggtccttcccttcaaggcagtgggttcctttctggcccaaggtgtgtctagaaatgtcatccaagagctagggctcaaaatgagggccttatgaccctgaacagtgccctattctgtggctgagctggtatccaagacacaagacaaagttctctttagttccctctcccctccttaagtggaggaaagaagtcgctttcgttgctgtgagctgtgctgcctagggctgagggaaaaatagcacaagcatgccctcagccagcccagctggtgcctcactaggtcacatgcctcccacatccactggctctgagcccagcacggcactaggacttgcctgggaattgcagtccttgtggcctagattgactttcaagtctatttaggaccccagagcctttgagcccacagtggtggggcttgcaaaaacttatgttccaaccattgggatggatgatgatgcccctctgtctagggctggtctaaatgcttcctctgtgggtgggtgtcaagcaagtttagcctggtttttctttctgctctgacagagcagcacagagttcaatgcagggtcccataatcactgcactctccttcctccagtgcacagattttccatgccacaggaccactactggggagtggaggaggggtggcttcagggattcaagactgtgttttctaccttcctcggtgcctctttcagcgataggaagttaaaaccaggtactgtggttgctcacctgattgttggctcttatgaaggcttttttttgtgtatgtagatagtagttaaatttggtgttcctgcagtgggggcgataggtgaaatttctattcagccatcttgctctgctctcccttgaccctttctgttttatctttatttttccatttcattaatttttgctcaaatcttgtgcatttctatctgcaagcttatttctaaacttttattaatgtcttcatctgggctccgaatagcctttcttaataggtaaagattataaattcctgtagggtgttctagtggcagccctcaatttttgatatgtattattttatcagtgttgagttacaagcagttgcatagtatgaagtcttatgtgtctcactttttgcactcaatattttgtttgtgagatgttacatgtagccataatttatttattctcagatattatacataatctttcataaatgaatatgtcaccatttttccatctctctgtttgtggatatctggcttgtttccaatctttggatattatgaataatgctgctgtgaccatccttgtacacaactcttgaggtacatgtccatacattcatgttgattatgtatctaggaatgaaatctctggggcataggatatgcttatgttaaattctattccatgatgccaactgttttccaaattatttgtacaacatgcactttctccagcagtgtgtgagtacctacttctcctccagtcttgccaatgcttactattgtcagtttttaaagttttagccatttggcagatgtataatggcggctcaaagaggtgtgaatttacattttcctgactactaatgtggttaaacaattttgtatgtgtgtatgaattccctgctgctatggtttgaatgtcccctctaaaactcatgtggaaacttaatccccaatgtggcagtattgagaggtgggggcctttaagaggtgattgcatcatgagggctctgctcctaattcattcatggattaatgggttagtgaattaatacattatcatgagaggcaaacaggtggctttataagaagaggaagagagatctgagctagcacactagcatgctcagcccccttgccatgtgacaccttgagccaccttgggactctgcacagagtccccaccagcaggaaagctctcatcagatgtgaccccttgactttggacttctcagactccataactgtaataattaaattccttttctttatacattgcccttctttgggtaagtcctagttcaggtcctccatattcttaattattttctgtctactagttctaacagttgctgagagggagatgttgaagtctccaactataattatgaatttgtctctcctttcagctctgtcaatgtttgtttcatgtattttgaggcactgcttttggtgcatatgcctttagaattgttatgacttcctggtggatttaattatgggtatgttagagcttaagactaccattttgttatttgttttctgtttgtttcctctggttatcattcctttttctcttttattgttacttgaatacttcttagtatttcattttgacttatttatagtgtttttgagtgtatttcttcatagagtttttattttggttatttcaatagacatatgtgacttatcgcagtctgctggtatcaatgttttgccaccttgaaggacatgtggaaacctttcttccatttaggtcccttatctttctttctttcttccttttttttttttttttttttgagacagagtctcactctgtcgcccaggctgcagtgcaatgaagcgaacttccgcatcctaggttcaaacaattctcctgcctcagcctcccgagtagctggaattacaggcattcgctactacccccagctaactttttgtatttttagtagagatggtatttcactatgttggccaggctggtcttgaactcctgacctcaggtgatccacctgcctcgccctcccagagtgctgggattacaggcatgagccaccgtgcctggcccctttcacaatgttatcttgagcatcaaataatgctataatttttgttttgatcttcagattcttaaaataaaactcacatgagaaacaatggtctatggtttgtactcatatgcttcgtttttatgttgttctttcttatgctccatggctccttcttttattatttccttcctgctgaaggtcttcctttagtcaatttttaaggataggtctgaaattaacaaattcttctagctttccttcatctgagaatgtctttagtgccccttcattttggtaaaatagtcttgccagatagagattgtggttgacagttcttttctttcagcacctgaaaaatgttgtaccagttccttctggccttaaatataaaaaagatttattatgacaatatatcttttataagaggttatatcacccatggtttcaaataagaaatccactgtcaaaccaaacaccgcatattctcactcacaggtgggaattgaacaatgagaacacatggacacaggaaggggaacatcacactctggggactgttgtggggtggggggaggagggagggatagcattgggagatatacctaattctagatgatgagttagtgggtgcagcacaccagcatggcacatgtatacatatgtaactaacctgcacattgtgcacatgtaccctaaaacttaaagtataataataataataataaaaagaaagagtaaaaaaaaagaaaaagaaaaaaaagaaatccactgtcattcaaatggcacttgtaggtaaaatgacatttttttttctggttgttttcaatattattgtctttagttttaataagctcaattatgatgtgtcttcattattacatatgtatagatgacctgttggccctgtttctctggagaaccctgactcttacatggtctatgagcctagaatattttgttgtgccagaaagtataggagtcctagaaaactgattagggcaaaacaaaggacccaggatccagcttgatgaggctcccactggccagatctgagataatctgagcataaaaatgaataatgacaggattgtaacccggtgactaagaacaggatacatgctatcattttaagttataaaatgaatgaatgaacattcttttttacaaggaatggtgtggaattagaaaaccaccattttgtagccaccattggaataattgattcaggcagaaaacatcaatggatgttcaaatcattagatggaagttaaatgagaaatagatttatttatatgaattactttttaattttaaaggggaaaaaaagataccattacaatgggaaaatctggcagatactaccatgatattgaatgaaggttagtaacatgagtaacaagacaaaccagcatcatgttgatgtcctgagaagaatacagcaccattcctgccagaaatgcatggcccaaatctaatcacaaaggaacatcaaactcaagtaaaacacattgtacggaacagtggcctgcactcttcaacgatgtcaaaaatcaatgttaaattagataattatattatggttatataagagaatgtccttgttttgagacacaggctgaaatgtttggaaatggttgtgatatctgcaaggtattcttaaatgttacaaagagagagagagcgcgcgcacaatagagcataggcaggacaaaaatgttacctgatgactccaggcaaagtgtttttggaggtggactgtgttactcctaaaaccaagtgtgttctgccagctcagggattctgggctgcttggatttttgaaacaaacacacactcatcagagggctgtaaacagtgcaggtgatgcctgaacacagctgactgctatcttggtttaaaaatgcagactctggagctggatggttgaatctctattacacccccaatttgtgtgatcttggtcaagttcattgacttctttaggcttcagttccctcatctgtaaaacagtatgagaatagtcgctgtgttctaagattgctttgaagattaacatgagtcggtaatatctataatgcttataagggtgcctggcacacagtaacgatgaataaatgctaattattgtatttactattagtagtaattggacaggcagcaaagaagatccttcaactttctgtctcttaatggtctgaaacttccatctgttactatttaaaagaatttgggtaagtcctcgtacagaaaatgagtctttcttaatttcggaatgatggtaaaacattgggttttagtcccaccagtattttctacctggaaaggaactgagccagctgggtgggcagtacagaaatggaaggagggagtagggaactgatcctgcttgcaaagacaaaagaacaaggagaccctggggaatgcagaacctggcaccatttttcttcaactaccatgaaaatagacagactgcctgatacggtttggctgtatccccacccaaatctcaacttggattgtgtctcccagaattcccacttgttgtaggggggaccgaggggaaggtaattgaatcatgggggctggtctttcccatgatagtgaataagtctcatgagatctgatgggtttatcaggggtttccacttttgcttcttcctcattttctcttgccaccaccacgtaagaagtacctttcacctcccaccatgattctgaggactccccagccatgtggaagtgcaagtccaattaaacctctttttcttcccagtcccaggtatgtctttatcagcagtgtgaaaacagaccaatacactgcctgacactctttgatgaatagtttttgcgtcaaagagtaaattgggagtaaaataacagaagataaaaacaaaatattttggaaccaaaagaagaatgcctaagctatgctcagtagtacattcatagttttaaatggccttaaaatttaaaagagagagtttcatgaaccattatgcttatatcttggttcttccaaagtgctgctaaagtcttagcctgctgcaatgagtacctgggcaggtatgtgaaatactccaccttggtagagataacagaaacataaccttgaccttcccattaaaactaaagggaaaattcgactgaagttttcaagtagtacccttaaggaatcacacatagaaggtactcaataaatattatagcttgaataaataaaacaatgccactgagagcctcaagggtctggagtactctcagataactggcgtattagttagatgttgctctgtaacaaaccacttcaaaacttagaagttacccagctggaaatttcctttctcccactgaagatgggagcctattttaggggcctaaaatagtaaccttttattatttctcatgagtccacaggacgatggggcacttctgctactctgggctggatgtggctgatcttaactggctcatcagtgatcagccagtggattggctgggcctggctcatctcagatgacttcagccctccttcccatgtcctgcacatcccttcagcaggctaagctgggcttgttcttatggcagtgccagaggtccaagaaatgagtgaaaatgcacatgtgcttttccaagcctctgatcccatcctgctggccaaagcatgtcacagcatcaagcccaacatcattttgggagggccctacttaaacgaatggcgagagtgatatatgaaaaattgggccaatttctgcatgaatcctctatgattgggaatcacgtagataagtgttttgggacagttcatccaaatgacagacataaaataatgaaatgtgaaatgacagacataaaataatgaaatgcgtggccatctccttaccacagttgattctaacccagttgttgaattatttgccatacctcactcagttcagcatggctatcagtatgatgcacccttctatgtctctgaggatttataagagatctaaattttttaaaaagaaagaaactggactgccatccaacagttcacaaaaatcaatttcagatatatcaaagacccagaggtaaaaagcaaaatttcaaagctttcaaaattaaatgggggtgggggaatctcttaatatccttagagtagaaaaaattctttaaaaagacacaaaatgcactatctatataggacgcattttcaaatctagccatattgaaattgatgatttttgttaatcaaaagttacctcaaagggaatgtttttaaaagtcatgatatgagataaaatatttgtagcacatgtaaccaacaagtgactagaacctgggtacataaagaactcctgtaaacagtgttgtgctggaagatgtttaacaactgactctcaggccctaaaagtccttatttttagcatttgcttgtttccaggatataaacacttccatgtggccaatttcaagccactaaggtaaggtcaccaagcagggccttggggatagatggtcgcagttggctctcacaaggcaggtataaaggctgcagcacaaaagtcaacatgaaaaacaaaacaacccaatgggggccaggcacagtggctcaagcctataatcccagcactttgggaggccgaggcgggtggatcacctgaggtccggagcttgagactagcctgaccaacatggagaaacctcatctctactaaaaatacaaaattagccagcgtgatggtgcatgcctgtagtcccagctacttgggaggctgaggaaggagaatcgcttgagcctgggaggcagaggttgtggtgagccgagatcacgccattgcactccagcctgggtgacaagagcaaaactctgagggaaaaaaaaaccaataggaaaagtgcaaaagacttcagaaggcttttatgagggctgtcttagttcatttgtgttgctgtgaagagatacttgagtgtgggtggtttataaggaaaagagttgtatttggctcaacgttctgtaggctgtgcaagaagcatggagctggcattaggcaagggcctcacgctgcttccactcatggcagaagggcaagggagcccatgtgtggagatcactcggcaagagagaaaggcaaggaggtgccaggctctctctaacaagcaggaacgaatagagtgagaactcacactccttccccatggagggcattaaagtattcatgagggatccgcccccatgacccaaacacctcccattaggccccacctccaacactgggaatcaaatttcaacatgagatttggaggagaaaaacagacaatatcaaactatagcaggggcataaaagaaaacctaaatggacaataaaaacctgaaaagatgctcaatcttgtaactgatgagggaaatgcaaattaaagccacaatcagatacatttcacaccctccagattgacagaagttaaaaagtttgtcagtttggggttggtgattcggagctgtggaagctctcacccacggctggcggagcctgtgctagtacaaaccactgtgagaagcagtttggcatttcctagaagaggtgactgtgcacaccctacaaccagcactttcattcctgtaaatgtaaacgtgccctagggaaactcttgcccatgcaccccgcaggacacacagggttcgcgggaggaccattagcaatgggaaaaaatgaaaacaacccatgtgcccatcagcaacaaaataaactataatctctgtatatgatggaatacaatttcacagcagtaaaactaatgaattgtggctacaggtatcaatatggacaaatcccaagaacttcatggagagagagagaatcacaaaagaataaacgtcacataactgcaatactataaagttccttatctatactaacaaagacaggggtgtttatcagcaaactcaatttggtggttggagagaggggcaggagagcaagaggggtatgatctgagcgtggggcaggaagaggggctaatccatgcgactggaaatagttcgttctcaaactgggtgtgagtgtggaggtgctcactgcattgttgctgctgagacatacgcttgcattggatagattcttccacgtgtgtatttcaaatttggcttcatcacaaggcttgtgggggagtgacaaagcagtgtattaagtgtgacagctgaggaaagccccagcagcaggggacagagagaggggcacatgttgtcacctggaggtggggtggttgcgggagaaacgtccaggctacaaaccgagttgcgaatcacagagggacttaggccgggaaggggcagcacggcgccctccaggcagagaagcagccccgcggccaccctgatgcggcgcggactcctcctgtccagttctctgtcacacctgctgcctgccccctcgccaacccctgcatacatggcccgcatatcagaggcggacgaagaagcggccagaacttagccagtcttccttcttcatcttccttcctcctagtaaaacacacacacacacacacacacacacacacacacacacacaaatgggcattagcctttcctctggtcgtgcctctatttcagcttgagattttcacctttcatcgcaagggtcttcgcggcagaacgtggccgtccccacagccgtcgggggtttcgggttggatcccgcgttcgctccgctgcttggcctgcgcttcagcctctagcgacccagcgggggcgcgacttccgagccgcctccgcctcccgcctctaccgcggggccggggcgaccccaggtctgcacggccgaccgctgcgtccagagagatggggccgagcctccctgcggagcagaaccgtgggacggagggcggtgggctccgcagggagggggcgcagtccgggacagaccccagcacaggctccttccaccctcccgggacagctccgaaatcccagccctacgccggagctgcggtttgcaaagcgcggctgggccttaggtcttgcccccagtttcctatgccctaggacgtccccttgggggccagccacccccagcccgcggagggaagaggggcccttccttcgcggaccgagggcggcagcctgtgtggggatacctgcgcaggtgcagccccggtgagagctccttaccaagaaagagggacattcatttccctctccaaggtagcagcgttgaaaggcttctccacagcattactcagtccaactaatgatgggaaaaggagggaaaaacgagggcgccgagccgcaaccgcttgcctacctccacctaaaacgcaaacacagcccgagtcgccagtgaccctgactcaggcggccgcgggcgttccccacggcaggacctggagccacacccgggccctcggggctccatggcagcgcggcagcgcctccttcgcggagaagccccactgccaggagaaccactgccgtcgggagacgacgtctgtatttgtagggagtgaaaggaggcgccgagtcccccacgtttcatcgcagggtcttcggggcagaattcggagacacctgtcacgatgggagcagtcagggctttcctggttttggggcctctggcttaggtgggctggcaatgcctctcctttcattcctgataaacatgctgggccggagcacagcggccatggggctgtttcttgtgagccacggctagttctaaactgtactgatttggacacctgccaccagatgagaaattagtaaaatgtggttaccaagggactgcttctctgctctagctgtgaacggggtccttagcggcctgcatgcccgcgcctctccagactgagaccaaagacttccgcgccaccgtcggcagctcgcgaacttagacttcagaccgtctgccgcactgcaataaagagaccatggtggggataccttttaaatgatttaaatgtgtccttccttctgcagcacacacacgtcctcctgaactggacacctggccaggccaacgaaaaaggagaagctcttttgtaaggtggcagggacgcacccccttagctagagacaggcttctaggtggctcgccttctactggtagaacatgtagggttatctgctaaagtgtgggacctgctacattgaagccaatcttctctgagcaggactcaatttatttttttcttaattgcaacacatgaaaattttaggtcaccaagaaacactagtcaaagggtttcattttctgtttatggcctatttattacaattcagaagaaaaatgaccaactagaaaaaaaatatgtaacacgtatcacggactgtcaaatgtctttttttttttagacaaggtctcactctgtgaccaggctagggtgcagcggtgtgatcttggctcactgcagccttgaactcccaggcttaagcaattctcccacctcagccttctgagtagctgggactatggcatgcaccaccacacctgggtaatttttgtatttttttgtagagaccagggtttcgccacgggcccaggctggatttttttctttatatgtaagaaaacttggtggagacggggtttcgctgtgttggccgggctggtctccagctcctaactgcgagtgatctgccagcctcggcctcccaaggtgcggggattgcagatggagtctcgttcactcagtgctcaatgttgcccaagctggagtgcagtggcatgatctcggctagctacaacctccacctcccagccacctgccttggcctcccaaagtgccgagattgcagcctctgccctgccgccaccccgtctgggaagtgaggagcatctctgcctggccgcccatcgtctgggatgtgaggagcccctctgcccggctgcccagtctgggaagtgaggagcgcctcttcccgggcgccatcccaactaggaagtgaggagcgtctctgcctggccgcccatcgtctgagatgtagggagcgcctctgccccatctgggatgtgaggagtgcctctgcccggctgcgaccccgtctgggaggtgaggagtgtctctgcccagcagccccgtctgagaagcgaggagcccctccgcccagcagccgccccatctgagaagtgaggagcccctccgcccggcagctgccccatctgagaagtgaggagcgtctccgcctggcagccgccccgtccgggagggaggtggggggcagacccctcccggccagcctccccgtccgggagggagttgggggccagcccctgcccggccagctgccctgtccgggagggaggtggggggcgcctctgcccggctgccccttctgggaagtgaggagcccctctgcccggccgccaccctgtctgggaggtgtacccaacagctcattgagaacgggccatgatgatgatggtggttttgtggaatagaaaagggggaaatgtgggaaaagatagggaaatcagattgttgctgtgtctgtgtagaaagaagtagacataggagactccattttgttctgtactaagaaagattcttctgccttgggatgctgttgatctatgaccttgctcccaaccctgtgctctctgaaacatgtgctgtgtcaactcagggttaaatggattaagggcagtgcaagatgtgctttgttaaacagatgcttgaaggcagcatgctcgttaagagtcatcaccactccctaatctcaagtacccagggacacaaacactgcagaaggccgcagggtcctctgcctaggaaaaccagagacctttgttcacttatctgctgaccttccctccactattgtcctatgaccctgccaaatccccttctgggagaaacacccaagaatgatcaattaaaaaaaaaaaaaagaaaacttggcaaaggatatggacagacaggaaatccagctggatcttcagcatataaaagatgctctaccacactggtaataagaaaactatactttaaaactacaagatactattttacagtctcagataggccaagttcaaaaatgaggagagtggctcgtgtctgggaggctgtggggtctgcgcggtcactcattactctccttatgccccctggggagatggcatggcaggcagtttaccttccaaaggtaacagttcacacactctttaacaaagcaattctgctcctttgtcctacggacttgcttgcatatgaaatggcctgccagtgagaatgtgcactgcaacgtggtttccagtagcgaatatgaaaccaatctacatctccataaataagagatgggtgagatagtgatgcattcacagaaccatgagtagccatgaaaaaaatgagtgtctttatatgaactaatatgcagagatctctaagaaatattattaaaggaaatgcaaggtgcagaactgtgggtacacctaccactaatgtaaaacactaaaaagcattgtgtaaggatataaaagaggttgctcatagtgttccttccagggaaagaaaatgggatgactgtgggagaagggttggaggagatttaactttcactttcaaactttttgctgtgttcatactttgtctattcaaaaaaattaacaaataaaaatgcatttaaaaattagaggccagtattacctacagtttccagccttctgtgtaaaagcagatgtattcacattctccagagaaacagaaccactaaggtatcaatatttccatatctctatatctgtctatatatacagatttattacaaggaattggaggttgagaaatccagaccccaggcagcaaatagtggtatgtgacttgccttcatcaacagaaaatgctggaagtgatgttttggggcttacaattccagtctttagagaattgttagcttctgcttctcctcttctagagtccagacaaggtaaggtgttaaactgtactgagacagccatgctgtgaggaagcccaagttatccatatggagagagagacaacataagggagcactgaggttctagacttgtgggtggagacttattggaccctctagcctagctcagctccatatatgtagtccatgccatgaggtggagcagaagagctgcccagccatgccctgcccaaactctcaacccacagaattgtgagaaacaataaattgttgtcttaaaccactaaattttggaatgttttgttgcatagcaataggtttgcccctaacatactggatgtcacaaggtgacaattcctttacagggacagctgagtgaccatcccatgggaaacaaatatttgcattcctttatcatgttactgaggcgacatctaattgtatccttctttttaccttacgtgagacactaatgggtggttttctccttgatcttttacagaagcaaacacagcatcaaacagcaaggggcttctaataggggatttgcagatggccagcctatctcagaataggacacaaagatcttggggtaccttgtttaggattcagacagtagtccctgtgaatcctatatacttgctatgaaaaggaaaaattggcttgtcaatttgaggtcaaaatggtggataggaggcaggactagcagctcctactcagacagagcagcacgtggagattcacatcatgaactacctcaagaacataccaggaaacctgagagaatccacagaccccttgaaggaggtggattgccactgcaggctccatgggacagctgaggaaactgccagtctgtttgctttctcacctggaaggcttgtagcctggggcaagttctcagccctgctcactggctgcctggaaataaactgagtgctgttgggggaccacagtgggagtgagatcagccttttgggctgtgggctgcatggcagctgggtgacgcctgtggctgccagctttcccccccttccctggcaacctgtgtgatgcagcagaagcagctataatccccttggtaacataactccattggcctgggaaccacacctccaccccctaaagcagcagtggcaggccccgcacaaggagagtctgagctcagacatgcctaaccctgaccagacctgatggtctttctctacctgccctggtaacagaagacaaaggacataatctcttgggaactctatggccctgcctaccacctgaccttagggcaagcttgtatcctccctatactactgcagctgatgtgctcttaaaagcaccacctcctggctggaggccaaccaaaacaaaactagcaccttttgttgttgtcattgttgttgagacagagtttccctcttgttgcccagactggagtgcaatggcatgatctcagctcactgcaacctctgcctctcaggttcaagctattctcctgcctcagcctcccaaagtagctgggattacaggtgcccaccaacgtgcccagctaatttttttgtatttttagttgagacggggtttcaccatgttggccaggctggtcttgaacgcctgacctcaggtgatccacccgcctcggcctcctgaagtcctgggattacaggtgtgagccaccacacccaaccaaaactagcacacttaataaaaatacaaccaaggaccctcacagagtccaggcgctggtatccacagctgagagacctaaagacggatcacatcacaggactctttgcagacactcctcagtaccagcccagaggctggtagctcttctgggtggctagatctagaagagaaataccaatcactgcaatttggctctcaggaagtcctattccaagggtgtgggggagagcaccacatcaagggagaaccctgtgggacaaaggaatctaaacagcagcccttgagtcccagatcttccctctgacatagcccacacaaatgagaaggaactagaaaaacaattctggtaatacaacaaaacaatgttctttaacaccctcaaaaaatcacgctaacttaccagcaatggatccaaaccaaaatgaaatccctgaactgccagaaaaagaattcagaaggtcaattgttaagctaatcaaggaggcaccagagaaaggtgaagtcctacttaaagaaattttaaaaaatgatataggatatgtgataaacatcataaaaaatgatataggatatatcatataagatataggatatatgacaggttttccttcatacgttacctgatacttttgcctcataactcttaagattctttccttcatcttgactagataatgtgatgaatatgtgccaaggtaatgatctttttgtgatgaatttccaaggttttctttgagcttcttgtatttggatgtctaggtctctagaaaggccagggaagttttccttgattattccctcaaatatgttttttaaacttttagatttcttttcttcctcaggaatatcaattattcttatattttgtcacttaacaaagcaagcactagtagctattcttacatcagacaaaacaaactttaaagcagcggcagttaaaaaagacaaagagagacattatataatgatgaacagactagcccaacaggaaaatatcacaatactaaatatatattcacctaacacaggagctcccagatttataaaacaattactactagacctaagaaatgagatagacagcaacacaataatagtgggggacttcaatactccacagacagcactagtcaggtcatcaagacataaggtcaacaaagaaacaatagacttaaactataccctagaacaaatggacttaacagatatttacagaagattctacccaacaactgcagaatatagattcaatgcatcagcacagggaacgtactccaagacagaccatatgataggccacaaaacaagtctcaacaaatttaagaaaatagagattatatcaaatactctctcagaccacagtggaataaaattggaaatcaactctaaaaggaaccctcaaaaccatgcaaatacacagaaattaacctgctcctgaatgatctttgggtcaacaatgaaatcaagatgaaaattaacaaattcattgaactcaacaataatagtgaaacaacctatcaaaacttctgggatacagcaaacgcagtgctaagaggaaaggtcagaagttcagagtgttaaatgcctacatcaaaaattccgaaaaggcacaaatagacaatctaaggtcacacctcgaggaactagagaaataagaacaaaccaaaccccaacccagcagaagaaaagaaataaccaagataagagcagtactaaatgaaattgaaacaacaacaacagaaaaaatacagaagataaatggaacaaaaagctggttcaaaagataaataaaattgatagaccattagtgagattaaccaacaaaagaagagagaagatctaaataagctcaatcagaaacgaaacaggagatattaccactgataccacagaaatataaaagatccttcaagggtactatgaacacctttacacgcataaactagaaaacctagatgagatgaatacattcctggaaatacacaaccctccttgattaaaccaggaagaaacagaaactctgaacagaccaataacaaggagtgagattgaaatggtatctaaaaagttaccaacaaaaaaaaaaggtctacgaccagacgaattcacaactgaatatatatcagacattccaagaagaattggtaccaatcctattgacactattccaaaagacagagaaagagggaatccttcctaaatcattccatgaatccagtatcaccctaataccaaaaccaggaaaggaaataacaaaaaaaagaaaactacagatcaatatccctgatgaacatagatgcgaaaatcctcaacaaaatactagctaacagaatccaacagcatatcaaaaagataatccaccatgatcaagtgggtttcatactagggatgtagggatggtttaatatatgcaagtcaataaatgtgatacaccacataaacagaattaaaaacaaaaaccacatgatcatctcaatacacacagaaaaaacatttgacaaaatccagcatctgattaaatgctcaaatgattaaaaccctcagcaaaattcgcatacaaaggacatacctcactgtaataaaataaaatattatcactgtaataaaagccatctatgacaaatccacagcaaacataatactgaatgggaaaaagttgataggattccctctgagaactggaacaaaacaaggatgcccactcttaccaatctattcaacatagtattggaagttctgcccagaatattcagacaagagagaagaataaagggcatccaaatcagtaaagaggatgtcaaactgtcactgtatgctgatgacatgatcatatacctagaaaaccataagggctcatccaaaacgctcctagaactggcaaatgaattcagcaaaattccaggatacaaaattaatgtacagaaatgaatagctctgctatacgccaacagcgaccaagctgaaaatcaaatcaagaactcaatcccttttacaataggtgcaaaaaataaaaataaaatacctagggctatacctaaccaaggagatgaaagacctctacgaggaaaactacaaaacactgctgaaagaaatcatagatgacacacaaatggaaacacatcccctactcatgaatgagtagaatcaatattgtgaaaatgaccatactgtcaaaagcaatctatagattcaatgcaattcccctcagaatatcatcatcattcttcacagaactaggaaaaaatcctaaaattcgaatgaaaccaaaaaagaccatagagagccaaagcaagactaaacaacaacaacaacaaaatctggaggaatcacattacccaacttcaaactatactgcaaaactatagttaccaaaacaatatggtactagtataaaaataggcacataaaccaatggaacagaatagagaacccagaaatacagccaaataattacagtcaactgatctttgacaaagcaaacaaaaacataaagtggggaaaggacaccctattcaacaaatgctgctgggataattggcaagccatatgaagctgaatgaaactggatcctcatctctcaccttacacaaaaatcaactcaagatggatcaaagacttaaatctaagaccagaaaccataaaaattctagaagataacattggaaaaacccttgtagacattggcttagatatagacttcatgaccaagaacccaaaagcaaatggaacaaaaccaaagataaatagatgaaactgaattaaactaaaaagcttctgcacagcagaagaaatagccagcaaaataaacagacaacacacagagtgggagaaaatattcacaatctatacttctgacaaaagactgataaccagaatctgcaaggaactcaaacaaatcagcaggaaaaaacaaacaaacaaacaaacaccccagaattgggcaaaggacatgaatagacaattctcaaaagaagatatacaaatggccaaaaaacatatgaaaaatgctcaatatcactattatcagggaagtgtgaataaaaaccacaatgcaataccgccttactcctgcaataatggccataatcaaaaaatagatgttggcgtgaatgtggtgaaaagggaacacttttacactgttggtgggaatgtaaactagtacaaccactatggaaaacagtgtggagattccttaaagaactgaaagtagatctaccgtttgatccagcaatcccattcctgggtatccatccagaggaaaataagtcattatatgaaaaagatacttgcacacgcatgtttttttttgttttttttttttttgtcttttaacagccaacagtttattgtacactagtcttgagcagcttcaatctgaattcatctccccaggacaggaagaagtcaggagatctcggggagacagagcttatatcctttcttattcagaactgccacaacccctatccctcaccagtcaggccccacatcacaccagtggcccagctggaattctaacatcagctaattcctttatattcttgtcgttcttgacattgccagaaaacgtaatctctcatgctttccaatcccaatagtgttttctctgggcctcctaacccccctctctgtccacaaatctccttttcagttgcaacccccatccaattttaaacaacttccacattttcaatactgaggttaatcattaattgagctgtaatgggtatgtgttgtctactaagtgttttggaaagtcactttgacacttatctaatattataggcatgcactcatccttcccatgacccttttccttccacatactttagaatgttcttccttgataggaatgtaagctctatgagggcatgtgtttttgttttattcactaatgtggatcaagtaaccatagcagcgcctctcgtatagtaggtattcaataaataagcattgaataaatgaatttaatgagcatacattcagcaaatatatggttatatgacaatatgacaatgaatgagtaaaataatattttcccttatggagtttacattctaatgtgtaaatgccggaagcctatgacaaacagacaataagcatgtaaacagatataattccatactctcattaatctatggggaaaataaatcacattagggaaatagagaatgactggtagaaagaattttggttattttagatagactggttaagacaattctccttggggaggcaaatctgggcagaatactgatgtgaggcaaaatgaagattttggacataaaaagacttgggaataggcaggagtaataaacagagaatataaagatcttgatatggcaaaatgttttatgcatttgagagaaagagtggttggagataatgttagggagatgaggaaaggccatgttgtacaggtcttacaggttacctatacctgggggtccctaacccctgggccttggacggataccagtaccggtctgtggcatattaaaaactgggtggcacagcaggaggtgagcagcgggctagcgagcattacctcctgagctccgcctcctgtcagatcagtggtggcattagattctcataggacaggaaccctattgtgaactgctcatgcaagggatctaggttgcactctccttatgataatctaatgcctgatgatctgaggtggaacagtttaatccccaaactatccccacactgtcccttcccacagaaaaattgtcttccttgaaaccagtccctggggccaaaaatattagggaccactgatctataggattttcattttatttaaatgtgatgtgaaagcatgggaaagtttggaaaagtctcatgatcttatttaggatgataaaatcatgaattaaaaagctacttggtggagagagaaagcaaagagaccagcaaggaggctattgtagcatcaagtgacaaatgatggtggattgagccagaatggtggcagtggagtggaatcaggttctggatattctttgaagatggatttgatatggtaagggaaggagaggaattaagaataggtcctagattcctcagctgagctgggaaaatccattttactattagtgtttcctcaggaagagaatgagctaatacatttggggaaaatattatcacttcctgaaaactgaaaagaaaatgatcattttttaaaaatctattgtatcctttgttttctcttaacgttcttttgtctcccagccttttattttgaaaaatgttaacttcaataagaatttgaaaaaaatagtacaaccatataccctttacctacgttcactaattattaacattttgctacatttgctttctctgtcttttcacatatacacacaaacacacacagtttttctctgaaatatttgaaagtatgttgcagacatcatgaaactgcactgctagtattttggtatatatttacacatatttactgagaacaagaagattttcttatagaaatacaagaccagagaaattttacatagctacagtgctttttttttaaaatttatctcccactatctctttatttatttatttatttatttattattatactttaagttttagggtatatgtgcacaatgtgcaggttagttacatatgtatacatgtgccatgctggtgcgctgcacccactaactcgtcatctagcattaggtatatctcccaatgctatccctcccccctccccccaccccacaacagtccccagagcgtgatgttccccttccagtgtccatgtgttctcattgttcaattcccacctatgagagagaatatgcgatgtttggttttttgttcttgtgatagtttactgagaatgatgatttccaatttcatccatgtccttacaaaggacatgaactcatcattttttatggctgcatagtattccatggtgtatatgtgccacattttcttaatccagtctatcattgttgggcatttgggttggttccaagtctttgctattgtgaataatgccgcaataaacatacgacacatgcatgtttatagcagtataatttgcaattacaaaacatggaaccagctcaaatgtccatcaatcaatgagtggataaagaaaatgtggtatatatgtatatataccatggaatacgactcagccataaaaaggaacaaaataatggcattcgcaacaacctggatggagttggagaccattatcataagtgaagtaactcaggaatggaaaaccaaacatcatatattctcactcataagtgggagctaagctatgaggatgcaaaggcataagaatgatacaatggactttggagatcaaggaaaagggtggtgggggtgggggataaaactctacacactgggtacagtgtacactgcccgggtgatgggtgcaccaaaattttagaaatcaccactaaagaacttattcatgtacaataaataaataaataaaaattaacagggggaaaattggtacatggaatgtcagggggccttaggcaacgctgccctggggcagaaccccctgctctcccaccaagacacagtgccctccccaaccctatcaagcagctggccctgaaggaacagtgtacacctgaggggcccaggcaggaggctggagcttagggcataggagaggagccaagaggttgtgaagacagagtagctgcaggggaggtgcagactccaccacctaaagggtgcctgcaggggcctgagagccaagaccaaggctctgcaccatggggtggcctcctgcatctcccgccatgtggactctgcacaggttggattatatcccttgaacctgaagagccgccttaacattttttgggattccatgtttgtgctgacaacaccaccccttccttccacaacactgggcatggtgcccaacttggaccatgggttgtcaatcaacgagtggatgatcagccctcaggccaagtcctcccacaccctgtgtttgtgaatacaatgttattgatcaaggcagtgcacattgatgaaactgttgtccacacctgccttcacgctgtaacagcagggatgagttgttgtgacagagaccatgtggtagcaaagcctgaaatatttaccctctagctctttacagaaaggattgtcaatcctgaggaaatcaacaggaaggaaactattccagtttctaaaaatgtgagtgttttgtgtggtgaaagagaccatacatttctaagagaaatgatagagacagactggagaaaatacttgcaacatatgcatttacaaaatttaataactcttggctgggcgtggtggctcatgcctataatcccagcactttgggaggccgaggcagctgaatcacttgaaccccggaggtggaggttgcggaaagccgagattgtgccactacactccagcctgggcaacagagcaagactccatctcaaaaaaaaaaaattaataactctaatattccaaggcttctacaaattaatgagaaaaaggcaaacacaataaaatagaaaaatagaaaaatgggcaaaggagttgaacagaaaaagcacaccaaatacaaatgatttatgaatttatgagagacaaatgtcataagttattaagaaaacagaaatgtcacagtgtttttcactcacattgatagtattgagtcttgataaggatgaagggaacgctgtgcctttgggagaagcatcaatgagcacacttgttttggagagggtaatctatctaaactaacactaaattttttaaaaatgcatatctttgctagatagtatcatttctagatgtctaatctatagaaataatcatacaagttcaaaaataaatacagaaggattgtcatcctatcattacatgagataacatttttttagagaaaacctgaacactaattaatggaaaatggttacataaattgtaatgcatacattttgtaaaataggcagttattaaaaggaatgaaatgcatcaatattttctaaatgtaataactactaagatatattgttgagtaaaaaagcaagttgaaaaacattatgaattgcatgattgcattctaaaacataaaatctgtgtgtgtgtatgtgtgtgcacatgtgtgtgtatgtgtgcatgtgtatgtgttctagggaaaggagcgatggccacctacctccttcactggtgtgtggtaggcagggttgctgctctataagctaagatattgatttggctgctttagcaaagatcaaaataacagtgacttaacaataaagaagtttggttctccctctcgttaaagtcttggattagtagaaaggccagaggtcaaagtttccagagtcctacctgtctcatcactgtgccattctgtcagtgcatctcagctccacacagttgcagctggaggaccatggcctgggcagcaggaagggggaatgtggaggaaaggacagataggctctgtggaaggcatgacccagagttctacatgtgatttaaatcaccttcttttggccaaaacatagtcatgtggccacaccacgtaggctgggaaaaaaagcagtccttggctaggcagccccatgcccagctaaaatgtagaggtatctgttattaaaagaaaaacagaagaagtcaatatttgggtataatgagtagtctcttcctatggatgtcctgctgtcttccttgccaacagaaaatcataaaatcgacaatggagaaacagcagacggattatgaaagaatgcaatttgtctatagcagacttatccacaacagtaacaggcaacagaagatggaaaattatatttgcaaagtaatgagagaaaccagtgtgagcatagcatcctacattatgcaaatgatcatttaagaggaagggaaagagaaaaacatttcagagcaagacagtgagaattggccaggcacggtggctcgtgcctttaatcccagcattttgggaggccaaagcaggaggattgcttgagcccaggagtttgagaccagcctgggcaacttggtgaaatcctgtctgtattaaaaacaaaacaaaacaaaacagaaaaaaaaaaaggtagtgagaatgtaccattaatagacatgtgctgaaagaactactaacagatgtactatatttcaagaagaaggaaattgaacacagaaggaactgaggtgcaagaagtaatggtatagaagaacactggaaatatatggtatttctagaaagctttagctgaatccatcagtaataataaacgtaatagttctgaatgtataaaagtaagttggaaatttccagctggaaaaagatggcttagactagttttccttgcaccttccctctacacacagctataaaccctagaataatgtaagaggcaaccaaaggagaactctcataggtgttaacaggaaagtgaactggtttgggcctcagggatggatgaagtgcagctgcagggaatcttatttccccttaccagatggaggacagtgacccaggtccagtgtttcccatccccaacacagtgacagaaggcagccaaggaatcctcattcctgtcctggaactacaggagtccctcctacagcaccaggtgtattcatcttctgttgttgctataacaaaattaccacaaacttagtggcttaagtaactacacatttattattttccagttgtggaggtcagaggtctcaaactggtctcactgggaaaaactcaaggtcttcagggctgtattccctttggagctctagggggggatccattcccttgtcatttccagctttagaggctgcccacactccttggctagtggccccttcctccatctccaagccagccacatcatgttgagtcctgctcattcttccatctcttattttctctctactgccttcaccttccattaacaagaactcttgtgattacattgtatgtttgtggttacactacagaatccaagatgacctccccatctcaaggtcaactaattaacaccttaattctatttgcaatctttgtcattaccataacatattcatgggttctgggataaggggtagacatttttatggaggcattagtctgcttaccacagactgccctctggcccccaaagatacacatctatcccatatgcaaaatgcattccactccaagattcccagccttatcaacccattaaagtaacaactcaaagtccaaaatctcatctaactttcagattagctccaaagtgccaaaatgcatcatccgaggctctgggagtgatccatcctggggcacaattcttcttcatctgtgaacctgggaaattcaagaaacaagttatctactcccaaaatacaaaggtgagacaggcatgggataacagtgatagatatttccattcaaaaagagaagaggaagaaaaaggagttgccagtcccaatcaatttcaaaatcaagccaggcacattccattttgtttcaaggcctgagaataattctctgtggctcaagactcagacccccctgagctagtggctctgcctttggagtcatccttcctttttcttgaagggtatcacatgtttacagctgagtagttttatcatcacattttttgcctgtagaatttgagagtggcgggggcggtctaacagccctttttcattttgctttctctctgtacttttctttccaagctagcagtgtttctgttggtataacatcctcaagagccttgtgagtctcccatgtttgtcacagggattcacaccattggataagagactcatctaaggatctttcatagagttcagtgccacctgcaagggagatataccaggatcccaccatcaataagtgggcaagagaagtcctcacctcctctgcagcctgaaactcccctctcccatcaagaaacagcaggccaggtggagaaggcactggcagagggcatcctgtcataagtacctcctctgggaagactctctgtgccctataagcagaagagatcctgtcacaagggcccagcttggaaagcctctgtttttgtgtgggcctgggtcttcccaccccactgagtgacaccaggccaacaaacctagggaaataccttcagccctctgggcagcaacagcagggaccagtgaagagcctagcagcaccagctaaaccaaacaggtgaaaatgacaccacaaagtttctgaaaattaaactgttattggaaccatggcccacaaaagtaggtcattactcacatactaagccttaacagggtgattgccttgctacaatagaaaatttaaatagaaatcagtctcctaacagaagaaacaaaatgtccagaatacaataacataccaagaaacaggaaagcaacaacttgaatgagaaaagacaatcgaataatatcaacatggagacgaattaggtattgaaatattctggctaggactttacaggaaccatcataaaaatgcttcaaaaattaattacaggggccgggcaggtggctcacacctgtaatcccagaactttgggaggccgaggcaggcggatcacctgaggtcaggagttcgagaccagcctggccaatgtggtgaaaccccatctctactgaaaatgcaaaaattagcctggcatggtggcaggtgcctgtaatctcagctactcaggagggtgaggcgggagaacctcttgaacccaggaggcagaggttgcagtgagcagagatcatgccactgcactccagcctgggtgacaagagggaaacttcatctcaaaaaaaaaaaattaattacaaatgaaaaaatagaaaatatcagcaaaaagtagaagttacaaatttgttgggttaaattacattaatagattttatgatgtagaaccatcatttattttattgtaaaaatacaataaaataaattaaaaacttgctggatgagctcaatggtagaatggaagtgacaaagcataaaatctgtgaatatgagaacagatcaatagcacttgctcatcatgtgaataacatcattaagaataacagaaaaaaaatcatctgaaaaaaatgaacagagcctcagggaccttgttagagtaaaaaaaaaaatctgacttccatactatcagagcctaataagaagagaagaaagagttgaaagaatatttgaagaaataattcccattttgatgaaagatataaatctacagattcaagaaactatgataatcacaaacaagataaacccaaagaaatccataccaagacacatcatcattaacttaataaaactaaagacaaaaaaaattgaaaacagccagaagaaatgacatcttaacctacaagtgtcatttgaataagagtggatttcttatttgaaaccatggatgataaatatcttataaaacataaagtagaacatattttacatagactatagtctcttataaaaataaaatataaaagaaaaatctctttgcactcccatgttcaagggtggaagaagagggatgtcccaggggagggaaggaggaagagaatttgcccttctcccacctttttgttctatcaggtcctcaacagatgggaagatgcccatccacattggtgagggtagatctttactcagtccaccacttcaaatgccaatctcttctagaagaactctcacagacacactcagaaataatgtgttaccagccatcagggcatgttttaggccagtcaagttgacacataaaattagccatcactgtgtacttttcctgccctggtctttgatttggcctagtggtgatagggaatttagaaccccagatccagtctctagctgtgctcattgctcctggagcaccatgcttctggctctttcagaacagaagtagaaaatatatgagtttttcatttgtttgctttttaaatctatcctgttccctcaaattctaaccaacaccacagtactcttccggtcttagagcttcaaacttatgtttgttttatctgaattccttcctcaggaaaggaccctcaggcctgtcaacgaaagtatcaaagaactgaaactcacaaaatcaccacatcctgataatgagatgccagacccctcattcatcatgattgcttccttaacctctctaattcctgttttcttatacattattacatttcttcccaggtatataaacctttaattttggtgggtcaggcagaaggatttgagactgaactctcatttccttggctacctcagtgattggctgtgcagcaagcagcaggacctcagtggacccctggtgttttggtaacataatcacatcatatttctccttcaatttattgggttaagttacattaatagattttatgatgtagaaccatccttacattcttgcaataaactgtattagttgtgaattggtggattcgactaatatttcattcaggtttataaataaaatgtctgtaattatcacttctgatgttgttcttaactggttttggaatcaaaacaatgttcactttttagaatgaacttgaagacgttatctcttttggtatattttggaacaacttgcttaacttgaacatttgtatataatttgaaaattttgtaaaatttaccttcaaaaccattttggcctggggttgtttgtttgaggggttgacggaaggcagagcttggactattacaactgtattaatgtttcctggtttacctgttccaatttttttcttcttatgcagttttggttttctatatttttataagattttattcattgaattgagggcttcaatttttcatttacaataaaattctcctttacaatttttaaaaatctccactgtgtttgcagttattatctctttttgttctgtatttcctctcatagtttacttttatgatcatcttttttccttggtgagtcttgtgagatgtgtctgtcttgttaattttttcaatgactttatttctgccttcgttaatcttctccattgttttgattgatgtgtgccctgatggttattatctccttttgtgtggttttttttttttttttggttttactttgttgctcttattccaactcttgagttgaatgctagtttgtttttaaaaattgtattttctgaaaaatggtcttaaagctataattctccttctaacaattgctttattggcagtctgtgtttttattatcatttagttttaaatattccgcaacttccttttaaatccaagagtgattttgtaaaatgctatttatttccaaaaaaaaaaattggattaaaaatctcttttgggccaggcacagtggcagcactttgggaggccaaggcaggtggatcatgaggtcaagagattgagcccatcctggccaacatggcgaaagcccatctctactaaaaatataaaaattagctgggcatggtggcacatgcttgtagtcccagctactcgggaggctgaggcaggagaattgcttgaacccgggaggcggaggttgcagtgagctgagattgcaccactgcactccagcctggtgacagagtgagactccatctcaaaaacaaaacaaaacaaaaaaactcttttgttgttttagttgtattatatttaggaaacatgctttgtgtgaaattcatcctttggaatttaagagagctttccctatgttctaatgcatggtcaatttttgtacatgttccttgattgccctaatttaatgtgtattacctattttggggggtttagagttctttatatatctattaattatagtgatcagaccttgatacgcatgctaattttttggtctgttttatccataagtttctaaagcagtatgttaaaatatcctactataattattgattcttctatttatatctataattttttcagttgttaccttacatattttgttgctataattgtggggacacaatttcatgatgttgatgtgtatattttgtatttcttttaagtagtttaaatatcattattctggaaattttatcctaaattttattagaaacatacttcattgtttctaagtcaagatttttacaaattctggcatctctaaaactgagttgctgagttgctaattaatgaggataaagttctagttaaacaaaatgaataagttctagagatctgctatacaacattgtaacctatctttaactataccctattgagccataatccagccactgtactccagcctggcccacagagcaagaccctgtctctaaaaaccaacaataactacaacaacaacattgtattgtacactttaaaatgtgttaagatggtatatttcatgttaagtgttcttatcataataaaataaaatttcaaagtaaaattgagttgtttcttttacctgctgtctgggaggcagtagatgtgacctaggtgttattgcctgtgtttatgtgaacataatgataactgttctttttgtcattacttcaattgagttctgtgcatttttggcactagatgtgctgaatttaattgctgtttataatttatttaaaagcttacatgatgatttggcattgaagtgaaaagttatatcgtaagcagaaaattaactataagaggctagtgtgacctatttatatgtcatgcaggactatagtcaaggtatcaaatatcgatttgtcagaaacttgctgctgactttgatctgaagctatttaacttctaagaacatatgattccactgaggaaaaaaatgaagctatgaatgaaataaaaaatgaaatactaataaaactgagtttttacagaacaattgctaaaggtgcttattatgaacacaggttagaaaaatattacatcactctgatgctatgcataatcaccaaaggtcaaatgttgttaccatatttaattttaaaccacaaacaataacaaaatgtaagttatttcccaaaatatcttattgtgcttgcactaaaaagaagaaaaaggcattagataaactgatgacagaataattaaaagaggctgggcgcggtggctcaagcctataatcccagcactttgggaggccgaggcaggtagatcacctgaggtcaggagttacagaccagcctggccaacatggtgaaaccctgagtctacgaaaaatacaaacaatagctgggcatggtggtgggtgcctataatcccagctactcaggaggctgaggcaggagaatcacttgaacctaagaagcagaggttgcagtgagccaagatcgcaccattgctttctgggcaagagagtgagactctgtctcaaaaaaaaaaagaaaaaaaactcaaagaatctggaatggatgtctaggagactaagtaactaagcatatttgttttgatgtatctgatcagctaaagaataagttcactaagaagtgaattaggttggtggttgttccataatgtatgactccttgaagattccatcagcaaaccatttaacacttatttgaagaaggaacacgatttctgtttgttgtctgaaaaccttgcactgattgcaagttctggtaagatcactaaagcactggcatcaacttaaaaatggcatccatgtcttgaaagaaaaaaaaatctcagacaacattgaagcactcttaaacagtgcttcatcacaaattctatcattatcacagagggcatttgagtatgctcaaaagcttgggtaactgactgtgagtgaaaaagtaattcaaaagaattatattctgatttggaaaagtttgttttccttttatatattagggctatctatttccagaatttttaatttaattttactttaatttttttagacaaagtctcactctgtcacccaggctagagtgcagtggcacaatctcggctcactgcaacctctgtctcccaggttcaaatgattctcttgcctcagcctcctgtgtagctgggactacaggtacccaccatcatgtccggctaatttttgtatttttaatagagacagggtttcaccatgtttgctagtctggtctcaagtgatccacctgccttcacctcccaaagtgctgggattacaggctagagttttatttttaattctaccgtctctttaagtttcttctggagaccacatactgttggatatgtttttgtttcaaattctgagagtctcagccttttaattgttggatttaacccatttatattttgtaatttctgttatattagtgattatttcttccaacttcatatttacatttactttttcccattatattcttttattgatttaaaagttataactataatttatgttctatgacagttgccttaatttaatatccaaatatatgtttatttgcttcttttattttcttaagcaaatattaatatatacatttttcccttaacaataaaagtatttttgatgcttattatacccttggcctctctttcttgctctctcaatccctgtcatattgatattatttaaaattttagttcttggttgccatatatgtttttttcttttctttggtcttagagtgagggcgtttgtacttttcttccctcctaaggcaagggtaacacttgctgattcatctgaggatgcttattgcccatacctcccgtattatccttctgaatctgtagctcctcttttttatgtactttccttgaaaatattttaaatgtgagtctttgttgatctttgtgtggcaagcctgatactctaaatgcctgagcacattttaaatatatacttaggttttaatgaaaaattggagataaaaatttcagtttcaaaatttttattttcaatactttaaaatatttctcagttgttctattgcttccaatgttgtgtttgagaagtttgatgccaatttgattcttattcctttgtaagtgctctctgcaagcatttagaattttccctgtctcctaaatgttttaaattcactgtaatgtatctgggtgtgtctttttctttatgttttctgtttgagccctatttgtctttatttctgggacattcatctttgcttttattcaaatatttctttttctccctctttctctttttcttttgagactccatttacccctaccctttggatattggcacttctatatctatcttccatatcttttatcttatttcacagttttaatctctttattctttcctgccctctgaagtgttctcagccttcactctcaattccctaacctgcttctcagctctggctcactctagaaggcccatgtcaatagacctgtccgtggttttctaacttttaccatcacacatagcactgcagtgaataacctgcacatgtgaaaggatctctataggataaatgcccaaaatttgaattgtgagtcaaaggacatctgaatttctaatttctgataggtaaatttttctccacagtggtggaccgaattacactccacccagcaatgtgtaagagtgtggtttcttttacattttcctaatgatgaattgtgttgaacattgtttcacgtgtttattgaccatctgcatatcttctttggtgatatctattcgagtcctttgcccattaaaaacattgagttgtcattttgttattgggttgttaattcatattttctacttaattgttgcttttatacgtgaaaagctgtgggtctcaatattaattttgttcattgctactgtagtaaattttcttattatttgttgtactttttcactgtgttggatttttcaggcatgcaatcatgttatctgcaaataggctagctcctctttactgctgtttctcttgtctataatactcgtgttggctggtacctctaatgcaatgttaaataacaatggttacaggagacattctcgttttgtttctgacactctcaggaatccttctaatgatgtgaatttgcggactggaatagatttatattgataatgctatgaagtattagtctatattggcttatttaagatattaaaatcagactagatttaagttttctatggtctatggaactgatcatatgacttatctctttagagccaatgattttgtgaattatattaatttcctgacattcagtcatcctattattcctggaataaattctgcatagtcataaggaacacattcttattctaaggcattgttatattctgtttcctaatattttatttaagatttttaaattggaattaataagcaaaattggtgtgtatcttccttttctgtgtctatactccctgccaaatttcaatgttacttttatgtcacagaaaacatttagaagtttttctcatttttcaatgttttgtagcagtttaaaaaacacagaaaatgtctgttatttattaaagacaatgtaaattcccttataacattatcaaaggctattctggagactagcttattgacaactatattagtctgctggggttgtcataacaaagtatcacaaactaagtggcttaaacaacagaaatttattgtcttacagttctggaggccggaagttgagatcaaggtgtcagcagggctgtgctctgcggagaatgctggggaaggatctgtccaggactctctccgcttctggtggttccttggcatgtggcagcatcactccaatcagcatgtggcatcctccctgtgtgcctgggtctgtgtccagacttccccttttcagaaggacaccagctgtgttgaatgacagcccacctggctccagtgtgacctcattctaacttaactaacatctgcaatgaccctgtttccaaatgaggtcacaatctgagggactggggcttaggacttcaacgcaggaattcgggggcatacaattcaacccagaacaacaaccttatccatgtcttcactctatttaaacttcctaactcttttggagctcgttgtgataagttatatttttctaagaaactatccatttgttaaatgttttcaaatatagctgaataaaatggatcaagttaatctttatgattttattttctgttgctttttcctctgcaaaaataaataattaatttttaatttttgtttctggttatttctcccttattgttttttctttgtggtgtttaaaaagctattttgcttatattatttagcagtttacacattccaccccaccccatcccccaaccatgaacttttgtatttatttctcaattgtactgttttttccccaaatcactgatttatatttttctttgttaatgcttcctttatgctttctttcagtttatttttctttaaatgactaaatgtacttattttaaaataattatacagtaaaattgacattttttactctttgaaggtaaagtccatgaattataacatatatacattcatgtgactactgccatcaccacggtacacagttgttctatgacctaaaaagaaaacccccaaacaagaaaacttcgtgtgctgttgacacgcttgcccggtcccggccccatcccccactgatctcctttgctgtcattctgttctcccccactgtagttttgtcttttgggcaatctcatgctaatagaatcatcccgtatataaactttggagaccactactctcacaagcacagtgcctttgagattcattcagattgttctgggtgtccatacaggccagtctctgtggggctgctgcacaccacaccccctccccaccagcccacctctgagtgggccaagggcccagggtctatttcctgatagaaatctcaagcaacaagagtaattcctgacaagtgcccatttccttccctcatgacaagatgcacaatttatcttccgggaaggaacgcccagcctttggcataactttcttaagactcccaatctgctaattcatttcaagagaaaggaaaaaccctttgtttccaggtgagtgctgggagtgtggtatgatggggattcttcagacccaggaagtgacctggccaagggtcccctggtcttctccatccttccttccccaggttgccccctgctctctgacccccttcgcctgattccagctgtgtttttagtgctccctgatgttcctgcaccctgagaccctcaaccaccccacagtacaacagctcctgacacaccccgcagggcttttccatttttaggtggctcaaccctgctgcagcttttaactctgctagccagcaatttttttttcttttctttttttttttttttgagatggagtcttgctctcttgcctggagtgcagtggcacgatctcggctcattgcaagctctgcctcctgggttcacaccattctcctgcctcagcctcccgaatagctgggactacaggcgcccaccacctcgcccggctaattttttgtatttttagtagagacggggtttcaccatgttagccaggatggtatcgatctcctgacctcatgatacacctgcgtcggcctcccaaagtgctgggattacaggcgtgagccatcgcgcctggcttttttttgtttgtttgtttgttttaccacaaatgtcatacaggctggttgcaagaaaatgcaagtaacacataaatatattaagtaaaatataaattgtgctttcactgcctgcctccaacaccaaggtccatttcagaggtgaccactctttatggacagcttgagatatgtgcttccagattgttttgtgtgcatctgcaaagacacacacacacacacatccctcacacacgtgttcacacatacccctgtacttctgtagtagactcttggtgctgtgtagattttcttcatctggctggtgcatccttcccagctgcaccctactctggagactcaaccagggcagaagcaatctgtctcatccagaaatgtctggaagtggtacccagcccgtagagcagcccctagtcagccactgagtaatacaggcacaaaatccccgcccccttgcttggaggtggggccgctctgtggtagctttcgcattccagagctcccctgggaccaggctgaggcttccactggatcccttgcccggcttctcccctgcccttctaagcttcccctgagagcactttctcagcaaatctcttgcacataggcctgtgtaataggtatgcataggcacacgtagctgttctcagagaggagctcctgctcactgaagcagagggtggtgtctttcttcacatgacagcaccccatggccacctctgaatgtgagtctacttcactttcttatggcagcagagctccccctggaattgattaatagccctattagtgagattgagctcattcattcattagacacatggtttatgaagtgctactgtatgccaagtactgctttaagcactggggctgtctccaacttttctctcttacagaagatcggaatatttttaaagcatattcaagcatttgtgtaaatggttctgaagcacagattcctggagatggaattgtgggtcagagggaaactgcatttgcagccaggatgggtgtctcttggggaagtgttcctccttcagctccagcgacagctccttgctttgtgtctacttttctcccccatctctgccttggcaacctctcctccccagcccttcccacctacccagggaacacctgaaaccctggcagagctgctgctgagccctcccccatgctgctgatctgggcatttgcccttcctgctgcctcaggccctcagaaaccaaggcctcccagcctgtcttctctctggtccctggtttacggaagaggatgttgggattcagagaggttaagtgacctacttttctagaccaatttgttcaagttcctcccaaacatctccaccagcctgtcccagaggcacttcaaattcagcatcctggattattctcttcatgtctgccctaaaacttgccttttctgttccctataataaatgcccaagagaaaatgtcccatgacagctgactctcccacccctccttgtcaggcacaggtctcctgagctctcctgagcctgtctcctgggtctgccattgtgactgtcccctgcagccctgatctggatttgtggccaccagctcccttactgcttccaccagctggacatccttggtcctcacaggccctggagagttcatcttccagggctgctgtcagcatccccccttggctcaagcagcccgccggggactcaggagggccggtggcaccagaggccagcgcagtccgactcaggtcattccatgcaggcgcctttcaggtcctcaggacctggggaccagcaccacacacagctgtgggtcctctcgagccaataccatgtctcagcccctgtagcctgccccgtgctgccctcctcttacctcgcaggacctcctttcttggccccctggatagctgcctcttcctttccaggacagcctgggactctgggatttgccaatatatgtgtggggcatcagaggagctgagtgctgcctgtgaagggcattgacgacgtgtcggggaaatgggaaaggatgggagggtagacatccgggttggtgtcctagagatccaagacgcgcagctcaccatgctgcttgccttcaggtgcctcattggtaagtcaaaggcaacagatagaggctcccagaaggcccttcccagagagcaactctttagagatctaagcatcttcggagaaaatttgggagcttggatggtttgtatcaggcctctgttttttcttggactcttttgggtatcttcatgcccctcgagtgcttatcaggatgccacacggcacagcaggtggtgaatatatgtgtcataagtgagcgagaagcaaggcttttcatcagggaaagtatgacttctctgatggagcaatgtcactccattttacttacctgcaggaatgtttaacacgagagtgaccaggacactgcaagtggctgtgttagttggtaaaccttttcagaggacagtttagtaatccatatggaaagttctaaaattatgcaatgcctttaattttacttactgaaattctaaagaaataattaaggatgtgtgtaagatttagtggaaggttgatctttgcaagggctatttataataaagttgaaaacaacctgtgtccaataacaggagattggttaactaagttctggaacttagatacaatggaattctgagtagccactaaaaattatgttattgaagtatatttcgggtgtgggaaaaaagtcgtaataagttactgaattgagtcatgttataaaatagtatgtacttaatggaaacattttagaacaaaaatgtatatgctacacatttttaaacatctgtgagggtcttgctactcaaagtgtggtccccggaccagctgtttctgcatcattgggagcttgtcagaatcacagaactgcagcccagcacaacctcaggtgattcccatgcagagaggtcccaacgctgggttgcggcacccacacaaacatcacatctgtgtgtggggctactaggagtctattatttcccctttttgcttatttatttgtggcaactgtatgttactgacataataaagaaaaaagaaagatggacacactctgaaaaacacacagtgggcttcattgtcatggaagctttcctggctctttcctgtctgggacgccctcactgagttcactttaagtcccgctccttcttgggtgcatttgactctggtatggggggctcttggcttgaagagtggcactttcagaatcactgctgctttcaaaggggctctgctcctgccagacagggtggagactgaaggcccaagggccttcggtcccccagaccccacccagggcatgggccaggccccttgcttgccctcccactctgccgcatggtctgcccattaggatgcaggccgcttggcagattaggtcatttcttttccagtaagtgaattggctacttatgcattctcctgtagcaccaacaccagacacatttctcaatcctcctcccctggtaggacaaggccaggaacagactgtttccaccttccttacatcaatctgtcaggctgcggcaggtggctctgctggaaggccactgccctcgtccctggctgtccagaaaagtgtctttccccagttccagtgacgtcaggtggatgctgcacctgcagaggagagcagctgtctctgaagctggccctcgggtgacaaccccacaggcgatggtgagagcgaatgacgcttgtggctctcagagtgtggattacatgtggcaggccaaggtcttcgaagctctgaaataagcaagatcttctccccccaggcaaagcatagactaagccctgctctttcttccagttgagcaaggaggatccagaggctggggatgggttcccatctgacttggttctgaagcccatatcctgggagtagagttgccagcatggtgcctgaatatggtgtatggtttcccatgatcaagggtgaccaaagttttaaagacccaagaaagtgctgagtccagtggcctgatttcacttgctttattttttgctgagtactgaccttccgtcagggtttagggccaacttgtgtaggtagggtgtggggaggtccgcacctcgaggagcccagcatgggtgtggggggctcgtgctggctggttgcatccgtgcctgagctcagccttcttacacctttgcccatgaataccaccccctgcccccgcaccctcattttcagaaggtcccacccaggaaaggggaggtgccaccagctatggtttgggacaagctgggccctgcaaccagtgcttatagtggggagggggtggggagcgcaggggaaggcatgggtcacagtgtaccccatacctacccagccctctgcctccttcacctttgtcaccccactgtgtagttgtcacctgttcccaccgcgtctcccacatggcccctgtcagcctagggatcagcctgctatcagcacctgccgcctagtcctagccgcccactccaggggcctcctgctgcacttgcccttctcagagcagccactaccctgcagacctgaccagggtggagcatgtacagcctgcaccattgggaagacctggtgaggctcaagctgaattattctacatgctttcctgtgagttccaaaaatgtctgaaaaaactgaagaacacattgagagtcctcagccactcctctctcctccgtggatgcatttatttcactgtcttttctttccttcctgtctctgtttctcatggaggatgctgtgtcggccctcaatactgggggctcactgaccttcctccagcctcattcattcctcagatgagcagtcctgtctcagggctgaactcccctctccattaaattcctgcttctaaggagcccccagactggatcaggggctaccacattcacccacctctggcagcctgtacacatggatgcaataatcctggaagttcccaagaaggaaacccccactgtgtgttctcccaggcctcctggggtgcttcctagagcaggtgggaggagcaggaaaagtggcttcaccagcatctcttgatggctgttgatagaaatgttatgcagacgggtgggagtggggagggatacagagccaacgaggcccagcactctcctgagggctaatcttcggagtccctggcaggaggcagggagcaagtaatgaaggagcaacgcccagcaggagggagtcatcggactggagaccaagaaaggcccaaggaggcactcaaatgctgaaggaataaatggtgggctctggactttagttagcattccttacaatgtgttagacgagaaagggtctgggttcaaataggctaagaagtactgctcgcccccagttaaatgtgttcatctgttgcagagcctctcagagcctctctgttcattttcatcagaattgagaggaaaagttggcagtgagtaaagggagctgggaggcgacacgaggaaaggactttgtgggtcattgatccattgacccctctcctgtaaactctgcctgcatggccatcactcaaggacagctgaagggtggcctggaagggcctggaggaaaggtggtcattggggtggaacccaggacagtggctgtgaggatgtgggaggtgggtggccagtggtcaggacagggttctcccttggataaggcctgggccctgcgtggtcaccgtgatcagggcgggccagggcaccttgaagtaaggcaggacaaggaggcccggaggccatgagctgtgggagggacctgcgctcccccagggcttgcagagcactaggtgggcaaacctggccgaggcctcactgtggccctgtcctttggttctgggtatccctggcctttcccgggagggagaagcagcagcagattgtcctacctcggacatagcgggctccttccttccaggggcctgactgacctggcggcactcggggtagcctgctgggcgttgactcttgtcggctcctagccctggtctcctgggcaaacccctgcaccaaaagaagaaaggcccccaccagctccatcctaatctcgacccgcttgtctgcaagaggctaaaggagcctactcgactctcattctctgattttctgtcctcccctaaaacctcaggctcatccctggctccaagcccttcatcttctgctcttattgcctcccggcgcccgggattttgggctttctaacgccctccgcagcctgccaattctctatcacctaaggctgaagaactgcgtttgtgaagagggagtgcatggggccggggcggggctcccgtggagagggcggggcctcctgcggagggcgtggcctgagtgtagggtcgggggctgtgggcggggcggggcggggtctgagggccctgctgaggaaagccggtgcctcctgctccccagccctgtgctcccgcgcccccagtctcagcgggttccggcttagtccggcaccctgggggaatgctgcgctctggctggcagcacgccctgcctgcgctcgccccgtctttgctcctggtcaccatgcgtcctgcacagttaccatccgtgcccacatgctgccccggggtcgccgtgtccagatgtggctgggtcttggtgtccccgctgcgctcgtccctcctgccaccaccgtttgcatatgggcctttccattaagaatcacgcgctccgggcagggccagcgcgctgcgggcagctccctaagaccccgacgggcgtaagcctctctgcctctctgtccagtctggcctgggacagacacctgtggacacctgaggcaaagggaagtcggggcccagggacatctcaggggaatagggtctcgggaaaaagggagaggctgggctacgaaggggagctggggtaggcaggggagcacagccctgcaggagggcaggatgcccgcccggggcggaagagccgagggcaggccctggggcggggcgctgggctatggagaccacgctcctccgcccagtcctgtctgtccgaagcgacgcggcagggcacaggcgtccgcagaacccgccaagcgcgggacgggcctctgctcctggctccgccggccttcccaggccccgggagccaggaaggtctgaatggagtgatgcgcctggacttttgttcggaaatcccgcgtggagggcggcctagcggggagaggctggaaacaggcgaggaggagcagggccgcggttgtacgggacaacgggaaccgggtcttccctcgctaagaaagggaagggtctcagccttactgagaggagcccctgtggaggaagcgggcctgcacctgcggcttccctgcaccccgcacgccgtgcccaggcacttcctccccaacacaagcaaaggtagcccagctgcagccggatcctccctgagcgcagcgcaggggtcacagcccccgacagctgcgcaagtctattcctcccccggccttttcagcggccgtccagagctcagcatcagcgctcctggcacagaccccactgctgactccattcactcccctacccccccttaagctatttgaacttctcacgccctccacctgcagggccgggttatgtcaccggctgacgtcaacagctgtagaggaataggagcaggtttccgttttcctctcccggcacctggccaaatgcccagatatgcacccactccctactgctgcctccttatggctgcccaccagccccactgagatcgaatggggagcctgtaaatcctgatgtcacccagtctcggggccgggagaagctctgagccaggcccccaaacctggcagggtccagggctgggggcaggtcaggggcctagcctgttctcctgctgcctgccatggctggctccaaggagggtggaggccacactccacacacttctgtcacccagcaggctctctggcctcagctcccactgggcttggacagtgggagcaccagcagggttcagagccacctggaagcagctcactctccaggtcccaccccatctgggagcagctctctccccaggtacccccgcggcagccgtgggggtggccttctctaccaaagcctgctccttgctcctgccagggccgtctctaaggcgacagccacacctgctgttgtcccatcaggcctcaaagaggtcacgtttccctgtcctttccagtctcctaagccccacttacgcctctaaacagactctaccgatgccccaggtcagtgttggggtcctggctggtgcagctggtgggtgtttgctctccttgaattcattctagtctttgacaagcatgcattgagcacctgttgtgtacactaggcctgtttaggtgccaggacaggaggagtatgacttgggtcctggcctgtgagaggccagggcaaaagcagtggggaggaggaagtggtggggagatttagggccccatgtgatccccagtaccccaattcatgtcccaaaacgaaaaaaaatggtaactcttggccatgttgtgcaatagtccctaatcagcaatgtcagctgaggacacgtccggtccacattatatttaatgatggtctagcactgtcattacccattttttaacaagatggccaagaaagccacccttgagggcaccagattgtcttcctgctgtttctgtcatgctctgcttctgcacacaggagacacactcacaggcaacatgcagacacacatacatgggagacacacagacacacacacacacacacacacacacagaggagcgaagcaggaactagaggctggccagctctacctcttctccaccaacatgttttgagtcccctcggacaaatcaggccccataaggtatggggtctccctccctggtggaggtcacctaggtggttcagtcaaagcccccagtggtggacaggccgagagcaaagaggcttctcttggtccctgtcactcctccctcctacactctcctttcccccttggccccaaagaccaaaccatctcttggactcagaggcctgtgaggtctcctgggggtctccaggcctggatgcacccagctgcttctcctgggcaccgaggctcccggcacgccccctgtgactgggctctcatctcatcttcacctccgtgtcgttcagcttgccctccacccatgctggtcctactggccatggaaagccgctgctgcaagacatccttcagtgactgtcctggctttgtgtccatgcccagacttagggggaaggggagaagcaccaagtcttcagcacagagtcagtgaggggagaggaggtgcttccagtggttggaaacgttcgatttctttttaagagtaagttttagctgataaattccactcccgtcgatatctttttccagagaacacctacggagataaggaggtgtgccccaccctgaggggctcggggagagagaacaagcaggaggctcagcttccccatctttgtgtcaacagccccttcagctctgccatcctttgtctaaactcactctcccgcactagagcacactgtcctagggggtgctgtgtctgctccccctacctaggtcccctgcaccccaccccacacccccacctgctgaatgaatgaattcagcaagtgaatgaacaagtaaatacccaatatttccttgcacaccttgcactttgcagaaaagagttgggtgggggcagttttaattcttctgtgctctctctttccatctataaatccctacccttgaccacctgggccatcctcacacagcccagggacacacacagggctggctgtcattcttgatacccttcccattgtatccttcctgtccagtggaccccctcaaaagacaggaaaatgactgtgaccactatgtaaatagggagagatgccttcaggagtcactgctgccttcaggagagaccagcacccatggaaaggagccctaaggtctctacgggtgtctgttttcatttggacaagtagcttgatgaatgcggacatgcagtggtaggttggaagtagaggcaagagcggggctgaaaagagtggacctgtctggaaagaagtatgggaacatcgggcatctcttggaacactgcaggaaggtgcaggaaggaacagcacagagcggcagcctcagcaggagcaggaggccactgtccactgagcaccttcaggtgtttgccaaagtgcaacatgcacccttccccgaaggctgcctcacactcggccttggagctccacggtgggatttggggaacacagagacgtccacagtgaaacgactccatgaactcagctggcagcaataggagcttcagatcacaggtgaccaggagaatacgtgcccctcaaggactatacaaacctgggggaggtgctgggttttccacaattccacccgacctgtaccctgggacacctgggagaccatagggaagtgggtgctagtgaggctactgttgctgccccccaggcccgtggtgagggcagggtgcaccatcacagccgttggccccattggcagagcacactcatatcaccccctgctgcttacaccagccttgtctgtactcaggaatagggacagcaatcgttcccattttatagatggaaatctgtgtcctgcggagaggacataattgactgtacctagtaagtggtgctattagggctgttactcggacccctgtcctgagcctggacttcctcctgccaggcttggagaaccccatcagcccacccctgcaggaaccaccagctccacactggcttcctaacccacaagcatcgccaaatgtccatccccccgccccggaaaacattcagttgcatctctatcttatacccttcacaaaatacattttgggtggactaattctcacatgcaacatccacagttgcctttatctaagtcttagagtcaaaaacaagaggataagtttataaacttaggttaagaatcttcttaattagcacacaaaaatcaataaatgaaaatagtgataaacttgacttcaccaaaatgaaaattttccgtatgataaaagattccacaaacaagcttgaagtctttctaccaaatggagaaataatttgccatgcgtacaagtggccagaaaatacaaacaagtcctaccaaccagtaggaaaagactaacaatgcagcgtgaggcacaggccaagaagaacaagggcaagcgcaaacacaaggtgggaggtgggcaagctcaccacggccatggccatggccactgagggatcctgagccacgcccaggtcagcactaagtttccatcagctggcaaatgttttgagttcataacacctgggaagggtgcaggagtggggagcaggtgttttcttcattgccagggattgtaaaggggtggagctgccctggggcttccaggcagtgcttactgatgtgccactcatgcacccaggagctggcacttccatcctcagactcccccaaggctcccccagtatacatgagagcaggtacacagatgcccagcagcactgcctgggaccctgcgtgaaaactgaaaggtctagaagcaaatgaaaataccatttgtaagaaaatggtaaaaggaaactatgtgcctatgtttgcgcacgtgcatgtgtgcgtttgtgtgtgtgcatccatgtgtgtacgcccatgccatggaatacaatgctgcaatgaggtggacaacgtctacaatgaggtagacaacgtctacaatgaggtagacacaggatgatctccaaggtcagtgaaaatgttccgtgcacaccagacccactgctcttggaatcaagataaacccactccctgccttccaggccctccctggcccctccttcactgcctgcccttgcccccagcccagctcctgggccctctgctctcctatggcctttctctgacctctcatccacctcaaggctgccacgcatccttcactctgttctccccactggagccggccctgaggccgcttcccaaagcagcctttgctaaccactgcccctcaatgtgcaccatgctcctcgctgaggtgagacaggtgcccaggggccctgtctgatcacatgctgctcgcacagcatgctctcctagctggcacctgggaggtggtgaacctgcatgaacatcagctagacggctaagtggtggcacatagattcggtgtcgtgtaaatgagaggcacagaaagcggtgctctgggctgggggcagggggtggctcacgcctgtaatctcagcactttgggaggccgaggcagtcagatcacaaagtcaagagatcaagtccatcttggtcaacatggtgaaacccactaaaaatacaaaaattagctgggcatggtggcacgtgcctgtaatcccagccactcgggaggctgaggcaggagaatcgcttgaatctgggaggcggaggttgcagtgagccgagatcgcgctactgcactccagcctggtgacagagtgagactcctcaaaaaaagaaaatgaaagaaaaagaaagcagcactctgtgtttctgtgggcacgacctgtgggctcatgcgctcaggaggctctagaggcactgacactcatctccgcccatgcctcctctggcctcatggacggtggcaaagtggaaacaattttaatcaaggtctgtatttttaacaaaaaatgtattaatgacttcggattcttaggacttgtgatttttcacctttacactggtgtgaccgcaatatgcactcggtagaacacgaacttcagatttggtgatatgcaatacaatgatcccttcagatgctgggcagtggcgtgagcacagctctcggccaacatatgactgcaggccaaacagctgctactccaggacgctgtggcgctggctgattctgcccaactgtaggtgaaagtgagtgctccaagcgcgcttaagcgggctgggctcagctgtgatgcttgctagattgggtggattaaatgcactctcaactcaccttattttcaacatatgatgagtttatcaggatgtaaccccctcaaagttgaggagcacctgtacagtaaatgaaaatataatgaggaaaagattctcctgctcagtcgctgtttactgaggtatgatctggggcgggaaactgggcttcagccctccaccacggccacccagagggccctccttgagcatagagaggggcttctcatcgggaaaggcaggggagacttcccgggtgacgctgagcagaaaccaataggcaggcaagacacaggcaggggtggcacgggaaggagagaggtggtcccagccgagggggagcgcaggaaaaccccagagatggaggaaaccaacgtgccctgcctcctgccctggatggagaggcccaggccctgaccaccaaggcaacaaaggcctggcccagcgcgtgcggccagaacttccacccctgtgcatctgtgagggatggaatctggagcaggacctttacaggaacccctgttcctctcaggaagggacttggggcttcctaggttgtctacaatccccagagcatccctttctcatgactgccatggccccacttggcacaggcctcagcctccttcccggtgctctgcggcctttcagccccttctccccttctgggccccctccagacttcagtgggtctggagacaataagaatttcctaattccaggctgcgggtgatggatgcagcccaccaggcccctgccacggggtcttcaggaagccatctcccttctccttggactctgtaattaaagctggggataacctactgtatttcctaattagcagccttaatccctcatgcacaccattaacaggctggcgcatctttagatgtgattggtaatgtcgttagcctaatccataatcaatacttggataattgcttccttgggtttatatttagtccttggggtcttgggctggggggaacatccatctgcagatgcactaatggctgtgtggaggtcgcccacggaccgctcacccaggacccccaggagctgtggcctgtggtcagagcaggtgctgccacagcaccggagacccaggccctggtgcatccagggatctctgcaggctgcggttgcgaagcctcctggtccatcaaggccttgggctctggttccagaacactaggggttatttcagaaacaaggtcaggagaccccagacctcagacctcagaccatggcagtgtccgcacgtccccaccccacacatccccaccctttcagaagagtctgcggggggtacagaggatggtcccagactagagctgcaggactgtcacagcctgcacattcctgctccacgcgggccccagcgcccctcagctccaggcacagcccctgtcctcgcctcccccgcttgccaggaaaccgtggcccagcccgacgtgatttcctttctctcaaaggctggcggcagctttggcagctcaaggacaggccagggcagaagaagagcagcctgtcgaaggcagcccttatgaatgggatctcatctgactgtaactggaattcgtatggaggctccgcttacaggaacttccccagcagacgaatctgggccacagagttctgagctggaatgccccaggagccagccataaatctccccaaaatgagggtgcacaatctcattgctctggaggtgcgctgcttgcccctggagacgacttgtcattctgcgtcctccaggctctgcagagagccaggagccgggccagggagaggtggatgggagttggcaaagtcaccgtgaaggtaaacatttttatcatttaattaggagcctctcagaaaagcaagctctgtttcgtctagagctggtcaaaggaaatgagaagtgacattttcccacccccacgttccccttggcccgggaaactccaagctggaggcgcgggatgtgggcagcctcaggctgtgcacatccagggctgggcccaggggcagtggtggggcgtgcagcctttgctgtgctctggccgtgcccggcactctcgctccctcatttgctctcataaacgccgtctgcattatcgatcaccctctgggtccctccataatgcaggggcttcaaaccgcacccgctccttgagggtgctgcattcctgtactctctgcatctcccaagcatatgtgtgacagcaagatggctgcagatatgcaacttccaataatcaatcaactcttaaatgatcctcaataaacccttaagtaatgaccaggagcccctcaccagcatatctgtacccatttgttgctccatccatcccaatgcatgactgacaagtgttcacacacgtgtcacccgcaggctccactccagctttggaggatgcaggcaggacgtcactctggggctcctgtctcctggggagatgacagtgagggagggacactcatgaagaacctccctagccagttcctgactctgcgactgcccagactctgagggtactgaccaacagagctcactcagctacacagagatgaacctggaggcctagaagaggccggcctggcctgggtgcaaaggccccaggcagaagagcccagatgtcctcacttctttcccagtatggggcacccaaaacatgcagctccattttaatgagcagctgctgtcctttttcagctgctatgggcccactctgtccaggctgcagcctctgggcagcctgaatccagccaccaggtgaggcacatgcatggagaactgtaagaacattgagacttcgtgcctcactttacagggcagcaaatggaggccagagagggcaagatacatggccagggatgcacaggagcaggatgaggaaccgggccttgctcccaccctgcactcggaggcccaggtccacctactacagacaaggagtccgtgggccaggggtgggactcatctgtgcacggagggcccaggctgttttttctcaggagggacaaggctctagtcaacactgcatcagggagggacagatgtcatctattcagcagggggttttagcagcttccttagttcttgggcttcactgggtccttctgccaacaagcatggcccctggccccgtgtggacactctcccagggcagaggccatggctaaccagcctgagctgctccagatagcccagcagagatatccaagcagctggagccagccagccctcagcacatgtccatttattcttgcagcagctacttactgggcctgggcggagacaagatgatccattctggatgcatatatatgaagaatataaagcagggctggtgggatggggacatcatgcaaatgtagtggggtgctggagaagtctgtctgccaaggtagccaacaaggagaagccagatgtgctgacagctgtctagggcggagagcagcagagcaaaggccctgtggcaggaatggatttgctgtgttccaggcaggagaaaggccagcatgatggagccaagtgagccagcaaagtgaaaaggccagagaagcctgcagcctggggcatgggttccattcccagtgcaggaaactgggatttgaagcaagggttggcatggttgatactttcagaagagtcagtctgagaggggccctggatgccaggctgaggaggtgggacttccttctggaggagaaaggaggaccaaagaggcttttcagcagggagctggcaggtcactctccagctgtgggagccagccccttctccgggagctgtgcgggtgctgggcgccatcaagacagctccgctcctcccagccgtgagacttgggacagagtcaccctctcaaattctgttttgttctctgcaaaatagacataaaattttagacaataaccagctactccagccaaacaccatataaaaaatggtggcttgttcccactcacaccatcaaaggccgagtggggagcctggacttccaccctggccaggctgtaatgagttgcccaatctccctgtctccctgatgagtggtatcagagagggctcagtgaggggccaggaccttcatccccaccaggcagtaaccagccccttccaccccgtggtgtcagtggaggctgcacagggagcaggagccttcgggggaacctggactcctactcccaccttccacactgtgcctgccagagtggtgtcagaagccgccagctaaaccagaaggtttcaactcacattcagaatttcataacatactgcacaaataacacaatacaggagctcagcagcagcatggggggacaaaggaacacatccatgaactccaagagaaactatagaaattatttaatctgaacaacaaagctacaatagattgaaaatgaaaacaaaaagaacaatccctcaggaacctgtgagactgtaacaaaacatctaattcatgttattgagtctcagaaggagaggagaaagaggtgggccttaaaaaggactcaaagatacaatggttgaaactccctaaatctggcaaaagacacacacttacgaattcaagaagctgagttactcaaataggataaaccaaaaaaatccacaccacgacacatcacggttaaactcctgaaaaataaaaacaaagaaaaaatcttaaaagtagttgggagagaaaagaccccttcctacctatagggaaaaaaaataagaacgacgacagatttctcattagaaagcacagaggtcaaaagtggcacatttttcaagtgctgaaagaaaataactatcaactcagaattctatttccagtaaaatattcttcaggaacaaaggaaattaagatattctcaaatgaaagaaaagtaacagaatttgacaatagctgacctaccctagaatgattaaaggaagttctctaaacagaaagaaaatattaaaaataaggaatcttgaagcatcagaaaggaagagaaaaacagtaggagtaaaaaatattggtaaacatttccttctcatttttggttttctaaattatatttgaccgttttcacaaaaattatattgtctgatgtatttctgaatgcatgtcgagaaaatatttaagacaattgtattacaaatataggagggtaaagtagcttgaaggggcatgagttttctgtactctacttaaactggtaaaatattaacatcagtacactaaattatgtatatataatgtaatacatcaaatagccgttttaaaagctatacaaaaagacacactcaaaacacactataggctgggcatggtggctcatacctgtaatcccagccctttgggaggccgaggtgggcggatcacgaggtcaggagatcgagaccatcctggctaacatggtgaaaccctgtctctactaaaaatagaaaaaaaattagctgggcgtggtgtcgggcacctgtagtcccagctactcgggagactgaggcaggagaatagcgtgaacctgggaggcagagcttgcagtgagcggagatcgcaccactgcactccagcctgggtgacagagtgagaaaaataaaaaaaaaaacactatagacaaatcaagctggaattctaaaaaactttaaataacccataggaaagggaaaaaagctcagatatactaaaaatagtgagaacaaacagaaaaccaaaacaaaacataaaatggacaacttaagccctaacatgtcaataattatgtgaaaatgcaaatggtctaaatataccaattaaaagacagagatggacagaatacactaaaaatatgacccacctatatgctgtctataagaaactcacttcaaatataatgatatgtgtaggctggaagtaaaatgacgggaaaagataccttacacaaacatcaatcaaaaaaaagaaagcaggaataagtatattaataccagataaagtatattttagagcaaagaaaattgctggagacagaaagggtcattatataaggatgaatgggtcacccaccaagaagtcatagcaattctaaacatgtatgtacctaacaaaagagccaaaaaatatgtgaagcaaaatctgatcaaactaaaatgagaaatatataaatctacacttctttcaacaattcatagaactactattccaacatagaactactttcaataattcacagaactactaacagaaaattagtaaggatatagaactcagcaacaccatcaaagaacgttatctattcaacagatggagaaaactccatgcagcaaaagaagaatacatattcttttcttttcttttcttttcttttttttttttttttgagatagagacttgctgtgtcgctcaggctggagtgcagtggcatgatcttggctcactgcaagctctgcctcccgggttcatgccattctcctgcctcagcctccccagcagctgggactacaggcgcacaccgccacatctggctaatttttttgtatttttagtagagatggggtttcactgtgttagccaggatggtctccatctcctgacttcgtgatctgcccacttcggcctcccaaagtgctgggattacaggcgtgagccactgtgcctggccaaatacacattcttttcaaatgcccgtggaacatattccaaaatagactgtatgtaggccttaaaataaacctcaaaatttttaaaacaattgaaattttgtagagcatgttctctgactgtaatggaattcaactagaaaccaacagtggaaggataataagaaaatctctaaacaattgaaaacaaaacaacacatttctaaataatccatgactcataggaaatctcaagggatatataaacaacgttagactaaatgaaaagaaaaatgaaaatgcaatataccaaaattagtaggatacagctaaaatagtgctgagaagatggtggatagcactaaatgcctacatcacagaagagggaacatcttaagtcattaatctatttttacacctcaaaaatctagaaaagaagagcaaaataaacccaaagcaagcaggagggaataataaaaataaaggcagaatgaaatttatgaaattttaaacagagaaactatagataaaataaatgaaacaaaaaagcagattcttttaaaagatcaataaaattgataaacctttagcaagactgacaaagaaaaaagagaaaacacaaatcattaatatcgtgaatgaaacaggatatgactgcagaccctgaagactgaaggaaatcaagagaatactatgaacaactctgcacacataaatttgacaacttacataaaatggatgagtccctccaaaaccaactacaattcactgaatgtgaaataaatagcctatagccattagtaaaattgaattcataatttaaaacctcctcaaaaagaaatcttcaggtcgagatagtatcactggaaaattgtaccaaatgtttaaagaagaattaacaccaattctacacagtcttttccagaaaatagaacaggagcaaatgcttcccaatactattggtagtattaccctgacacaaaactaattctgtcttagtctgtaaccgactaagaaataaaaggaattcagactgggaaggaagtaatagctgcccctgtttgctaatgacatgattcatctgtaacagactaagagagtgttaaaaaagaaaaccataggccaatattcctcataaatatagatataaatattcctaacaaaatattggcaaataaaactcagcaatatataaaaataattatatgccatgatcaagtagggtttattccagggatgcaaaagcagttccaatatgtgaaaatcaataagtgtaatccacttgataaacaggctaaagaagaaaaatcacataatcatattaattgaggaagaaaatgtatttgacaaaattcagcacccttgagggatgggggtatggggaatgactggctgtttaacagtctgggcttccctctggggtggtaaaaatattctggagctagacagcggtgatagttgcacaacattgtaaatgtcctaaatgttactgaatgtacagtttatactgcttagaatggtaaattttaagttacgtgtattttatgaaaacaaaaaattaaattcaatacctattcataaagaaactcagaaaaataagaactgaggggaatgtcctcaactcaataaagaacattgacaaaaacctaacatttaacattatacctactggtgaaagactggataatttcctcaaagatcaggagaaaggcaagggtgcttctcttgccacttctgttcagcagcatcctagactttctagacagtgcaataaagcaagaaaaagaaataaaaggcattcaggctggggaggaagaaataaaacttcccctgtttgctaatgacatgattgtctatataggaaattctaagaaatttaccaaaaaaaaaaaaaaaagccaaaaaagcaaaaaaccaaaaccaaaacaaaaccatcactaataaataagttcagcaaagtcttgggatatgaggtaaacatacaaagaaaccggtgaatttctatacactagcatgaacacagggacactggaattaaaaattacagtaactaaaattgatgaaatacttaggtataattctaacaaaacatgttcaagacttatatgccaaaaactacaaaatgctgatgaaacaaatttagagaaattttttaaaaatctagataaatggagagacttactgtgttcatggattggaagtctcaacataggaagatatcaactctctctaagttggttttcaggtttaacacaatttctatcaaaatctcagcaagattttttgaagatatagacgtcattctaaaatttacatggaaatgcaaaggaactggaatagctaaaacaattttgaaaaaggataaagtgggaggaatcaatctatgtgattttaatatattatttagctacatttatcaagactgtgtagcattggtggagagttagttacatagattaatggaacagagtagagaacccagaaataaacccacagcaataggtccagctgattttagacaaaggtgcaaaaataattcaatggagcaaagatgatgctggagaaatcagacagttgtaggccaaaaccaaccaaacagaaacctgaaccttcacctaaatctcacatctgattttttaaaattaacttaaaaaggataatggatttaaacataaaatgtaaaactataaaacttttagcaaaaaataatagaaacttttcaggatttagaactaggcagtgttcttagatttgatgccagaagcaaaatccataaaaagaaaaattgataagttggattcatcagaatgaaaaccttttgctctgcaaaagatcctattaagaggatgaaaagacaatctacagactgggagaaaatatttgcaaaccacatatctgacaaagaaatagtctaaaatatgcaaagaattctcagaacaaaacaacaaaaaatccaattagcaaacaggcagacgtaaagcgatcttttaccaaagaaatggcaaataagcacataaaactgactgtcagcaatgtgtaaactaaaaccactacacccttatcagaatggctaaaataaaaataaaaaaatagtgacaccagcaaatgctggcaaggatacagagaaactggatcattcatgcattgctggtaagaatgtaaaatgataaaggcactccagaaaacagtttgtcagtttctttaaaaactaagtatgccactaccatatgacccagtaactgcattcctggcaatttatatcagagaaatgaagacttatgcttactcaaaaatctgtacataaaagttcacagcagcttttttagatagtagttgaaaactgggaacaccccagatgtcctttattgggtgaatggtttaaacacactatggtacatccataccatggaatactgctcagtggaaaaaaggaccaaactcttgttacacgcatcaacctgggtgagcctgcagagaatcatgctctgtgaaatcgccagtgccaaattgttacacactgtatgattccatttatataacattcttgaaatgacaacattacattaaaatggtgcaaaagtaactaaggtttaatagaaatgcagactaggttagcttaatggctcccaggggttaagggcaggatggggttaggggcagggaattcctctccttgagggagctgggagggaagtgggtgtggctataaaagagaaacgtgagggatcctggtggggaggggatgttctgtctctccacagtatcaatgtcagcatcctgattgtgacattgtagtatagtttgtgtgtgtgtgtgtgtgtgtgtgtgtgtgtgtgtgtggttttttttttttaaaatggactctcacacttgttgcccaggctggagtgcagtggcacgatctcggctcaccacaacctccgcctctcaggttcaagcgattctcctgcctcagcctcccgagtagctgggattacaggcgcgcgccaccatgctcagctaattttgtatttttagtagaaagagcgtttctccgtgttggtcaggctggtctcaaactccctacctcaggtgatccacccgccttgacctcccaaagtgctgggattacaggcatgagccaccatgcctggccaacactgtagtatagttttataagatgttacctctggaggaaattaggtaaaaagtacacaagatctctctgttttatttcgtagaaccgtatgtgaatttacaattattcaaaataaaaagtttaattaaataaaaaaatcactaaaaaaagttgcctagaagatttaacaaaattaaaccaatctgtgaatttaatgacataaagcatccaactttattgcttaattgttaaacttcatccaagcaatatgtagacattgcctaaaatatttcaacatattacaaggtttataaagaaaagtggcagtcccctgccctaatccccatccctagaagcattccatgtgagtctgttggctgttccttctcacgtttacttttatgattctaagtaaaatgcttaggctgccggttcttggtttttccattttagtgttaaccgaatgatggacttcttcccagggtaaataacagtcctgttcccttacacatcccctccaaccgcccccaccccacacacacatccttccctctccacttccttccaatggagttagatcatgatattgggtcaaattaatgttttatttttaacacttggctaagtaaatacccttcacagctgagtccgaccgttttctagccatccgtatcgtatattcatgcaataaatggttattggcacccaatgtttgccgggcactgttgcaggtgctggggacacagcactggaaaagcaaacagggtcctgtcctggagaagcttccatttttgaggattgggagaccaataagaaacaagttcaggcatattttttccggagataagcaccaaggaggagccccggacggggtgccatgagcaggggtgccctagggaggcctgaggagaagaccctgccaggggctgaggggagaagaggggacttgcgggctcctagaggaagagctcatccaagcaggacggcagaagcccaaagtcctgggagtgagctcgctgtcccgaggcccaggtgaaggggctgatatggttggggggagtccagctgagtcccttcttgccacccggggccccactgccacggggcgtcactcgcttctcttattaatgccgtcaccaccccttggcttcagctaagtttcagctttttccactctgaagccagcacctctcatctgttccgttctacccgcagcgttgccctcgtcctccccccaccctccgcctcatgggcgcaaacactcgggagcacacgtggagggtggaggcggcacagagacctccccagggaaatgaggctccagctggatttgaacacgcggggaggaggtgaggatgctgctttcccaacagctgggccgcctcgtccttgtcaccgctctggtttctcagcccaggctattttgggtcaggctgcgaggaccgctgcgtcagcgagtgggcgtgagtggcggcgcctacctcccccagttgggccgggcacagtgccaggccaggcccacccaggctgcgccaggggccgccagcctctgggcggcagggggacccctggaaccagggagagtggcctgagcaggaaatcaggtcccaggtaacacgggcttcagcgggctcaggctggggaggggacaggtgtctcggactgcgggcggaggaaccgcgcacatcagagggcagcgtctcagggcgggctgggatctggggagggattcgccaggaggggtcagtggcccaggccttccaggctgagtggcgctgggcagaggcacgaccaaaggcaggaggctctgggactatttagggaggagggaggctcaccgaggacacagaggccaggctgggaggtggccaccagccaggggcggggcagcaggtcagggagatcggatttccccagctcccactggcccgcgccttgcaagccggagatttcccctgctccgtggaaccctaacagctactctggggccttgcgccccatcccaggaggcccaccccctctcccggccagttctaccttctctgtctcagcaacccccacccttgcgactgaatgaagcactctgaacagagaccttttgaaaaaagtctaaatgtccccttcttaggtgagggaagcaaaagggaaaaatagaatcgacaccaatgacctattccagtctcccctcccgactgcagaaaccagcagagccacatgggcccacaggcggggcaggcccagctgcaggcaccaccctcctccctgtcctgagccgggcttgctctcagagcctgctgctgtccccaggctagggatgcgcctcccagcgggaacccctgtggagggaaagccccgcccagcccgaagctcagtcgcgaggaactgccgtctgttgagcactgccaggtactttttgactcatgggtcgttttgctctaacatgtgtatcccttaaaactcagaagagagtctggtcttgtttactcgcggttttttttgtttttgttgttgttgcttgtttgtttttcttttgaacaaggaggaagaatatctataggcaggaagtccccaactgtcctagtccccaggctgctattaaaaagtaccatagactggggacttaaacaacaaacacgtctaacagttctgaaagctggagggccaggcaaggcgctggcagatccactgtgcggtgaggcctctccttctggctcatccctggtgccttctcctgtgtcctcacgtggtgggcaaagcagctctctgaggtccttgtgtaggggcaccaatcccattcaccagggcaccgcccctgtggcctcatcacctcccaaatgtcccatgtcttaatgccatcaccatgtgggggagggcttcaacctgtggatttcagatacacactaggcccacagcacacactcaggctgaggcctgctctaccatttccgcagacccctctggacccgtcgcggtgctagtctgcagctctgttcagcacctgctgtgctcggccaggctgagggcagtgggtgggcgaatactcctgttccctcccctaaagctcaagcaccccttccagcaaggttctgctgtccctctgtcacaatcaagggaaaacgaggtactgagggtcccatggcacggccccgcagccaatcaccaggactaggcctgggagtcagcccccagctgtcatgcctggaaaccctgacctcacttactgccaggcccagggagggctgtcacttccctgggaagggccctccatgctggggacatactgagagtgccgactgattcaaaagactggaggagggatccaaggcaggaggcctcctgagggcctgaatggccacagactgtaggcacagggatggagagaggatgctgtgtgtgggcaggtcagcgaggaaggttggtgggacccatgggcctaagggtgaggaagagtcaaagatgacttgaggctttccaggggcacaaaatagaggatggtgaggccatcagggatggggcaagctgtagagggtgccgtgaggggctctggtggcggagacttgagctttctgagtctaatgaaagaaagagaaattggagagaagggccccaaggggtactgacctgggccgggctccagcatccagttcctataggggctatgaaggcctgagattagggtccgtctcaatttcagggggatttctctgctgtggccaaagcagcctgaagctaggccaggagttttgtctcctcactgccttttctggagtgccttgtagggattaatgcaggagggaaacccggttgatttcaggtgtgcaggggtcttgggggagaattctgggtgaggagcctacaccatttgtcccaggtgcagcttcgcccaacacgcacaggctcagcagggctggtcaggaacgatcttgaactgtcagcaccctcaatgagcctttgtatgaactggaaacagacggtgacactgaatcagggtacaccggggtccaggactgggggtggtccctggagggatcacagcccccctctcacagggcatgacccccatacctgcgtgctgtgcccctgaacctttgggtcccatggggttaccaagcaagcactggctcccagccttgtgacttcaacatggccaggagcactgtgcaggtggcctcagagaaaaggggcgggagggcccagacttttgctgggcaccccacctcccaggagagggcacctttctttttctgtgggaggatctgcagctgtggggcagacccccagccctcactagactgctcgggtttcctggaggctccgggccaagctagcctgagtgcggaaggtggcaggtgccccagatgcagtgtgctccatgctctcggtggctgtggccttcctgcgtgtgtccccatcggtggagtggcattggcacgctcctcacctgctcgcccacaccattccagccctgatgattaattgtataattagctagaagccacatgttgctcaggttgaatttggtctaaaaatattttcttatgaaaaacacagcagaacctaaaaatatctcctccacagttgcccagggaagcctcctgcttgggccacccccagccatccctagctgcaactcagtttcttggagagtctggaatgcagaggcagagggctggccaggcactgcttcccaccagggcaaggtgagctggggtatcaagactgtccctggcattgccagttcccacaggctcccaatgcctacagtaggtcagaggctgctggggctgcctgggaggctcctgtgtgcatacaggatgcatgccagcctgacttcacgggggctggggcagtgccacagaggaggcacagacctcgtggggtgaggtcctggaaagggcttcctcaccctggtgagccatcagggaaggcctgcaaaggaccagtgctgagctgggtgggaccctgcacaggcagaactccctgctgacctgtgcaggggagtaagggatgctggaagaagacactggccctgccctagagcccctaaactgagcattgctgcggctgaggcccgtgcacctggtcccatccctgcatagggcttggctgactggctacatgtcctgtggctggtggggacagacatgagcagggacatggagcacctgtatcttccaggctttagcacacagaagcaaccaccctgctctggcacacagttctccctgggtgggttagtcacaggggtcaagaacttaccatcttgcccttctcctcttcccttttggtgtccttaaatgggggccaccatctcctgcttcggaggctctgccttggtctcaggagaggaccccgtccacctggcctgtctgtgcaccttctatcccatctctggggtagatgatgaacccttagtgcctccactccctcctggcccagtggagccctggagcacatttccgggcccttctctctggtcccaggtgggtggctcaggcccagagagcttggcccctctggatggacacagaaaggtgggggcacagccaggatgggcactgccttctcctaagcaagcccaggtgcatggatggagcaagtgggggctccctgcagccccatccagccctgagtctcaggcccagggtggtgtggcagggatttggactgagtgtggcttgcagagggcacacctgcctggggacaaaatctgttaaccccaggtttaaacaataaaggcactaacaatctaacctccagagaatgaggaggtgggcggctccaggtgcctgttgcagttaaaccccatgaagcctggctcctgtctctacagtcccctcaccttccttcatgcttcaaagatggctgctgcagccccaagcatcacacgtatcacaaagggaagagatggcaccagcaaaatatcttcttcctcctccctcgtttttcagaaagccaaagccctcttgccaatagcttctccttgtcttgactgaactgtgcccacggtggtcacatggccactactaactgctagagtgtccagtgaagccagtgcctgacaagggagagcccagctgctataactggactggaacaaacagaattgcagcctctgaagctgagcacattgcaaccccaaactaaagcaggtgctgaaggcaagaagaggttgggagaatgttttccacaggagaaaacttcatccttgtgatctggggaggggcaaagtctgcgaggagaggctctgccttccccccaaccaggggcccacatttccatctctgataaataattggtaggtgtcgttccctggagcagatctgtaactcactgaggggaccttccaagctggttctgtgttaaatacacaaatcttaccacagcctttctgacaatcaggcatccaggccctgctagatccctgttgaaaggaaactcatcacatgtcaggcagcccattccttctggaggcttctctgacaggaaccacatccttattttgagctaaaatgggcttcccttggcttctagtcattaaccctagtcctactttcccacattttttttcagcaactttctgtgaatctattatttcaaaacacaaaattaaaaataagttaaggagagacacaaaaagtctaagaagtgcctgaattgtacttctagagatgaacattacaatgtctgagataaatagtacactcgatggcatgagcggcagattagacattacaaagtagcttagtggactagagacattgccataaagactacccaaaatgagccacacaaaaaattaggaatacaaatgaatgtaaagggcatcagcaaactagggagaaatccgcaagtagcctaatatatgttggaattgtagtgaccaaagaagtgtgggaacagaaaaaaaatatttgaagaaatagtggttgaagagtgtccaaactggatgaacactttaaactctagtgcaagcatagccaaccacaagcgcaagaacaagaagcaaggagaaaactaaccaaggtgcaatcatgatcaaattgcttaaaaccagtaacaaagaaaacatcatcaaagcagccgggaaaacaaggacacgtttcatcaagaggaccaaagagcatgaagataagagatttttcaccagaaacaatgcaggcaagaagtcagtggagagacatcattaaagcactgtctgtacaaaactgtcattggaggattgcatacccagcaaaaatgcctttcaaacatgaaggtgaagttgaggcttcttcagacatacagaagctgaaatcatcagcagatcttgtctgcaagaaatgttaaaagaagtccatcaggcaaagtgatactggatgaagatctgcacttacaaacaggaatgaaaatcactacaggtgagaactacacaggtacatttattatttaggtctctttaaaagaaaattgattctttcaaaaaataatatatagtggggtctgtgataggtaaaagtgaagcgtgacaccaatagcattgacaacaatagaataagggtggggagaagtatctcactataaaaatctcagactatgctaaagtcctgtgatgccaagatcgcttgaagggattgtgatcagttaaagactcacactataaagcttaaagcaaacactaaaataacaaacaaagagttatagctaacgagtcaaaaaaaaagagagctaaaatgtaatcacgaatacttgattaatgcaaaaggaagacagaaaaagaggaaaaagaacatgaaaaccagaggtgagcagccaccagaaggcagaagaggcaagcaatggatcctgccccagagcacccagggggactgtggccctgccagcaccccaatttcagccccatgatgctgattgcagacttctggcccccagaactatggcaagataaatttctgttgttttaagacaccaagtgtgtgatttttcttacactagccacagaaatgaatgcattgtatcaccctgggaggggcaggccaccaagtctcatcatcccctccaactctgtgtcataaagtccagacagtgctgctgagaagttagggctcctttcttctgcctcctgaatcatgagtggaggctctactccaggttcggggggctgagaacatggaggcgctgactactctcacccagctcactcacagggtataggttccacaccagtcaagtcaagtgaaaaagatcagaggcttccacccccacccagtgacaagaggagtgttgtagacatttttctcaggggtagaggctactcaggagaacacaaagctccaaactccaaaggtgtctcttgaagactgaggttatttgaaatagtgtgggtaaattcaagtctaagggctatctcaaaaacagtggagattttattagcaggcaaagagcaggctgatcactctgtgggcaacaagccaactgtaggccagtgagtttaccaggaagaaccaagaaaagagccctgctgggaccagaaaagaatccaaatattatctctgtctaaaattaattttatcagactagaaaaatgcatgccccaggacattatcaaaatggtttatggttttgtttctgaggcacttgtaggtcctgaagataattgtacatattctcttctaaaaactttatatttcttttacatgtagatatttcatccttagaattgatttttgtaaatggtatgaagtagggatatagttttagttttttccacatggatttgcagtctcctaaggaccgttgattgaaaaatcagcctgttcctcactgatcacgcacacgtgaagtatacagattgtggggtttgtttctgggctctgaattctattccttggcttacatgtgtagttagttatttttgtctgcaagcatttcattttaccttggagtattatttgtgggttcctccagggacgatttgtcttccatctttccagtacctgggacaccaccactctgtctcgttgaaaattgaactgccagcttgaggttttcagaccacctaaatcttatgaattcaggctgaaaaatctacatgaagaccactggcttctgttgataaattctcagcagggattttcacctctttcctctcggcactgaggttcaaaatggctggttttctttgttatacccttgagaaaggcagatttatttccagttgaccctcactttgagcagacagctgattggggtctcagctctgtggggatttcccacagaaatctgggcctgccatgggctttgacttctgccctctgcccaccaggaagtcacgaaactggaagttcaacttcccgttgctggcaaattccctcaggaatttggcttgccttttgggtgtctgtattctacaaatgttttgacttgagaagttcttgcttttggctaaatctttaatacgtttttaaaagactatttataaaattttgtccaggttttcagtgcaagagctgatccaggtacctagctcaccatgttatccaagtgtccagtacaacccaatttttaagtttttaaattgtataattttaaaattatgaagtgtgttttgtctttaggattttgaaagatctgagagttctgtcttatcctgagaggtaactaatgtcccttccttccaactcttgcccctgttacctgagtccacctgtagcaggtactttaacatacataacgtgtgacctgctggtgctggagtggggttcacttcacttccacagtggcctctgcaggggcagggagtcctggagccctccgtgtcccagaccccagttctgactttatttgagtcaagagcctctttaagaatctgatgaggccggctgcagtggctcacacctataactccagcactttgggaggctgaggtgggaggatcacttgagcctaggagtttgagaccagcctgggcaacatagggagaccctgtctctacaaaaacttttttttaaaattagccaggtatggtggcatgggcctatgatcccagctattcaggatgctgaggtaggaggatcacttgagcccaggaggttgaggctgcagtgagccatgactgcaccactgcattccagcctaggctacagagtgagattctgtctccaaaacaaaacaaaaaaaattctgatgaaagctagacaagggcgtacagaacacacacagcagacacagtttctgttggatacaccttcagggggcctgtggatcccttgcagtgggatcccctaattctaagaccccccaccccacgcctctctatagcacttccctgtgtttgctgctggcaggacaggaggcagcaggggctagcacaggccagcctgctcagctgtgggtgttctgcagcgaacctgctgtgcctgtgtcacataccaagggcatgactaagggctactgatgcagagtcagaagtggcccagccctggcccctacctcctcccaggctcctctgagcctcagcagagactgtggccaagtagtgaagtctctggcggacatctggacctgcaagccatccagagcattgtccttggcagtggcgagatggtcaggtcagcacctgggtccttcccagcttaggcacactttttgccaggataggagcttctcaggccagggcctctcttgccagtgcaggcagtcatgcctggcatcaagtccagcaggcgcggaggggactgcaggccacagctgttcaagtgggggcctcctttctgccctgcgaggccctctcagccttgatgagatcacttgggggccttctatctctgggactccagaaatagagacagggaactgggagtgaaagcagccacatgtgcttgggcaccatgagtgctcacaggtgccagaggagcagacgggaccaggtcagggactgcagcccaggaccagccagtggggcttctgcagtgcctcatcctgttcctgccatgcctcactgccaggaaaacagccacccttgaccacctgcccaccggcctctcccaaagaagacactccgagaagcaactgctagaattttctcaggactaatagcagttgctaactgtctccaaagcacactcagctgtccttggggctcagccagccccacacataggagggacaaggcccacagcgcacaggctcagctccacagcacagggcttctgtcctgaggccccgtaagcctccttccagcatgcctttctgttcatggagtattcactttgtgattgtgtaatcaaaaatcgtcttgacaatacagcattctcccatactagacttactcagagatggtctgtgctctgaggatgatgctagcatggctgctgcctgggcacctcagagcagtcctgacacagcccccatggagccccacctcgaggagaatgggatagcctggggatcctgggcccggagtgggccccacgtgagtccagcttgctccagctgactctctgtgggcctccattttcttgtctggaatggaaggaaatgatccctccagctcataataatgatcatgtttatgtcagatcatcgttcctaggatttccccaaacctccacgtgcctgggagaggagtgagttctccagctccctgggaccctcaggggttacacacaccaccatcggccctcccataaaggctgcaccttggctcggcctccactgtgggcctggctgcaggctctcaccccagctggtaggagctggggtgaaggaggccagttcaggcgagtcctctgcaccatcctctgctggcccgatttcccgatcagcactggatcagcctgagtgcctgaatccagagctcactctccacttgggtgggagcatggctgcttcctgtcagccccagcggtgtgactgggaccagagagtctcctgcagcctgaagaattgtcccagcctgcccacccccggcctcctgtgctccaggcaggcgtggctctccgtgtggcagatctcactctttgtcagggcctctgtgtccttcctcctgggacaggcttggcctcagagggtgggagggaagggagggccactgcagccgcagctgctgcatcaggaggggccaggagtccccaaggtcgagtccagagcgcagcagggagtcccagtgctgacgctctgcacatgtggcgtccttgtcttgccccagctgcaggctccatgtccaaaagcacatggagggagagcagaggtttcctggggacagcagctgaggccaggggctggtgtgctggctcacaggctctgaggctggggatcactgacattgtgctgctgcggcctcctgcccagggagcctgctggcaaggggcccactgcgacccgggctgcatccctggccagccctctctcactggaggcctggactcacccctgccaggaggggagctctgtgctccctctctgctctgtgctccctctctgctctgtgctcccttcctgcctgtctggcagcacagtgaccacctccccaaaacccatcccggcacggaagtggggcctcagagcaagcagaggaagaaccaggggcccttggtgatacagcctggagggggccttggctggcacttgccattggtgtcgggcagacaccggcccctccacccaccagaagatctcaggcacacctgcccaccctgaaagcaagcaggcagggagtggcccccagagctgaccagagggagagaagacaggaactgtagagacaagaggagtccaccgcccagcctggggcagcaccttggaagctggggttgggctatccaactagaagggacagaagccagctgtgcggttggttggtggtgggctggaaaggggcagagggactcaggacgtgccttctgatgggatcatagggtctccataatgcattggccacaggtggatgaggaagaagttgcctcagggttgtcgtggaactcccaggagggctacgccacccccatgggtgtctccaagccccacgccacctggtttgcagaccatgggcccctagtcatgtcgcctatctgggcctttttttaaaaaaaaaaatttattttgagagaattgtagaatgagcatacaattcatgcatgcacttataagaaacgatacagagaggtctgaagtaccctttacccaatttccttcagtgataacatcttgcaaaactacagtacggtatcacagccaggatactgacatccgtagagtcaagttacagagtattcccttaccaccaggggccatccgcagccacacccacttccctccctccctccccagcccctccataacccctggcagccactcaccacttctccatttctacagttttgtcatttcaagattgttatataaatggaatcgttacattatgtaacctcccggcattggctttttttttcactcggcccagatccctgtagatccatccaagttgtcccatgtaccagcagttgattgctttctaatgttgagtaggattccatggagtggatgcactatggcttgaccattcacccattgaaggctctttgcagagctctcggttttgggctactgtgaacaaagctactatgagcttttgtgtacaggtttttgtatgactacaagtcttcatttctctgagataaatgcctgggagtgcaattgctgggtcacatgtcagttgcatgtttagttttataagaaactaagaaactgttttctggagtggctttaacattttacattcccaccagcatcatgtataggtgatgcagtttctccacatccttaccagcatgtggggttctcactgttttttattttagctatgttgatgtgtatataatggtatctccatgcaattttaacttgtatttccctaatgagtaatgatgacaaacgtgttttcatgggtttatttgccatctgggtatgctcttatatggaataactcttcatatcttttgccagtttcctaattcgcttgtttgtttactactgcattttgagagttgtttattctagatgttaaaagccttcatcggatacatagtttgcaaatattttctcccagtctgtagcttgtcttttcattcccttaacaggctctttcacagaacaaaagcttctaattttaagaaagtccaattgttttttacgtcaattctaacaacgtggctagttctagatcccgaaaattttctgctattaagaaaaaaaagctttatagctttacatttacacctaatccattttgagttagtttttgtataaagtgtgaattcattatttttgctgtgatgtccagttgttcccgcatcatttattggaaaagctgtccctcctctgatgaatggcttcatacttttgcggaatattaggtgggcatatttgtgtgagtctatttctggggtccgttgatctatgtgtgtctgtccatctgccaataccctactgtcttgattagtaagctttaatttcaaatagtgattccttccacttattcttccttctcaagatgggttttgctgttctaggtcctgtgtgtttccacataaattttatggaaaaataagcttgtctatatccacaaaaatacttgctaaaattttgacagtaactacattaaacctgtagaattttggaaaaattgacatccttatatgttgagtactgtacatgtttttttaagtttataatgaagtatttcattgtttttgaaatgactgtaaatgatattatatttttaatttgttttcacaccttcttttttaatgtatagaaatggattgatttttgtgtgttgatcttacatactgcaacttgctacactcacttattagttcttttgcagattccttgggattttctacagagactgtcatgtcatctgcaaatacagacagttaatttctttcattccaatctgcatgtcttttatttctttttcttgacatattgtagttggtagagcttgcagtagtctactgcataagagaggtgagaatggacacttttccttgtaccaaatcgtagaaggaaaatattcagtcttttaccattaagtatgttagctataggtttttacagatgctctttatgaagttaagaaaattctcctttgctccaagtttgctgagagtttttatcatgactaggtgttggattttgtcaaatgcttttcctgcgtcaactgatagaatcacatgacttttcctctgtagcctgttggtaggtgtattacattggttggtcttgtaattctgaaccaaccctgcatacctgggataaatcccaactgctcatggtgtataattccttttaaatgttgctgaatttgatttgctgatattttgtcaacaatccttgtgctgaagttcatgagaaatgttggtctgtacttttattatcacatgttgtctttgtctggttttggtatcgggcctagcctaataaaagtgttctttcctcttctattttttaagacggattttgtaaaataggtgttaattcttcataaatgtgtggtagaattctccaacgaagccatctgggcctgaagatttcttttaaatttcacattcagtgtgtttaattgttataagactattcaagttgcatgtttcatattggttgagttttggccatttgtggtttttgaggaattggttcatttcttccacactgttgaatttatgagggtaaaactgtagcgttcctttgttgtctttaaaatggctgaaagatctgtaatatctctgttttattcctgatattggtgatttgagtcttctcttgttttatctttgtgaatcttgccagaggtttattttttgaagaactagatttttgtttccttgtttttctctattgttttcctgttgtcagtttcatcgactgctgctctttattatttcctttgctctgccttgctctgggtttattttgcttttctttctcgtgtttcttgggttagtaatttcgatgactgatctgagacttttcctcttttctaatgtaagctttcagtgctgtacatttctgtttcaggctttttcagggttttttcatttgaaagtggaaggtttgcatcggcacgcggaatagagaagacaggcgtgcttgagaatgggctctgccgcctctcagcctgctccctgggttggttatttcaactcccaggggttcctaatccagaacccggctgccgtgcacaaggctatgggtttctgggaagactaaggcccctgctcagagccgaccctcagcaaacagcctttcctctcgctcctttctttcctgctccagcagtttgattctgtgattaactttaaaataacatttattttacacgattacaaaataaatatattttcatggaagaaaatttggaaaacacaaaaagctatcgagaaaataatctatctgcaaaccttgccactccaccccgcctggacctctgctcactttggcaagcaccctcctgacttctttgacgtgaatttgtttttccataagttattggggtacgggtggtattttgttacatgagtaagttctttagtggtgattagtgaaattttggtgcacccatcaccagagcagtatacattgcaccgtatttgcaatcttttatccctcgtcccctcccactcttcctctcaagtccccaaagtccattgtatccttcttatgcctttgcattctcatagcttagctctcacatatcagtgagaacatacgatgtttggttttccattcctgagttacttcacttagaataatagtctccaatctcattcaggtcactgcaaatgctgttaattcattcctttgtatggctgagtagtattccatcatatatatataatcatatatatggaatactactcagtagtgtgcatatatatatatatatatagtattccatatagtagtattctatatatatatgtatatatatatatatatatatatatatatatatacacatatatatatatggaatactactcaatcatacaaaggaatgaattaacagcatttgcagtgacctggatgagattggagactattattctaagtgaagtaactcaggaatggaaaaccaaacatcgtatgttctcactgatgtgtgggagctaagctatgagaatgcaaaggcataagaatgatacaaatatatatatatttcatatatatttatttatatgtatctatatatgaaatatatttatatatagatatataaatatctatatacaaataaatatttatgtatatataaataaatatatttatatatgtatatataaataaatatatttatatatttatttatatatctctatataaatatatatgaaatatgtataaatatttatatatacatgaaatatatataaatatttatatataaatatacagttatatattatatatctatatataaaatatatagatatatgtaatatatattttatatatagatatataatatatgtatcagagtttccttatgcactcattgattgatgggcatttgggttggttccacgattttgatattgtgaactgtgctgctataaacgtgtgtgaaagtatcttttttgaataatgacttattttcctctggtagatacccaatagtgggattgctggatcaaatggtagctctacttttagttctttaagaaatttccacagtgttttccatagtggctgtactaatttacattcccaccagcagtgtaggagcattccctcatcaccacatccacgccaacatctactgttttttgattttttggttatggccattcttgcaggagtaaggtggtgtcacattgtggttttggtttgcatttccctgatcactagtgatgttgagcattttttcgtatgtttgttggccatttgtgtatcttcttttgagaactgtctattcatgtccttagcccactttttgatggcattgtttgtttatttcttactgatttgtttgagttcgctgtagattctggatattagtcctctgtcagatgtatagattgtgaaggttttctcctactctgtgcattgtctgtttctctgctgactgttccttttgccatgcaaaagctctttaggttaattaagtcccagctatttatctttgtttttattgcatttgcttttgggttctttgtcatgaaatccttgcctaagccagtgtccagaagggtttttccaatattatcttctagaattttcatagtttcaggtcttaggtttaagtcctaaatttttgtttttatgaagtgcatgtgtatttgaagtgttcaaacacttaacagtatctcacttcacttagcagtatctcaatcatatctttgggttatcaaatatttttctaaaatatgattttaacatatgtggatatgtcataattccacagctgatatatatttaagctttaatttttgtcattatgagttgaattgtgtgaacaaattcatacatctttgggcatgtctctgatttttttccttaagacagattcttaggaggggaatttttgtgtcaaagactatgatcatttttaagattactgtctagaaaatgtgtccccaaatctactccacctggaagtatggccaaccttcctctatgtggagtattcaattattttttaaatattgtatttgcctttattgtgaatgaaatattatattttattgttttaacttgcattccatgctagtaaagcaagtgtaactctcaatgtccaatcacagatgtaaagaacaatcttgtttctctctttctggacaattccaagcccctatcccttccttggaccttttctgtggtcttttttctgggatcttttatggagactttctaggctcagtgaccactggccctggctactgctgagaccctgtggctctggtctgcagaccagaaactataaaaatgggcccttcaggtttgcagtctttgatgttcccattccctccttggccataaggccctcccacccctaactgcagcacccaccgcctggagtcacaggtgcagccccagcccctggcagccctcccgggctctgcaaggccccagccccatctgaatctcagatgttctccctggccaccccaggacaccagtatcctccattcagggcactgggcttttaagggagggcctgcctctgggctcttctcacttccagagagggcaaaacgaaaacaacatacattcagcaactcagaaatcaccttgctgcacagccagtctcctgggttcacaggtttttcctcctgtgtgtctccctgttctcctgctctttcgtgattgataagagctctttgtacaggaaggacagtggtcctccagttgtagtgtgtgtggcagcggttccccgagggaggcgttatttgctcttgaactttgcctgcgagctgtgcctgtgcattgctttgctttttaattttaaagcgagttgaagcctcctgtgtttgtttgctttcactgtgctttcctgattggaaagtcttttccacccccccattcagcatcttatggtttctttgctaacactggaactcaattgctctggaaggcacttgggggttaggggtgggggatcccattttctcactaggtagggtgtgcccccggcacccctaggaaagtccctccagccctctgcatttgctggattgcacaggaggcccagggtctcctgagggggaggagatgaggaggatgcggagaggtaccaaggggtcccccaccttgcaccctgcgaagtccccctttctccctgtggaagggaagataagcctcacctaggcgctgaccatgggtgaccccttactctgcaggtgggtgagacccttggagaggcctcctgctagtgctcagcagggttcccagacaaaaggaattgtcaccctttgggtggtggctccatggcactgcaggaccctggagagcccctcggctccggcccaggggcagagagctccatccagcctctgtttcccacctgggccttcacctcaactgtgctcgaggcaggcagggtgggggttgggtgggaaggaggcagagagagactctggagctgggtgcctgtgaagagggaggccatccttctgaagatgtcatcggggtctgaaggcacattggaaggtgcactcagtcaccgaaattagacgagggacaattgcgcagacaaggagccttcacccctgttagtcggggacacagctcggcccacgccccacctccacatctcctccccatcctgctgtggcagagcctgccctccagccctctgcagccccgaccccagtccggccctcagctcccagccccgcagctgcagaggcttcctggggaggggcagctcctggtccaccccatagcagaggtcaggcagctatcttgcgtctggcatctgcataggactaagagatccatcaagtccaattaggggaacagctccttcctgctctgcttagctgactaattcaatagcagccacccaggcctgggccggcagaggctctcccaaatccaatgaaggccttgctctgcagcccggctgccagcatcacccaggcattttgctcactcagcacagacccaagtcaggccccagccatacccaccaccaggagctcccagagccgtgctgctggcaccaggcctcccccagcaagctcccttcctcagggcttctgccctagagggaaggaaacttgtggccattgaggggtaggggaagtgccacagcccgtccaggcctgtcatcccaaaggaaggcccacagctgctttccaggtcttgtagaagctcgttccttccccggggtgctcttgctctgaacaatgccccagggcaggtggaggggcagatggaaatcagccacggggcttttgcaggcaagagtgcaggagggactctgcatgcctgggctcaggcctcagcagagcctgttgagggaagggatggaaaagagtagctatatggcctccctcatggggtcccagcccacagctgtgtcccaaacatcctgtgtgtccctcaacacccagcctggatgggttccttaactgagctcaagtcttagacccgtagaggcctggcacctccaggttcactcaaagggattacagagaccaagcccaaacctacccatccaatgctgggatgtgaggccctgccaaggggcttaagtccagctgcgacaggaggctcagagacatgagccaattatgacttattaaggacaaggcgttgtaattttttttaactgcttgatacacgtgatcaaggcttacttcagcctctatctcctgggctcaagtgatcctcccacatcagtctccccagtagctgggaccacaggcgtgcaccaccacgcctggctaatttttttattttttgtagagacagggtctcactatgttgctgaagctagtctcgaactcctggcctcaaacaatccttctgtctcagcctcacaaggtgctgggattatagacatgagacaccaggcctggccaatacccattttatagatcatttgagtgagggtgttttccctgtaactcactcagtcccactgaatttccgaggcacattctggaaagaaggcatggcatcactggtaggggtctgccccagtgcactaggacaccactgggccacggtctctctgctcttagctcactcactccatcactctcgaaatgatgtaatatgtacagacatctcaggataaataggtccatacctttggcaccttctgttaaagcagtaagttgtgttgtttatttatttttgctttgcctgcgagttgttttattgctgttgttgattaggtttttattaaaagtaatacctgcacaccatacatctcgaacagtattaaattatatgaaatgtgcacaatgaaatgtaaaagcctactcccaatatttcctctctcccagataactgctcttgaccgtttcttgtgcatactctcagaaaaacacttatgcaaattcagcatgtgcgcaaacagcgtgatgctgcccatgcttctgaggcatgctgtgtctgtgacgcctttttttaggtgtaatggaatggatgcccacgtgtggatgtgtgtgtgggccatggctgaccagtgccctgctgttggcccctgcagacaacgctccaggaaattttacttgttcaaattttacttggaaaattctgcaagtgtgttcttaggataaatttctggtagtacaacccaaaacaatgagctaaaaacaacctgggccaaaacatctgtgcaaggaaatttttaaacggatcttgtcaaattgttttcaaaaagatttccacatctttcaacagggtatgatgttatcaccactttccaatgaaaaaagaatgtcattctattttgtgtttatttagttatgagtgaagtcaagtactcttttttacatttttgtccatttctccattagggtaccttttcttattggtgcctgagagcacttagtccgtttaggaaatagggcccttagctgtcatatgtgctgcaaatatttccccccaatttatttgtttgtttattttatcataccaaagtcttacagtgtgtaaacaaacgtattgatcattttaaaattcatttggtttgggttgctcagaaaggtctttatttttttaaaaaatcatgtttacttccagtaattttatggcttaatactttagtctggaattgatttggcatcaaataactttatcaaaagtagccttattttttccttgtggggggtctcgagtcacgtcattatttatcgaatggtccctcattgttcccattagtctaaggccaccccattgcctgtgaaatttccattgtgacatctatatttggactctgccttgtaaatttcttatgcaatatcaaaccgtcttaactgtggttgtataacacagtccatttcactatcgctgtgccagccttttaacgtcctcctgtagcagttctgagttgtcttcatgtagattccacacacttgttaagattacttctatatatttttattttatgtattgcttttgtgaatgtaatcttttattccattacctctttatttagtcatggtttatgcatgggaaagccctcgatctttgcatgttatttttgttagtagcaactctgcagaatgctcttattttcagccaagtctttgggtttcattggccagccctgtacctgtgtgtgactccatcttcccttcctctcttctcctgtgtccctgtctccaagacatcagcagctcacgatcagactcctgccatgctccctggctgtgggggctgcagcctttgggctgatgtccgcttgtacgcacctccctcttctctgtctcatcagggttaatggctactgaactgccaaacacctttgcaacgtttgttaaactttacgttttttattcttcaggggttaattttagtcatttacatagctctagaaaatcatcatttttacctaagtatccaaattttctgtccagcagtttgcaaagcaggccctgatgcatcttttccatttctttgcctctgtggttctttctccttactcatttctgcttttctctcactccccactgccactccgcttttcttactccatggtaggagtgcccatctctttgttggaaggcaacagtcactctcctgtctggctctgtcccccaggagggctgctgggggtctgtgcctgtctggtgttgtcagactccagcgcggtgccattcaggcttgggagcccagtggtttctctgctgatgaaggggcccgtggccgtggtgggtgctggctcattcttcatccccaggagcagggatgctagaatggcctcagtttggggaaggagctgggggtactcctggcaggggatgtgctgaggaacatcttaccgtccacttggatcctgggggacaagagttgggtggcagttggagacccctgggcccatgagggtggggatgaccagcatactctggcaggcagtgtgtgggtcctctgaagcagctcccccaaaaacctagtggcatatgcccctgttacagccctgaggataaggtggggaggctggctggggacatggaagttggtgctgactaacgagaggccagtccctggccctgtggcctgaactctaggtgtctgtggggttctgttggcacagacacaccacacgtctatgttcatggagactttgtcactggcaaaggcaggggcttctcagcagggagggggtagagccaggcagggcagcagtgggagggctaaggtccccctgggtccctggggaaggggctggaggcagcagcagggagactgggctgttcagagggacctggaaagatattgggtccagcagagcgactttggagtccacaagtgatgtggagttggggaggccctcaccccaccccaggcctggacccctgagctgtccaaagcagctcctggtaggctgcggctgaaatggagggcctgaggtgagagagaggagcagaggggctcaagcttggggccagtccactggggctccacgaatgacctgggagaggctcagagctcgtgaaggggccagggtgtcaggattgttcacccagaggcacccctgttctcatccaggttacagaagagcctcaggtccagtgggagaggggagaatgccctgcacacagtgccagcccctccttgctgagctctgcatgcctgggtgaggggctgatgctgcacccccgctggggctgcctgccagggctctggaccctcccacaggaggccaggcctgtgcccagtggcaggggagggtgtcctctccagccagggctccagcctccctccaggctgctctagctggccccaggcaatttgaaaagccccctgggatttcctgacagtacaggcccagagctgaactgagcacagccctcagccaccaaatgggccatcagtcacccaaccctgagagcccaccccctccagcctcccctgcaggcagcatcaccctgggagccctgcactccagagccacttcctccctgaggccctgcacctctgacagccaccacaccatgcctgagccgactcagcctggatgaggtgcagtcttctccaggcctcccaggccccacgctgcagccacacaacctaccgctccatcacagttaccctaggagggggttggaaacaccagggctggcatgtgacagactggctagcccctaggtccttttgaggtccagagaagagactacagggtcaggagcaggagagactcacgcctagggtgagggggtgctctgcatcattttcctggtgcagaaacaggttggagcattgctgaggaccctgagcaggatttgagccagggtgcacccgcagggcaggacggaagatgccacatggctcacccacccctggggccacatgcagagttactgtcaagccacgtcagcacccgcagggcccagtgtgagcacagcagcgactccaagtgggtgggagctggcaagccacctgctggccagggatgcctgttcgcctgttagaggtagcgattctcgttcagagtggaccacagcctgatgacccctgctttcaagaaggaccatcccatcttaaacaacagctccatgaatacaaccctccctgggagtgcagtgaggccatttttaccaggctgcctgtaaggatggggtggaggattggatctatggattaacattccctttggggacgcatcgcgggcagatgagaaattcccgacagcttgatggtcagggtctccattacccatatatcaaggagaggaagacggattccccacgccgactgcctgcccagcctccctgccgacagccaccgctgaagggcggttgatggaggttgtgactgtccctgtgaccaccctcctgaggccctaaagcacaggagaactccaggcagaaacagatgcggggtaatgtagcccccctcagccccagctcctctgggaggggctgttttgtaaatcactgccagccccgctcctcctggcaggtaagattgaggcagcagggatgtgccccgagaaacagagctggtggagaggtttgagggggcatgtgggtgactgcctgtccccaccaaggggcaggggctgcctttctatctgggtcggcagacagccaggctgcccccagggaaggcaggggtggcgcctggggtggatgctggcattggaatgcccaggtaaaaccctgactccatccatgttatttatcctctctgagtcttcactctgtcgtccatgagacaggggtgattgtatgtgaggaggaaacccatgtgcctgagaacagcgtggtgaggagcttgcacatgtggcacagagacggtgcgcttgtgattaggtggcctgagggaaggagtactgtggctgtgggtgttgggctctgctcctcagaagaccccagagggcaggtggctgagcagatctccagagctggagtgcccaagtggattctggggtcaggaaaggaagtgatatgattgggggccacagtgggacacttgagccatgtgtccaaagagcctctgcactcacagagccctttatcttgtggggcagaacactcccccaccatgaggactcttctgcacatttcagagggcaggactgcaaaacccaggttccacctccctctcccattttctggtacagcatatggtaggtgctcattcatgctgagtgaatagagagctgggcaaatgctcactggcactgagcttcactgaacttctcacatgctactgtgtattgaatcttgtacatcttgcagagcttcgtggttgaccaagcacttgtcatccttcactctccttgcttgtcccgtatagctgaggaatgctgggcacaggcaggcaggattgctgtcgccgttgtacagagcacaggctgcccaactgcaagggccgtagagagcatccaggtgccatgagcaccagaggggagtacctggcctcatggtcagagaccaggtctagtagaggaagggagacagggatgctctcattctcagagcagaatcctttcttcacttaacctattttgttagcattaaaaaaagagaaataggcttgggccttatttatgctcctggtttttttaaattgttttattaatatctactctttagtacttctttacctgctttttgcttttcaatttaaatacacttaagtctttcttgttgtttaattaatgtatacattgaaaggtgatatgttttcctgtaaatactgctttagctacattccacaggttttgctgtaatttcctatcctacaatgctgaatgatttgaaatttccatcttgatttcagtcatttaggaggatatttgtaaatttccaagcatatttttatatacgtatttcttaattgcttattttcaatttattacacagtcagagagtgtgtactatatgatatcattttttaaaatttcgtgggacttcctttccttttacttcctgattttcctaattttttaatctcattgaaccatccattactttttttttttttttttttttttctgagatggcatttcgctctggtcgcccaggctggagtgcaatgggtgcgatcttggctcactgcaacctctgtctcctgggttcaagcaattctcctgcctcagcctcccgagtagctgggattacaggcgtgtgccaccactcccagctaattttgtatttttagtagagacggggtttcaccatgtggtcaggctggtctcgacttcaagtgatcaacctgcctcagcctcccaaagtgctgggattacaggcgtgagctactacgcccagccctgagctatccatttctgataagaaaatgttttaaagcttacactgaggtggcaaatttgtcagtttctctttgcagcaagattatgttattaagtgcgcacaagttcatggttagtgagtcctactggtaaatgcattgtagtgtccctcttcatcctcatgagtgcttcctgccttcattctgtgtccgttgttagtaatcccatgtcagcttttctaatgttttggtctcgtattttctgggtatgtcttttatccctttgccttttgctataatttggtttaggtgcttctgtaatgtcaatttcattcatgaggaatcaaattctgctctgttacagggaccctagctgatccccaacccttaggaacagagagcctagaagtatctatgctcatgtccatgtaatatacacacgtgcccacacacacctcacacagttcttacactcacacatatacacactcacatatacacttacacgctcacacatgtacacatgacatacattcatactcacacatacacacccacaaacacatatatactcacacatatacacttataccacaacccacaaaaacacatatacacatgacatgcactcacacacatacatatttatgcacacaacatacattcatacacttgcacactcatgtacacatacacacttatacactcatgcatatacacatacaatatacacacatatgaacacatatacgcatgacatacatcacacacatgcacacttatacatacaacatacattcacacatatacactcacaaatacacacttatacacacaacacactcaactacatatacactcacatccatgtattcacacatactcaaagcaattttaatttgtaggaaatctcagtttaaaaatagctgcagttcctacctgggcatcaggtaacctggaagagaggaaggagaggactgtaattagcgaaattcatgattcgaaaagaagccttggcaaggactggattcgagtccttttgtgaccctggctgggcgagactcatctcttgggagcctttgttttcctccctaaatggggatcacctgagggcacctcctgctgtgaagctaccagacaccctgaggggaagggatccctgggctcctgtcaggaggatgtgaactgcctgggtgggggcagcattccccctacttctcccctcctgggtaagaggctgggtctctggggcaagtggagtcctggcttatcagtcagccacaccatgaacacccagttctgcctccaggtgtcaaataggcaatttaattaaacagaaattcagcagccagcaacatgacgtcatagttcctggaaacagaactgtagccacaattctagtagctcattctgtccttcaagagtttaaaattttttaatgccggagctccatttgatcaccttcacgcggccctggtgggtcaggcccacctgctcgctggcagcccctccttgcctctctgtggtcccaccagtaattaagccttttaagagctgggggagcttcaatatcggtaattcaatctccccctgtttactgatctctgccattagccgagttgaaagcaaaatgttttaattaaaaagattggcaataagttggtgtaatgccataatttgcacagggccccttctagaggatgacttcgccctgcctcagttgctatgacaactaatggacaagattgttccagtgtgagaagcagcatgaggaggggacaggagtgggaagaggggcctctgcaggaggacagagctgtgaggtggaaagaccaggcctctccgtgagctccagggaggtcttgcctctttgttgccatccctgtggctggaagagtcgtgtctctaagtgcctgggccaaggttgtcatggccagtgccatctgggctcaatggtccagtacagagcagagggcgagactcagcagccattcaccctggagtgtactggggccccgcctctgaacagggcagctgtgcggcgggccaaggcagaccccgggtaaatgtcaaataaatgcccctcacctcccctcccacacaggggccaggtaaagggacgtccgcatgtcacctgcctttgtgtgctgactgtctgttgggacacccaggggccaaggtgatgtcctggagaggagctggctcgggaggcactcaggctgcagtctccttccaggactcccaggctagacagagcagaagatggcaactgctctgggtgccccacagctgatattcactcacttctctgaccatggggccagatcctcctgaagaggtaagccctttgtgggagcggataaggcgaggccttgtggaaagggaccaggacattccgagtcttgatttcctcatctgtgaaacgggaatgaaagcatccttctctcagagtcactctgaggactgacagaaaccgcatggtgggtccaacatcctctgcggctatgctagtggtgtgggtgtgccttgaggagccatggggggcaggggccctcgccagtcagctgctgtctgcacccagggccacagggcaagggtgggctctgaaagagcaggacaaacagccagaggacttggctccccgctcctggaggagggcaggtctgaccagccaggagcaggttggggtgtggggtgaagcagaaaaccaaactcgagtgaaatagaaaacatggaacagttgtgcgtcctcacactacagcactagtacatcttcacactacagcacttgtgggctgcggggccctgcaactgccagtgctggggcccggtcttctgagccacagcaccacgtgcagcagggacgtgatggctcaccccgctctcccctccaccatgagcgcacccacctttcctcaccctgccagggcaggacacacctttgggggcgccccaggacatccaggttttgaccccacaatgctcaggaaggatgacttgtgagtggaggctgggccattctggggggtatgctgaggcgtgagcccaaaggtgacaagtgacacatgagagcaagtggcaccaggtgccattcactcagctctgcttgggaagcccccctggggtggtagacagtgtcatgctctggtattctgtgctgtgaccagggccacctcattcccatacaggcccccagatcagtatctccaccaaccatactcaccatgggtgcaggaacatcagctcctctcctcctgagagtcactgggcagcgtgggggcaggcgagctggaggaggcgcagcttctggagctgggaggccgggtgctcctgcccgggagcccaagggcccgtctgacctcagagagcctccttatcagccgcggggagggcgatctatcacgtggcccatgctggtgtggaaggacaataaagcagatattgaccgtgattctaatcgggtgagctgggcctctcagccccacagaacacagcatgccgacttatgggttcagacgcgagaggagccaagcctgagcaggaacgagataagaacatgccctgggtgattcaatttaatgcaaccgtcgctcccagcaaccttgatttgctaagtgctggggagcccagagacgaaggagacagggggccagcatgttctggtctgacagcaggcacagggcctcgccctggtggggtcagaaggctaaggggatgtatgtccttgaatccactgggcagggaagggcaggggggtatgtgcagctgcctggaggaaaccccaggccccactgagccatggggagcaaggccctgaccagcacttgctgcagatggcccctgcctggagccttcccacctgctcctctgcagatgcctcccctctccctcaccaggaaagtcagggtatcccgactctgtcccgtgccaattatgtgctgtcatccagcccctgcatggccagtgccaccatgggccggtgaccgcgacaccctccacccacgagccaaccacacactctaagcctgcttgaggcctgtggcacctggtaccctgggggccagaactgttccaagacccaaccctgatctcctccctgtttaaactggcttattcctgctacttgggtctaaaaccctttgagagctgggcatggtggcacatgcctgtaatcccagcactttggaagaccgaagtgggcggatcgcttgagcccaggaattggagactactctggagaacatggcaagatgtcatctctatcaaaaaaaaaaaaaaactaaaaaatgagccaggtatggtggctcatgcctgtaatcccagctattcaggaggctgaggtgggagggtcactcgagctcaggagtttgaggccagcctaggcaacaaagtgagacctcatctccataaaaactaaaaaatttagacaggcatagtggcgtgcactggtagtcctagctatttgggagactggggcaggaagattgcatgagcccaggaggtcaaggctgcagtgagccaaggtcgtgccacttgactccagcctgggcaacagagcaagaccttgtctctaaataaataaataaataaaacccttcgagacccccacaccatcattccctcatcccccacctaacccaaggatgccctattgcccatcttcagaatgcaggcaaccctcacctgcattccttcctcaactgcatgcacccccacctgacccttcctcacctggacacattctcacccagctctctccctggcaccatcccctcagctgtcatcctccacagctctctggagacaacttcccccgtgtctcctagccctgccctgccccttcccgcagcagcagaagtttctggagtgtgcactgggtcccgctgcttgccagcttggtcttgctgccatccaccatggcagccaggccaaacccaccctcctccctcctctaaacacccctggccggcacctgcttaccctacagtctcatctcctctctcacctgtcacatgctccccacatgcagctcttgccgcctcaccaggttccttacattcaccctatctccgggcctctgcacgcactgtgccttctgtttagaagcatttatcctgcattccttttggtcaccttccttcctccatgcagaccttgtccctggggccctccctctggcccagctgcagcaactcctgcctagagttcctctctgtaacgcacttaccctgagtcaattctcgtgcttgtgtacgtgccccttgccccacaccagctgctccattcggtctcatccaccgttacacatgccacacccacagcagggcctctgaggcacccagtgccacagccacaccagctggatggctctctgtgcctcagcctgctcatctgtaagatgggggatcattgtgcccactcccagggctcagtgagggatgcacccaggtctttaggacatgctgggtgtgatggttcttcactcccttcgtggagagctgtgtaacctgcttgggatgatgccatcaggaagggcagatggcacagggtcataaggccacggacacccagctctgcttggagcaaaatctctccagggcactgagacagaggccccccaaatagcccgcctgccatcttccctcacgcatggtccctgtgctctgcctggcccacgccttttttggctggggctcaggctctctgtggagtgggggctgggggagcaacagaagaggccttgttgagggtcccaagggtccccacttacatgccacacggaccccagtgcagacccatctcccaagagccaggtccctgattggatttagctctggcctcccagcacctcacgcccatatcccctggcctgtctctttagaggataatcagaggaagtaattctatttgagaaacaatcactcctgtggtatgatggtgcactcgatgttaatggacccagcatccttgcatactaaggacgcatttcagccaagcacagggtgtttttcgagaaaggtcttgttccccatcaaggctctgccctcactgagctattagcagccaggctgaggacatgagcttgaggggaggtgcagactcagaggtgctctgtgcactgggctcctttgggcactggcagacagggcagaagttctgcctggggaactcgggctctggcaggtgttctgtacacccacctggcataacatcagcctgccctggtgccatttccattatcagtccatcttacaggtgaagacactgagaataagagaaaaaaggaggatgtccgtatccacacagctggtgagggggagctggaaaccctccagaacattgctcccgtgctcccccacttctgctcaccctctgctgactcagtttcccactttctgcctgctcgtggtgctgcacccgctgccaacataactgtaaatgcaaaaatgatgatgccacaccttcccacaaaattcttcaccatgtttccaaggcctacagaagacgctggagctctgggatgccagtgcatgggcacgcgccaccaagacaagccccctctaccttggacccatctcctggccaatcatacctggcaggcggccctggcccagccatactgcaccccctgcagggtcctgttctggcctggggacttcacacttagccttggcaagtgccacccccatgagggaaaggctccccccacccctcgtgtcctatctaggtgacagccactcgcccattcaggaggattctgcctgagcacctcttccccgtcaatgtcactccccgagcctgggcctgccacagaacctgccacgtccacgcaaggtcctgctcctgggtctgctcctcatctgagcggaggggagaggcttctccaacgctggagagagtgcagcctccggcagcctgtggggccacagggcctggcctgcccagctttctccttcattcattcagcacatacccattgaggtcccactgcctgtcaggccctgctgtgggctgccataacaagataggttacaccggcttgagcaaacagtcatttctaacagttctggaggccggcctctggactgggttccagcagggtcagtggtggtgaggcctctcttcctggtttgcggccggctgtcctctcatgacatcttcccatggtggagtgagatcatgccccttgcatccctccttataggtgcactaatcccattcatggagtctccacgcccatgacctaattccctcccacagccctcacacccactgccatcacgctggggtttgggctttcacatatgaatgggggtcacagataatcagcctagagtgggcactgggacacagcagtgacaaaaagacaaaacctatgtccccgagggcccacatacccactgaggacagaacttgccgaggtgatgctgagccatgtggacacctgggggagatcatgccaggcatgggggacgccagtatcgaggccctggctaggggtccctggtggatcagtgaggtgcccaagagagcagcacatggctggagcagtggcacagtgggttctgacttacatctcaggagaatcctgttgtctcgggcagagaacaggaggacaggctgcagtgctggtggacaggaaagtgcagaatgggccactgcagagatgcagcaggtgggcaggaggtgaggggtcagattctgggaccacgggaactgctggtgcgtggggtgaaggaaatgagagaagccagcacccagggagacgccaggacctgtggcctgagaaactgggagtgcagggctatcatcagctggagtggggcgagggcaggcctatggggaaggaaatggggacaagtgccttttgaatacctactggatgtccaggtggacttgtttgtaactggacattgtgagcctgacctgaggttcctgccctgagcccccatccccggcccccttgcagggtcagtgaggcacgagcacaggggtcagtcctagggacccaggcctggccctcaggggtaactggtgcccatgttgccctcaagggctgtcccctggtcttggagaacattccctgagagctgtcccctggccaaggggaagtgagggacacactagtgcctctcatgataccttggctggagcaggggcttggaggggcagcctggggccctcaggttcctgctccccaccccatgcatctcagcccttcactcccagggaagctgctgcatgccttccctagaatctgtcccacagggggtgaactccctgcctgtcaccactgttgaaggatgacttttcttctctccacaagccagggaattaattcatgccatctattttactgagtcggatcaaaggttgtcaaattccttcacccacttaatgatctgtaatatacccttccatttcctgaccaggctattagataaaatagaattcataatggcctcctggcagcatctgtgcacctgtgtacatgtgcagggtcagtcaagagaccctaggatctgctcagccaggatgtatctttttttccaagagattctgcaaatctcaatccatatggggcttttagtgccaaacatactctatggtctgtgtgaggctgaaaatatatgactcacgagtcaccactgcccttgccctgtccgtggtagacattattaatcaattacaggcactcttcaccactgagctcagatgtagctccttccacagccatcacacatgatacatgtcctggccggggcaaggaaacctcctgaccatccagatgagagacattaattgatgctgctcaccacactgttgtttctccttttttttatgtgtacggtggcctctgagcaggggtaatatgaggtgaccaggatccccccgctgagcctcctgcaggctgcttcagtgggcacagcccatgatcctactccacagtcaggaatgagcaccccaaacctgccaagctcccacctcacaggaggtctattgtgtcagcctcctgagctcctaggcatgaaagcaccttgctggacaaaggcagggattgctagcaggcagcagcacacaggcgatcatgggaagacccggggccctgcccgatccaccacacacccacacaccagtcatgctccatcctgtcacaatatcaaagaggaagcatcaaggctgacagccacagctgaaaagagctgtgcacaaccgccaccttggtccctgtgaggggtctggtcactggcctgacggtgacaccttctcggggtacagagtcccagactccctgttgttcctgtcttgggagcagtattggcgctggcctcaggccacctgggcctctccactcccttctcccctagcaggcctcttgctcagagctcctacgaggtctcctctcccagctcctctgagctgggctgcaggctgggtgtgtagagaagagcagaggaggctgggagagctccctgaagtcacgttactgtctgctcagctcagagagaagagcttcagagacagggaggactgagttcaaagggaagccctggggctggaggtgaccctacctggctgccgcagaggactagccacatgcctgccacatgccaaccatcgtcccctgtcactgcagcctctgtcatgtcagccttcagctccctggagcagtgaggcgggctgtcctcgcccctgcctcgacctgagccttttaagcaaatcagcaatgtaattattgatctgtaaaagaaaaggaattaatatggccgcccacatcctttgtacataagagtatttaacaatgaactctgcttaaacttcataaaagcctcttcagcaaatcagcacagaagtatcgatctggaagctggcctgtgaattccagctgactgcctctcccactgaaggaccattacttggtcttaccgaatctcctctctccatttatggctgggcgcttcctcctgggacgcttctgctgcctctccacagggactgagctgcccagttttgctgatcctcccttttcctggagtccagcgtatcgactggagagagtactggggaggtgctcttggttggggctctgcagccaccctgggcctaacaccccaggctcaggcctgccctagagacccttggtcaccctgcttttcatggagcagaagctggggtactcggtgtgcaccctcttgttcaccctcccaaatgggcattcttgcttcaccttgcagggtcacccagatgctgggggctggggccagccttccagccaatggctgagcgctttccttctcagatatgtgagttggggctggcatcacccacaatgtagcaagctggacccactgccactgaggccgtgggctctccctaatgggatcttgtccaggtacccgaggaggccagtgagtcagcaggctctgccagagcacccaccagccctggcatccagcaagatggctttgcccttggagccttcccatccaccctgggcccagcctgccagttactctgagcctgtggctgtgcatctggcctgggaccctgtcctgtctgctgggtagtgtcagggtcccatgggagagtcagtcctatcttgaagcaggactctgagctcactgccagctgctcagggttctcctcggctgcccagctctaggagcagaggcctgaaccctgtgacctctgtggggccacttgcagatggggcagggatgggctggtggatgagatggggtggctctgcagatggggtgggggatgccgacaactgaggcagtgagtgcagtggcaggagttggggtctctgggttgggcctcgtccagggctagcatctagggggtccagaacccccttcctctctggccaccatggctgcctttgtgaaatgagctctggccttggcctctaaggcccctacagccctgactttatgcatagcagcagaacagggtcagagagtccaaaccacagaccccacgtcacaggccagcccctcagaaatgcacagtgcctaacaggaacagagcctccaacacactgggaagtggctgtggtggcgtccgcccccgctgatcatgtcgtctgccctgcaccctcccacgcctctgcactggatgcaagctcactccacatgcctctctctgccgtggctcctgccttgtacctcctcctctctgtctcattcttcttgtctttgcctccttctctgtcagtttctttgtttctattttcttctctgctggcccctgttttccctttctctttgtctctttctgatctttctctgttaatcctgacgttctggttgtctttctggccacccccacgaccactcatgtccagcattccctggatcagggtgggtgaggctcatgcccaggtctcaagaggaggtccgggtgctgggccctgcctggcaacttggagaaggctccccttgagaacactcactcctccagggggatggaggctgtgggggcaagctcttctcagagcaggtgcacagcagtccctcctggccctgcaggtcttgctggttgccctaccatgagccacatcttggggccggcagtggggaggaggagacctctgtgctggccatgatttgagggacaccagaggactccaagggtgccccacctcacagcatcccttccccaccttcctccaacctgctcctggctgccaatggccaggacaggtcaggtcaggtgaggggtgatggggaccaccagagggctgcaggctgccaccccctccatccagctgccgaccagctgggagaggtgctgtcctcacactcacacaaagccttggtgagagaacagagagggatgcttgcatgtggcattgcacccctgggaagaggagcaccccaggaacttggggtccatgcggtccatgcctcggggccctatagcctggagtctaggtccccaagctcctccaggccaccttgagggcctctgccaacacgcactgcctcaggagggcatgcaggccacagacaaggggcagggcctcagctctcactagaaagaagccgaggagggggcctctgaggaactggcgggggtcccacaggcaggacagcccaaggtcatggcctctaactcagagggggcctctggaagcgccacgttcactaggcacgggctggaggcagcccgttcactagggcggtctcccgaagacgtatctgttgcaggggcagcgagaattccaggggaactctagaaaatgagtggcacctgccctccttgtgactggtcaaggaatattggggcctactgagcatgcttggggtaccctcctctgcagatagcccatgcaggtccaggggcctgatcccacctgccacccccaggctgggagactcagagcccatcagtgctggtgtcagaagaggtcgcccctttcctgacccctctgcttcctgccacccggagatcaaaaggtgtctcctcggcggttcctgtcaccagccttaatgcacgctctccccattagcacaggggctgggaggggaggcagccaggggaagatgggagcctcagatctgagcccagaggaaggagacaggggtgggaggtctagggaagattcagcgataggcctgccctcctgcggccctccagacaccagtcttagagccctcctgcatggggagacatggggcatactggggaagggtgaggtcctctctgagccccaccagccctgacttgactgccgctctgtgctgagtgctccccgcacacggctcctggtgacagcacccgtgtgctagtaccgagccacagggtggtcacagatgctgtccgtgtggtctccagcccgtgtcagtggggaagggcccacagtgcttttctgaggccagagcactgtcattgcccctcgaagaaccagctaatggcagtttccagactagaacctggtctcctcgtggcctgtgcagggttggggtgctcagcccagcctcagggggtcacctacaccccacccccaactgcccgtaggcccagggagctggagagcttccctgcctgcttgcaggcactcacggccctgtgacacacacacactcatccccaatgaaggtgcacccctgaccaggtgtggaccccaggccaggcagcaaagagacagctggcctgacttgggtcctcagcctggcccagccccagccgccggcttgagcaagcccttcccgagaggtcaacctcccatccagggcgtgagggttgcagcctgatcccaccctgctgcatctgccctgtggagccctcgtcctttttccctggggtctccctccccgccaggccaggctctaccctcagggccggaggcctcctgggggaggttcatgtctcactttgcagcctccagccagatggcctccataattcattttagtgaaatatggcaacacttttattggcgatgatcctatctggagcctggggacagtgatggccagaccagggctggtatctgctttcacagagctccgagaaaagcctgcatggttatgttcgcggatgtgcactcatttcgcgttgctgggagggggggtggggcagggcagaggctgcctctgggtctcctgattccaggcagtctggggcaggaggcccacaggcccctgcactggcctgacagaaggctcgggcccggggcagaggggtgggctgcaccctgcactgatgctcagaccaagctgagaggtggagaagtcaggggatatgcaaggtgatggggagcagctacccagagctgtggggtggaggccatgggtgccactcagcccttggaggagctgcctcccaccacctgcagcaccagagtggccctgctgagctgcaggctttctccctgcatctccagctcacactgttgtgtgctctgtgccccagggccagccccataggattcagaggccaacctcacttcctctgcactagcagcccagagacccctgcctgatagatgaaccccaaaactgcagtctcagtaggaccttagttgcagtcacaagtccaagaggaagaaggagaccccattcctggtcatgctgtctgccaggctccagcccgtcaccccttaccgtagccagcccagacctggtgcatggtggagcatctacaagcagaaggtgaggcgtccccaccatgggtctgctctgcagccctgcggatgtctcaccagcctgtatggggtgtgctcctggggacaccaccttggggctcctccagggagctgaaagagggcaggcctgggggacacgagatggacagggacctgagaactgcccatggcaccacccaataagcctgcacctatcccttcatccaaacaggtccaggaaaaaggcaattacatccccaagaaatgtggccagtcagggagcgtgagagcttgtgctgctcttgggggccacagagacccacctggctggttctggatgagacaaaggctgcagactgacacacctatgcaactctcctcctgcccaggtgagatcagtcccaagtgtcagcatgtcagccacccccaggagggtcctgggcatgttatctgacctcgctcaggcagaggtgaggctcagcgggtgactggggcaacgagacccagactagcgggaggcaccagaagggatgcaggcctggacagggtgggggctgtgaggccccaagtgtgcccggccaggacacagctgtgctttacttcccagaacggatggccaaggtggtctcagacaaggctgtgcctctgagctacattcccacagagacttcagggtggcagtgcagcctcagcctgcgccagcacccccaggccttcccgaggtgcctatcgacctgctgaacccagctaatgggctcctctgggcattgagttcagaggcgaggttgcctgtaagcaagattcgccagtgtgcttcatcagcaggcagcctcatgcaatatgtaacaccacattaacctgcactctcagggtagacagagcccccgccccggaatccggaatccggaatctgctgctatgtagaagtggcctgggacgggaggcagagcctgcaggccctgtccttttccctgtacttccatctccccactctgtgtacatggggtgggcagcaaagctggcgcttacaccatggcaccctcccctccacctatggcaggccttggaagtcaccggcaacccctgcccctccaaactcagacacgtcctcaggatctctctcaacacagtactgcaggcaaccacaactgggcagcccaagtgggtgagcaagatcaatgcggaattgcaaggggcctcaagtagcaaaaacaaccttcaaaaagaagaacaaagtcagaggagttacactttctgatttcaaatttactacaaagctacagctgttaaaacagtgtaaaactggcatagggatagacatataaatcaatagaataaaattcagagtcgtttaaggccagttaatttttgtcatggatgccaagctcattcaatggggaaagaacagtcttttctacaaatgttactgggacaacttgatttctgcatgcaaaagatgaggttggacccctacctcacactataggcaaaaattaactcaaaatggatcaataccctaaatataagagcaaaagctgcaaaactcttagaagaaagcatagtggtagatcttcatgaccttggatatggcaatggattcttagatatgatatcaaaatctcaagtaagaataacaataacaacaaaaaacagataaattagacttcatcaaatttaaaacttttgtgcaccaaacaacattatcaagaaagtgaaaagacaaccacagaatgggagaaaacacctgcaaatcatatatctaataatagtttaatatccagaatatataaagaacttctaaaactcgaaaacaaaagaacaaaacaaccaaatttaaaaatgggcaggctgggcatgtagctcatgcttgtaatcccagcacattaggaggccaaggcaggcgggtccatttgagctcaggagtttgagaccagcctgggcaacatagtgatactccatctctacaaaaaatacaaaaattagccaggcatggtggcttatgcctgtaatcccagctactctggaggctaaggctggaggatgacttgaggctgggaatcagaggttgcagtgagatcatgccactgccctccagactaggagacagaatgagaccctgtctcaaaaaataaataaaaataaaaataaaataaaataaaaatgggcaaaggatttgaatagatgtttctctgaagaagatgcacaaatgccaataagcacatgaaaagatgctcaacatcactaatctttagagaaatgtaaattaaagccaccatcacttcacctattggcatggctataatcagaaaagctaaaagtaacaactgctggtgaggatgtggagaaactggaactcttgtgcattgatgatggaaatggaaagtggtataactgttgtgtaaaatagtgtggtcattcctcaaaaagctaaatgtatagttaccatggaattgtgacccaataattccattcctaggtatatactcaacagaattgaaaacaagaaatcaaaaaatgcttgtgtcccaaagtttatagcagcatcatccacaaaagccaaaagatggaaaccaggcaaaagtcaaccgacagatgaatggataaatacagcgtgctccaccacacggaatatgattcatccgcacaaaggaacaaagttctgacacacatgacaacagagatgaaccttgaaaacattatgctgagtagaataagccagacacaaaaggacaaatattgtaggattccagatctaaactaggcaaatttatagagacaaagcagattagaggttaccaagggctaggggtgggggatgggaggttattgcttaatgggttcagattatctgtttgggatggtgaaaaagtttgcagtgcacaagagttccagttttggaagtagatatcagtgatggttgcacaacatcgtgaatgtaattaatgtgaattatacacttaaaatggttaaaatggcatttttgtgatgtatatcttttgctacaaaaagaaccattttttaaagaagcaatggtgagcaaagttggtaaatctgtaggtagatccaataaagccttgacaattcaaagaaaagtaataattaatttatggccatacaaacagggtgaggctagtactccaaacagcaaagcctagcatgcccagtaccgggcaaagagcagggggagacacgggctgtgtctacacaaggagcatgcctttctagcacaggtattaaaactttaggacaatttattaaagaaatagaaaatatgatctctgtgttagtttcctgtgattgctataagaagttaccacaagtctggtagtttataacaacaaaaatgtattctcttgcaatcctggaggccaggagacagaaatcaaggtgtggaggaggcagagccatgctccctctgaggctcgggggaggagccttcctggcctcttccagcttcccacagctggcatcattcctgagctgggccatgtctctccaatgcctgctctctgtttacagggccttgtcccctgtgcaggtctgggtcaaaactccctctgcttctcttttataggatacatggtatttagggccctggatgacccaggacatgctcctcctctcaaggtccctcactcgatcacatcttttgcaatacaggtgatattcacaggttccagattagacatgggtgtatctgtgggagtcatgatcagcctaccataacttccaagcaattgggaagaagaaaaagaatacagaaaattgagtatttctaatagaagttaggaaaggagagagaaaatggaagtccagaagccaggacaaaaaaataagtggtggaaataaattttcctagatccagagaaaacagtaaccatgaatgtactgaacagagactgtcagattggacacaaaagcaaagtcttgtgtcagacgttgcttacagaggtcacagtgaagtatagaaaggtagaaggcaagagggtgtggaaagccgtggagtgtaaatacggatgggatgaaagttggtgtggccgggccaatccccaacttagacttaaagacacagagaatccctgggaatggagacagcgactcccagatgatgaagcagcagagagatcctccaagggtgagtgacctagagcactttaccagctttgtaaaggaaaaggcatttgcctggaggctgcagggcccagtccagcctagctccaggacagctccaacccatcctcccatgggtggggtgtccctggtccaggctagggacggtccagggtgggttggcaggacctgctgtgatcgtgaagttgggaactgcctaaaccatcttctcagagcctgtgtgtccagagggaaaacccaagcacgtggaatatggtttacaagccgtggttgctgaggacaaggttggtaatgaaggcgcagggaagcctgggagggcagaaatgcacaaggaggggtggggctggagcccggctggtcctggtatcctgggcttggggggaccctgctcctttccctgggagccctgaggcctcaactggatgacaggaggtggatatgctggtccctgaggcacaggcagtatgaacctctgcatggagctgggtctcagcagaagcccacccaagcctggagtttcccagccagggatgcacctttttcatcccagcagcctctgtccctcagtcctgagccctcaggggccctcagggcatgaaagcaggaatcccaaatccaccttccagaattacacgggctgttcttggtggtcaggtggcctctcggggccagggtcctttttaagactggaacctctccaagctcaccagcactctcagtgcacgcacgcacgcacacacacacacacacacacaccaggattttaaactcagtccaacaaatctcagcatgcaccagaactatttcagcattttaagagcctgtattgattttggaaggagccaggcagcgtgtgaaggccattctgtctgggatcctatgctgagtctggggtctctgtatgagggattatccatgtgtggggagccttcccccttcagagctttccagcttccctctgatcacatgtcctgagcacactatcccaaacctaaccccagctgggctctagcaagagacgaggtcctgtcttgctgggaaagggtcatccttcccacccggaggcccctgctctgccccagtttcctgccacaaagcccagacagtcctgggaacctgggctggtgagtccctccatcaccttcagaaacagccatgaggagctggcagtgggatggcctgggggtaggagcgtggcttctggagctagaccacatgggttcagatcccagcggtgcctctaactggccacaggaccttgggcagtcagctgaccctgcccagtcccagcatcctcatctggtcttagctaacagggacacacctgaggaggtggtcttcatgtcacttccactgggaccagttttcagagcagctgcaggggtcatcagttaaggcagtacagcccacttacagaggaggcgggtggcttggggtgtgaaggacgtgcccaggtgacatgctgctgagtggccccaaccccatccaggcaccaagccagagcctgtccccagggaccccagggcacatcagcagaagctggaggatgtgggtctcctgggcctggaatctcagagcccacattggttaatttcacacgtccgcttgactggcacacagggggcctggatgtttggccagacattatgctgggtgtgtgtcaggggggctctgggtgagatgaacacttgaatccatggactgcaaagcagacagcctcccagtgtgggtagacccatccaacctgtcgcagacctaagctgaacacaaaggccaagtaggagataattcattctgcctggctgccttaagctgggagcttggtcttttccaggcttcagacctgaaccgaagtacaggctcttcatgcatgtcaagcccctggccttcagactgggacaaactccatcagctctcctggggctccagctggccagcagcagatctggggacttctcagactccactatctcatgaagcaattccttgccatccatctcctttaataaacacacacgcatcctatcacttctgtttctcgggaaaaccttaactaatgcagagcccgagagtggggcatggctcagggctgctgcacccaggaagcatctgtgctccctgtgcttccaggcagggaccctcatggaggggtgggatggtcgtacttcctcagccagcacttaggggccgtgaggtccatagccatgagctgagggagtgaccccacagtttatgtcactgtggagaaaggctccctgagctgtggatccagccagtgggttgtaaacctgactaagacactcaagctgctgcggccgggggcatgccacaaacccccagtgagcctcagtttccccctgtagaacaggggtgtgagagcagtctcctcagggtgtaaagagcccagcaaatgccgggcacagctcataccagataagcattagctggtggcagaaaagctggaagacagactgctgacctccacaaaaggatcagatttgtgccagtcctggccatggacaacaggtcccaggcttgacctgtaggtgaagagcccagagcccaggaccacatgccaagtgggaggctcctggcccagaacaccacacctgcctagcagatgtgtctcctggaagtgggaaagcaggactctccagggagccctggggatacagaggatgcagcccgcgaggccctggccttgaagccttagtgtctctgcaggccccacctgtgattggcccctccagggtcacccaggagggtaagatgcccagggcctgcatctgtgctgtgggacacagcctggcttctgaggcccatggaaacctttctcgggagcttctcaggaccccagccaggacatctgtgcctgtccgtgacagctgccctagaactggccacaggcctatggctgccttgcactgtcagcccccaacgcccgtcgtgtcatcagcatgtctcagatgccttcaagggctgcccactccatgatccttgtccacagccccagcatgtcccctagcgtcagaagtgtccccggatcctgcaagccaaccacataggacgtccacctctgagcccctctgttctcctaccctcctgctgatcacagccctgctgcctggcctcatggtccagtgcatctttctccctggagctgccacagtgcaccacctgcctggctatgcattggtgacccctaggagctccagggggaccttcacacaggcccaggacaactggggagtcctgcctgccctcctttgagtccagaagccctgagccaggctctcttcagaggggtggaggtcagcaggcaccaaggcctgcagtccccaattctcctctcccagctgatctctcttgccacaccctgtgctggcccatgcccgtgagtccgcctggccacccagacgggagctgatgtctccaggagacatacgggacttgccatagcccaggccagggcagtccctgggagacacagggcctgggaggctgcttcacctgcggggctcctgggcaggtgcagtgctccctggagtccatcctgggacctgtggcccagcccacctcagactggccacaggccctctcctgagaacccctgcctaggctctgtagccttagagcctcacctagaagctcccccaggcccctccactgggcagtgctcagcgcccacccctctctagtctagattttagggggagcctgggtccaggctgcccagcccagcacatccccaatacatacccaagccagccatgattgcaccatggggccaggggcagtgggggtggtttggggttggtggaggcatcagggcctgggtcccacagccagcctgggcctcccaggccattgagccctcatccttccagtgctctgcgagcaggcgtccctttgtgtgaggacacctgtggtgcaccccttcagtcaggcatccctgcaacccacttgggggtgcagacatgaaggagcccatgggaggcagcatgatggccctctacatccccaggctcctgtgctccttcctttcagatggcattcattgaaggggcaagtggaagaaggacgggtttcccagcagatgctgcaattcagcccctggcttgggatttgtgtcattgatattattgataaacagagaacacaggttgacaaaagacaagagaggccaccagaaatccatgaagacagagcctcttctggagagagcaggctgttggccaccctgagacccctccccaacttgcgcctggcctggattttgcaggggacggggctggggagctggtgctggtgtagccaccggccctgacacccagccgcgtgaccttctctcgtggcctcacagtcctcccttcaagggtcccaggcctgcccctcgaggccctctgccctccaggagcgcccccatgtccttcccagcatgggcagtgccttacagacacaggaaggctaatgtcagtggagggacacagtgacaagaggaagaatgtgcagcgcccttcaggagcgtggtggggccccagcaggggaggaaggctccaagggggatgacagcatggctgtggcaacgacagttccatgatggcagtgggggtggcggtgggggtggctgacctaacacaggggaggtaactgtccaacaggagccaggctcagccaaggagtacagccaggaaacctccccttccctccccctgcacaccaccctggatgaactgaggggccacccaggcactggagcctctgctgctgtcacagagtcaggctttgggcatggagcagctggcagaggggtgggtgctgaagggcaagtggactccatggagagggccctgatacggggaggctctgctggtctccgggagcaggtcaggacctgagcagactctctgggctcctcaggagaccacccagggcacacccagccctgcaagggtctctacgtggtgccgtcagtgccctgcaccccctggtaggctgcccacacctgtacctgctgccccacccagcaaggctgcagagctgcgtggttcatgcccacctccaaggaccccatggggctgaaggagacagcagagctgcccagctgcaaggttgtcagaggacccctgtttttctgtatttctgacagtaggagatggtgccattgctggaagatgggcctttcaggctggcacccagccccgccccagggggccacgccacctcccacaggctcctgcatggtgggcatgtcccaagccagcctcatctggccaggttgtcactctgggtaaagtgaggtggcagccctgacctgccagcagcagacagtagaattctacagagcatccttcaggctccagggaaggacagagccctgagcagcaaagactccaggaggcattgtggctttggaagcttttcttcaaagcttccaagcccatgttcaggccactttgcacctgagtgacagcatttagctttctttgtgttaggagaaacccatggattgactttcttttcctatttcctccgggggtgaagtatcataagccaggaaaaagtgggtcagggactgtctaggtgaccctggagagcctcgccaggagctccaggggtccatcaagggcaatgggagcaggaggggtggtggccacttcttgatggtgaggggggtgatgaggctcccttaggccctgaaaaggtcagaatggggggtagggagccacctcctgcctggagcagttgatgctcagagctgctcccatgtgtcctcatccctccttccaggtaatggagccatgggtttctaggggaatccagggctctggggagactgggattctgactttgatctttgactgactttgatcagttctcgtgtttttcctgtgcattttctgatgagtttatatctgtcaggagcctcaggaccgtgctaagcccccaggatctgagggtaggaaaaaccatgccttggatttcctgcagacatttgaccatggtggaaggctcaatgaaacttccacctaaacttggcagattgaacacttcattgattttcactctctcccagaatcctatcaaatgatcattagtaaatagagaattccaaaccctacaaagaaaaatacaagcaaatgaacaatgaaatcagtcagagcctaggaggctgaagcacactctgtgggcctggagggcagatggtttcgaggaaacagccctcaatgccacagagggaactggaggagcaaagtgactgaacccccagagctggaacgcaggcccccagcccagcctgtgggaggtgcagcctcattcccaggaaagggtgagccagagaggccctgcttctgggcatatcaggtacgtcccaagaagagggaggcaccaggttggggacaggggagtgaacgtttgtctgggaagcaaagacacagcccctcccgttctccaggaggcagcagcccagataccagtggccagtcatgggctcctcagactggaagtgggaggacttttctcgagggaaactgaacaggcccagagaagagacagtgaaggggaacctttaattaagatgctggctcatccatcacatctccctaaagaaagcttccaatccattttttaaaaataagctttttgttttagaagagctttagatttacagaactatcgtgaagatagcacagagagttctgacacacaccaccccagctcccctgttactaacatcttacattagtaaggtgcatttgtcacaactaatgaaccatgttgatgtgttggtattaacgaaatagcatcttttattctgatgtttttagttttgacctagtccccttttccagttccaggacatcacatgacatttgctggtcatgtctcttgggctcctgatggctgtggctgtttctcagatgttccttgttttcggtgaccttgcgagttctaaagagtgctggccaggtgctttgtagaatgcccttttactgggatttggctgatgtctgataagatgaagatagtgtgtcttggggaggaagaccacagccaaagtgtcactctcatcatgtcacaccaagggtatctgctactaacataatttttcactgtttttttacattttagatccagggggtacatgtgcaggtttgttacgtggatatactgcataatgctgaggtttgggcttctactgaacccatcacccaaatagtgaacacagtacacaacagggagtttttcaactcttgtcccccctccccttttggagtccctagtgtctattgtttccatctttatatctgtgtatacccattgcttaactcccacatataagtgagaacatgtggtatttggctttctgttcctgtattaattcacttaagataatgacctgcatcctagctgcatccatgttgctgcaaaggatgtgattttactcctttttatggctgcatagtattccgtggtgcatatgaaccacattttctttatccagtccacagttagtgggcacatagattgattccacgtttgctactgggaatggtgctgtggcttatcactgtggatgctgaccttgaccccctggctggggcggtgcttgtcaggtgtctctgctacaattactcttccacactgcaccctttggaaggaagtcattaagcacaacttccacttcgggagtggggagtttcgctacctgaccttaagggtggggtatcaacataatttgtttggaattctcctgcacagaatatttgtctttcctcccccacattgatttatttattcagtaatttattgatgtcaatatggatatttattgtataacttgggttataatctgatactactttattttgttgctcaaactgttccagttttggctgttgggagctctttcagttgactcctgtgtctcttttgcatagtcctatcattgtgggttgattttttgtttgtttatttgttttatcatgttcttgctttctggtgctacaaagtgctctaggctcaacttcaatatttcttgccacattcctagaaacaaccattctccaaggatctctggtttctttcactagacaatggtattaaaaaccaagatatgggtgctggggatgctcatttctactgggggcattgttgcttctaggccctctcagtggacagagcaaggaaatctgtatggatgctcacccatgtgtgtatccatgtgatggttaattttgtatgtcagcttggctaggctatggtgccaagttttttggccaaacattagtctagctgttactgtgatagtattgtttataggaactaccctttacaacaccggtaggtctcatctcatccaatcatttgaaggccctaagagtaaagactgaagcttcctgaagaagcaattgtgcctccagactgcagcatagaaaccctgagtttccagcctgcaaatttcagactcaagactgaaacatccattcttgccttaacttccagcctgcaggcttgctctatgtatttcagatttaccaggtcccacaatcacatgataggagtcagatccttaaaaatttctgtgtgtctacatgcacacacacacacaattagttttgtttctctggagaactctagtataacacatatctatgtctctatctatatctacatatctatattaagctaaacgttagtccacatgatgtctccccctctaatctactatcgcatggatcattctccccttccagcacccttgcttcttctgtaacctcccactcaaacagcgagatgctggttcccaccatccaccagacacttatcaaattgtctgatccacatgtatagtggtttcagaattgttaacccatacttctgtggggaaaaactttgccaaaaataatacagtgcttacgtgcctttctgtttgtctttagtcttagaaaaatccgctaattcccaaaattacttaggtcagcaccgtttctcccaccctcttcaaatgagattatttcatacatttgtaatgcagttacattattttgtcacattctgcattccatcctgggatctccaacatcctacatgttaaaaatatacatgcatttgtgtcaagttctgtgtattttgacacacgtttaatatcttgtattcaccttcacaaaatcatacagaatagtttcaccaccttaagctatttcctgtgcttcacttgttcaatgccctactcccaatcccctggcacccgccaatctgtttaccatctctacagttttgcctttttcagaagatatcattggaatcacatggtatgcaattttttcaaactaacaatatacatttattaaagatttattcatttcttttcatggcttgatggttctttttttattgctgattaacattttattgcatggatataacatagttggtttatccattcccttgtgaaaggcattttggttgctttcagtttttgacaattgtgaataaaaccactataaacattcacgtagattttttgtggacgtaagttttcaatcagttggtaaatacctaggagtgtggttgctggattatatggtaatcctgtgtttaactttataataagctgccagactatcttccaaagtgactggcccactttgcattctcaacatcaatgaacgcgagctcctgttgctctctattctcaccagcattaggattgttcatttttagattttaggtattctaattggtgtgtattagtatctctttgttgttttaatttgcaatttcctaatgacaaatgatgatgaacatccttttatatgttattttatgatctgtatgtcttctttagtgaggtgtctgttcatatcatttgatgatttttaactgggtttttttcattgttaagttttaagagttgttttgtatattttgtatacaggcaatttatccgatagatgttctgcggaggttttcttctagtctgtggcttgttgttttattctcttaagtgtcttttaggaaagcagaattgtttaattaataaaagtccaacttaccaatttttttcttttttttccaacaacctcttgtccaacagaacctttttttttttgtcttttttttttccattttgtggagaacaggatctcactatgttgcccaggcaggtctcgaactcctgggctcaaactatcctcctgcctctgcctccctaagtgttgagattacaggcatgagccaccatgcctggccagaacctatttttaatggatatatttgccaatatttggatgagtatttttgaatctatattcatgagaatttctggtctgtggttttcttttcctgtaatgtttttatctgtttttttgaattagggtaatcatggcctcatagaatgagttaggaaatagtccctcttccattttatatcttaaatgtttggtagaattcactggttcttgtatttgtggaatgttattaattattgattcaatttctttaataggtataggcctattccaatgatctatttctgtttctgtaagtcttagcagcttgtgtctttcaaagcattggttcatttaataatgttatcaaatttgtggtcatagagttgtttatagtattcctttattatcatttaaatgtctatggaatcactagtgataactcctctttcatttctgatattggtaatttgtgtcttttctctaacctggcttttggcctacgaatttgattgatcttttctataaaagatagttttgtttttttcatcttttcaatttcattgatttatgttctatgttttattatttcatttttccctcttgattcatgcttaaattgtacctctttatctagtttcctaagttattaattttacatatttattattactgttttttttttgagacagagtctcactctgtcacccaggctggagtgcagtggcgcgatctcagctcactgcaacctccgcttcctaggtttaagcaattcttgtgccttagcctcctaaatagctgtgactacaggcatgcatcaccatgcccaggtaatttcttttgtatttttagcagagacagggttttgccatgttggccaggctggtctcaaacttctgacctcaaatgatctgcctgctttggcctcccaaagtgctgagattacatatgtgagccaccgtgcctagctttgaatttctaatatatgcatttaatgccataaatttcccctttaccactcctttcactgtatcccacaaattgtgataaattatagtttattttcctttagttcaaaatatttttaaatttctttttcctattattttattttattttattttattttattttatttttttagacagggtcttgctctgacactccacaggctggagtacagtggtgcgatcatagctcactgcagccttgacctcctgggctcaagcagtcctcctgtctcagcctcccaaagtactgggactacaggtgcatgccaccccacctggcttaaatttctcttgaaaattcttctttgactcggctgggtgcagtggctcatgcctgtaatcccagcactttgggaggccgaggtatgtggatcacgaggtcaggagatcaagatcatcctggtcaacatagtgaaaccccgtctctactaataatacaaaaattagctgggtgtggtggcacctgcctgtaatcccagctactcaggaggctgaggcaggagaatctattgaaccaaggagttggaggatgcagtgaaccgagattgcgccactgcactccagcctggtgacagagcgagactccatctcaaaaaaaaaaaagaaaaaagaaaattcatctttggctcatgtgttatttagaagtgtcttgtttaatttccatattaaatacttgggggatttcccagctatctttccattattgatttctactttatttcaactgtggtctgagaacatactttatacaatatctattcttttaaatttgttgaggtgtgttttatggccccagaatttgatgtatcttgttgaatattccatacaagcttgagaagaacctgtattttgctgttgttgcatagtcttctataaatgtcaattagatcaagctcattgaaattgctattcaggttaactttagcctttattttacacctgcttcatcaatcagctactgatagacaggtgctgaagtctccaactataatggtggatgtgcctatttttaagttctattaatttttgcacatatatttatttaggtgcatataagtttaatattgttatgtcttcttagagaattgagccaattatttttacatagtgctcttatttatccctcataagtttccttgttctgaaatctgctttgtctgaaattaatataactgctccagttttctttcaattagtgttagcatggcatattttctctatttctttgcttttaacccatcagagtcttaatatttaaagggggccgggcacagtggctcacacctgtaatcctagcactttgggaggctgagggaggcagatcacgaggtcaggagatcgagaccatcctggctaacatggtgaaaccctgtctctactaaaaatacaaaaaattagcgaggcgtggtggcaggtgcctgtagtcccagctactcaggaggctgaggcaggagaatggcatgaacctgggaggaggagtttgcagtgagctgagatcacgccactgcactccagcctccagcctgggcaacagagtgagactctgtctcaaaaaaaaaaaaaaaaaaatatatatatatatatatatatatttaaagggtttcttacagaaaacaaaaagctaggtgttcattctacttctttaatccactctgaaaatttctgtcttttaattgtgtgtttagatcagcagtacccaacctttttggcaccaggaactggttttgtggaagataatttttcaatggaccaagggttgagggagatggtttggggatgaaactgttccaccttagatcaccaggctttagttagattctcataaggagtgcacaacctagatcccttgcatttgtagttcacaataagcttcaaactcctataagaatctaatgccaccgctgacctgatagaaggtggagttcaggcagtaatgcttgctcacccgctgctcacctcctgctgtgcagcccagttcctaacaggccttggaccagtccacagcccagttcctatcaggaactgataggcctttgggaggtgattaggtcatgaaggtaggacttggtactgagaagtggagggggctgccataataaatacctaaaatgtggatgcagctttggagccaggtaatgggtagaggctggaagaattttaaggtacatgctagaaaaagcctacgttgctgtgagtggttcataagcggaaattctgaggaggaatctcaggagaagaggagtgctacagagacagactcaatcttctgagaatatctaagtggttatgagctgcatattggtagaaatacggacaataaaggccattctgatgagtttcagacagaaatgaggaacatgttattgttggacaatggaggagaggccattttatcataaagtagcaaagaatctggttgaattgtgctcatgccctcgtgttttgtggaaagtcgaacttgcaagcaatgaaactgggtatttggctgaggaaatcactaagcaaagtagtgaaaaggtaggctggttcctctcaattgcttaaagtaaaatgcaaaacgaagaaataatttaaaagatgaaattgtttgtcaaaaggggaagcagaacttaaagatttggaaaattctcagccaatccatattggaaataacaaaaaagcctgttcaagacaccttatgataaagagattactatggatcaggcatctcaccagaagcctcatgctatacatcaaaataatggggagattcatcagtcatctaaacagaaaacaggacctaaaatctaagacaatggatgaatacccgcaaagacatttcagagatcatcagggctgcccctcccatcacagggcttcaaaggagggaccaccactacccagcagcctcacactgcaggctgtgctctttgctctccatcaccacactctccagtcatcccatgtgtgctttggtgggccccattgcagcatgcactgcaccaagcaaagctgtggggggcagagccggatttcaaaggatgccctagagagcactggggcccaggcagagaaccaccacaggggcagggccactgcagagagctcccaactaggaaaatatccagagagcaatgagggcttgacctcagactggtagagccactaccatgcaattccaggcccaggagagcaacaggtccacaactccaacccataagagctgtggcatgggctgtacacagcaaagccatgggggtggggctgtccaaagccatgagggcagacaaagctgaggaggagagatcaccatcccagtaggtccagaaggctgtcttccaccccagtgggtggcatcaggtcaaggaatatttctcttgagccttaagagtttggacttgttgagacctctcatacctttctttattcttatttctcccttttgggatgggactgcctgtcctgtaactgtcccaccattgtattttggaagcaagtagcatgtttgattttaaatattcaatttggattgctggagaacaatgccttaaaatgaatcataccttgaatctcatccacatcctatttagatgacatttagataaaactttggtcttgagactttcgagttgatgctagaatgagttaagacttccaggtctgttgggatgagattaatgtatttcacacctaagaaggacatgaattttggaaggccagggtggaatgctgtggtttgcatatatattttgtatacagacaatttatcagatagacgtcttgaaaatattttatttcagtctgtttctccctcaaattcatatgttgaaatcctaacccctgaaatgatggtatttgggattggggtcttttggggtgattaggtcatgaaagtggagccctcatacatgggattaatccccctataaaagaggcctgagggagaccccctgtcccttccaccatgtgaggacatcacaagaaggcaccatctatgaaccaggaaagggttcttcacctgacaccaactctgctggcaacttgattttggacttcacagcctccaaaactgggagaaagaagtttatgttgtttataaactacataatctatggtattttgtcagcagccgaaatggactaagaaagcaggtctgctggtgataaagccccctagtttttatttttctgagaaagtctttgtctttcacttgaacaataagttcactggatatagaaatctaggttgttggaattttttttctgtcaacaccttaaatatttcaccctactactaactgggtgggtagagtgggttttaatctccgcaaaatgccccatcccagaggaattatcactatttgtgttgtctggtagttccctaaaaagctgcatgctcaaggcttgcctttatttgacctgactcagagctcactgtgtataaacagctctatacctaaggtgtttattgaaaaaatgagaaatttttctacactgtagctgcctgagataacaataagagctgtggctaacaaaggctaactaaaaacctttaaagtataaaccaaagataaaatcctaagcccccaactgactgaatgaaccccatcttggccaaagggaacacagagaaacctgaaaaactaaattccaggccatgacgggaagggaggttagatttgcctcgttatactcctgcctttttggagtttaggcacaggtgaccagcattaacattaaaactgagatcataagactgaccaaacagactctttgtggcaataagataccaaattgcaacccgactttggtatagtatcacatgacggatagcagactctgaaggaaataaaaatattttatcccaaaatatatttctttgacatattttgaaatggctgccacaagccagcagattgatgtagaggaaatttgcatctgaagagaatctccattaatgcagccaggccttccctttctaggcctttcctagatctaggagagaatgagagtctgacacctttaaaagtttaaaaagaaacatttactatctattctctctgagggctgccacctaagaggcttcatctacataataaaaaccttgttgttcacaacctccttatcttaactcaggcattcctttctgatttcaagcctttagacaacagcttaactctctcaaccaattgtcaactaaagaatccttaaaacccacctaggacttgcaagccctcactttgaaatgtcccggcttttcgggctgaaccaatgggtactttacatgtatttatttatgtctttactgtaacttctgcatccctaaaaggcataaaaccaaaatgaaacctgattgcctcaggcacacttctcagaacctcttgagactgttccctggaccagggtccctcatattagcccagaataaacctctttaaatattttacagaggttagtttatgttcatcaacaaaaggaaaaactgaaaaatgagatatccataatgggcttagaaaagtgatgacatattcctacaaatctaaacaccacatgcaagtgcagggctgtgtacatgctcaggaaaaaacctgataaagatctagtctctcacttatagcttaacttgaggttctgcatttgcaggaagtgaaagttaaggcagatgtataaactgcaggcctgaacattgacagtgtgctccaacatatacacagagttcccagcaaagactgggagactcattggtccaagacattcaaggaaatttctgtccaatcattagctgaccactataccaactaagaagagacttcggtggctgcacataaccaagaatacagactttacagaattaacccaggaaatccaccaaacaaacaagcagaagcaacaataacaacaacaataaacaaacaaaaaagcttggttaggaaggggaatcttattttccatgtcgccacattatattatttaatatattcagttttcaacaagaaaacataggagataggcaaagaaacaggaaagtatggcccatacacaggaaaaaagtcagtcaatagaactgttcctaaggaagagcagatgagatgttggacttactagacaaagactttacatcagctattgtaaatatgtgcaaagaactaatgaaaatcttgtataaataattaaaagaaagtatgacaacgacatctcaccaagtagatatataaataaaaacatagaaactacaataaaaacaaatagaaattctagaattgaaaagtacataattaaaattaaaaatcactggaggggctcaacacaagattttcacttacataaaacagcatcagtgaaccggaaaatagatgaaataaaatgatacatttgtagaataggacaaaaaattaatgaaataaatgaacagaagcctcagaaatctgtggaacaacatcaagtgtgccaacatacagacaatgtgagttaaggaggataggagagagaaggggtcagagagaatatatggagaaataatggctgaaaatgtgccaaattttatgaaaacattaatctatgtatctaagaagcttaatgaactcctagtaggataaactgaaagtgatccacacctagatccttcataatcaaattgtcaaagtgacaaagacaagaagagccttgaaagtagcaagagaggctagacacagtggctcacgcctataatctcagcactttgggaggctgaggcaggaggattacttgagcccagaagttggagaccagcctaggcaacataatgagtctccgtctctacaaaaattagccaggtgtggtggtacatgcctgtgagccctgctatcaggaggctgatatgggggaatcgcttaagcccaggagattgaggctgcagtgagccattatcatgccaccgcactctagcctgggcaacagagcaagaccctgtctcagaaaaaagaagaaagtagcaagagacaagcaactcatcacgtgcaagggattctcaacaggattaatagctgagttctcatcaaatatcatgggagccagaaagcagtggaatgacatattcaaagtgctaaaaaaaatgacttttaactaagaattctatatttggccaaactgtttttcaaaaagagcaagaaattaagacattcctggataaacaaaaattggcagaattcattattagcagattttcacataatggctcaaacaaatactaatgggagtgctttagctgaaatgaaaggacaccggacaataactagattcacataaggaaataaaagtcaccaattaaggtatctacaatgtaaataaaaatgacaatttgttttgtgacacttttcttctcctatctgatttaaaagacaactacacaaagcaataattgtgttgatgagtttaaaatgtataaagatgtaatgtcatgacaatggcaaaaagaagagataaggaatagatttatattgaagcaaagttctttgtatagtattgaaataaaattcatattaatatcaactatactgttttaattaatatgttattgtagccctcagaggcccactaagaaaataaccatatatatatatatatatatatatatatatatatatatatatatataaaacagacataaatccatttttcccaggaattacattaaatgaattaaacactccaaccaaaagtcagagattggcagaatggatttgaagagtgtgattcaactatacttcaacaagacacatacttcagattccaatacacaaataggttgaaatgaaaggacggaaaggatatgccatgcatacggtaaacaaaacagagctggtgtggctacaccaatatacaagataggccttaaggcaaaaattgttactagagacaaagaaatacttgtataatgataaaagagtctacctattagaaagacataaccaaagtggttatgtcttgccatctaacaacagagctactagatatatgaagataaaagtgaaagaaaggaggaagaaatagttcaacataatagcaggagacttaaatactcaactttcaataatggatagaacaactacacagaagaccaacaggggacccaaagacttgaacaacactctaaaccattagacataacaaacgtctatagcacactccaccgtaccacagcagaatacatattcttctcaagtgtacataggacattctctaggatagatcatatattagataaaaaaataaatctcaataaaattttaaagattaaactcatataaagtatcttctctgaccacaatagaactagaaattaataacagaaggaaaactggaaaattcacaaatatgtggaaaataaacaatgcacttctaaaaacaaccaaggggtcaaagaacaaatcaagagaaaaattagcaaatactttgcaatgaatgaaaatgagaaagtatgtgatatggtttggctgtgtctccattcaaatctcaacttcaattgtatctcccaaaattcccacatgttgtgggagggacccagggggaggtaattgaataacgggggctggtctttcctgtgctattcttgtgatagttaataagtctcacgagatctgatggttttatcagggtttacccttttgcttcctctgcattctctttcctgctgccgccgtgtaagaagtgccttttgccctctgccatgactatgagacctctccagccatagagaactgtaactcaaattaaacttcctttttttctcagtcttgggtatgtctttatcagcagcatgaaaacagactaatacagtacaaaaacaaaaaattgtttcatttaaaagataatcagaattgcaaacctttagctagactgaccaagaaaaaagaagattcaaattactaaaatcagaaatgaaagagacataaacatgcatatatctttatattattataaagaattatttatatattatcctaaattattacttatattcctttaggtatatacccagtaataggattgctgggtcaaatggtatttctggttctaggtcgttgaggaatcttccacaatggttgaactaatttacattcccaccaacagtgtaaaagcattcctatttctccacagccttgccagcatctgttgtttcttgactttttaataatcaccattctgactggtgtgagatggtatcccactgtggttttgatttgcatttctgtaatgatcagtgatgtagagctttttttcatatatttgttggctgaataaatgtcttcttttgagaagtgtctgttcatgtccttcacccactttttaatgagagtgttcattttttcttgtaaatttgtttaagttccttgtagattctggatattagacctttgtcagatagatagattgcaaaaattttctcccattctgtagggtgtctgttcattctgatgatagtttcttttgctgttagttcctctttcttttagatcccatttgtcaatttttgcttttgttgcaatttcttttgacattttcatcatgaaatctttgctcatacctatgtcttgaatgggcctagattttcttctagggtttttatagttttgagttttacatttaagtctttaggccatcttgagttaatttttgtataaggtgtaaagaagggctccagtctcaattttctgcatatggccagccagttttcccagaaccatttattaaatagggaatccttttcccattgcttgtttttgtcaggtttatcaaggatcagatggttgtagatgtgcagtcttatttctgaggtctctattctgttccattgggctatgtgtctgtttttgtaccagtaccatgctgtttttggttactgtagccttatagtatagtttcaagttgggtagcataatgcctccatgttcattctttttgcttaggattgtcttggctatacgggctcttttttggtcccatatgaattttaaagtagtttttttctaattctgtgaagaatgtcaatggtagtttaatgggaatagcattgaatctataaattattttgggcactatggccattttaacaatattgattcttcctatccatgagcatggaatgcttttccatttgtgtcctctctgatttccttaaggggtggtttgtagttttccttgaagaggtccttcacttcccttgttagctgtattcctaggtattttattctctttgtagcaattgtgaatgtgagttcattcactatttgactctgcttgtttattgttggtatataggaatgcttgttatttttgcatgtttattttgctgaaggtactttttgttgctgaagctacttagcttaagaagctttgggctgagacaatgggattttctagatatgggatcatgtcaactgcaaacagacccagtttgacttcctctcttcctacttgaatacctttatttctttatcttgcctgattaccctggccagaacttccaatactgtgttgaatggaaatggtgagagagggcatccttgacttgtgccagttttcaagggaatgcttccagcttttgcccattcagtatgatactggctgtgggtttgtcataaatggctcttattattttgaggtatgtcccatcaatacctagttcattgagagtttttaacatgaagcgatgttgaattttatcgaagccctttcccacagataaccatgtggtttttatctttagttctgcttatgtgatgaattatgtttattgatttgcatatattgaactagccttgaatcccggggatgaagctgacttgattgttgttgataagctttttgatgtgctgctggattcagtttgccagtattttattgaggatttttgcttcaatgttcattggagacaatatgttttataaaatagacataaaaatactagcaaaccaaatcaagcaatgtataaaaaggattatatatcataagcaagtggatttatccaggaataaaagattggcataacatccaaatataatcagtgtgaaacaatatttttttttgtaatagacaaaaaaagcatctgataaaatacaacacctttttctgttaaaaaaaaaaaaaaaactcaacaaacttaaaatagaagagaatttccttaaccttctacagggcatccgtgaaaaacccaaagctaacaccataacgtggtaaaagactgaatactttcccactaagataaggaataagacaaagatgtctgctttcaccacttctatttaacactatactggaggttctagccagggaactattaaaaggcatgcagactggaaaggcagaagtaaaactatctctacagatgacataatcttgtatacagaacatcctaaggaatccacaggaaaattattagagctaatacatgcattcaacaaggttgtgggatacaaaatcattagagaaaaattcatagtatttcaatactttgaatgaacaatttgaaaatgaaattaaaggccagccacagtggcttgtgcctgcaatcctagcactttgagaggccagagcaggaggatcgcttgagcccacgagttcaacaccagcctgggtaacatagggagactccgtcttctctacaaaaaaaaaaaaaaaaaaaaaaaaaaagccgggcatggtggtgcatgtctgtggtcccagctattcgggaggctgacatgggagcatcgcttaagcccaggagatcaagactacagtgagctgtgatcacaccactgcattgcagcctgggcaacagagtgaaactctgtcaaaataaaggaaagagaaagggaaagggaaagggaggaaaaggaaggaaggaaggggaggggaggggaggggagggagggagggaggtaggaaggaaggaaggaaggaaggaaggaaggaaggaaggaaggaaggaaggaaaaagaaaagaaaaagaaaaaattccatttacaatagtattaaaattttaacaaataatttgcaagacttgttcactgaaaactacaaagcatttctggaaggaattagagagcatctaaataaagtaaggcatcccgtatttatgacttggaagatttaatgtttctaagatgacaatactctctaaattaatctacagatttgatatcctaaaaaataaaaccagatttttgtttttcatttttataatttgtttgtttttacttttttgctgatctgatgttaaaattcatatgaaaatacaggagattcagaatagctaaaacaatcttgaacaaaaagaacaaacttagagaactcgtatttcttgatttcaaaacttaccacatttggttatatttggtacaataatcaaaacactgtggtactggcatgaggataagtcaatagttcaatagaatagaattgagagcacagaaataagtgcttacatttatagtcaataagttttctacaagggtgccaagatgattcaatgaggaaaaaaaagtaacattttagatctttccctcacatcaaccatatacaaaaattaactcaaaatggatcacgaacttaaatgtaagtgctaaaactacaaaactctttttttttttttctgagatggagtttcattcttgttgcccagctggagtgcaatgacacgatctcggctcaccacaacctccgcctcccaggtacaagtgattctccagcctcagcttcctgagtagctgggattacagacacgtgccactacgccctgctaatcttttttgtatttttagtagagacagggtttctccatgttggtcaggctggtcttgaactcccgacctcaggtgatccacctgccttggctccccaaagtgctgggattataggagtgagccactgcacctggcctataaaactcttttttaaaaaacacgggagtaaatcttcataatcttgaattaggcactggtggctttttggtttttttgttttttgttttttgttattttttgataaagtctttctctgttgcccaggctggagtgcagtggcgcaatcttggctcactgcaacctccacctaccgtcccgagtagctgaaattacaggcccgtgccagcacactcgggtaatttttgtatttttagtagagacggggtttcaccattttggccaggctggtctcaaactcctgacctcaagccatccaccagcctcagcctcccaaagtgctgggattacaggcatgagttactgcacccagcgttgaattaggcaatggtttcttaaatatgacatctaaggcaaaagtgacaaaaggaaaaataattgataattggattttctcatttcctcaaaattaaattttcagggggttcaaaggacaccatcaaaaaagtgaaaagacaaccccacaggatggggacaatatttgcaagtcatatatctgataaagaactctcaaaactcaatagtaaaaagataatccaatttagaaatgggcaaaggactcattttttcaaagaaatttttccaaaatttttccaaagaagatatacacgataagcatgtgaaaagatgctcaccatcatttgtcaccagggaaatgcaaagctaaagcataggagatactgctgcccattcacgaagatggctagaatcaaaagcagccaacaacaaggcttggcaaaggtgtggagggatccgaatcctctcacggtgggaatggatgatggggccactgctttggagaagagcatggcatttcctcagaaggttagcgtaggtgccacgtgatccaccaattccaatcctaggtatcgtttttgtttgtttttttgggatggagtcttactctgtcacccaggctgaagtgctggagtgctggagtgcggtagaatgatctcagctcactgcaactgcaacctccgcctcccaggttcaagcgattctcctgcctcagcctcccaagtagctgggactacaggcatatgccaccacgcccagctactttttgtatttttagtagagacagggtttcaccatgttagtcaggctggtctcgaacccctgacctcagataatctgcttgcctcagccttcctaagttctgggattacaggtgtgagccaccaagccccaccctaggtatctattcatatctaagagagctgaaatatatttctacataaacacttgtccatggatgttcatcagcagcactgcttacaatcacccaaaagtggaaactgcccagtgtccatcagctgagggcatttatctgaggggagttttcgggaggcgggaggtgagaccgcatgggaggaaagctcagggcctggagtgcattcagcagtggctgggaagactgcctcagggcctgtgtgctccctgctgcactcacaccccttgctccatggagaactgagatgaaaccttgaagattccaaatgcagttgatggaaatggcagttgctgtggttattatctagggagtgcctgtgagaatctaacaagaaaacacacttagagagccccaccagcctcgcggaacaggaagcctgcgttctgtgtttccagttccctcattgccctgtcctgtcctgccctccttcccactcactggctacacataatcaccactggtatcacaggaggtcttggatctgtgtgtgtgagagagacagacagacatagacagacagacagagtcagtgggagccagagagagaaagcatgggagctaatttctccctggctcccaatgaggaatgaggacaggaaaagtcatgcagcatccaggctccttggcgcaactgggtcccaattcccatcctcctgccatcagcctcggtctgtccccaccttgccactgcccccgaattaaatgcttccgagcattttctggaactgtttttctcacatcgcccacacattcttattcccttagtcgaggctctgtccaccttcagcccaccggacagtcaattttcccagccgctggtgagtttctggtttgccaagacccagaggctgggggaagccagacagcaggtggcagctcttccggccgaggagaggagagggacagggctggctcctctagatgaagaggtgagagagctgtgctaggatcaggcggacagtgttcctggcagtagcagcagcaagagcacaggccctgaggtggggctgagctgacctaccccaagagtgaatggcaacccctcaggggccttagagagtgagaaggggtggagagaagtggaggagggtcgccaggggccaggtcatgccaggcctcatggggtctggtggcagcttccagctctattttggttgcaggttttaatcccaaaagttgtgttccctggtcacacttgagaaacgtgggcagctgctatgttgaatggaggttgaaaagaaggggcattaggggggtttgctgtggttgaagtggggatgaccacatgggctaggcgttggagggggcaggctggagagacgcgggaagactgggtgcatgaaatgatgtcccctgcccaggactcgctgaggccacggcaagtgcatgaggaagcacagagtccagggacttctggtctccagcctgagcaggaggtagacaggatgtgaatcccagtgtggggatggatggggcccagtggaacccttgccaggtgggccctgaagctcagggccctctcaggaatcattttatgtacatcatggtgcaggcagggtagtgctgtcctggggcaatgtgaatccattatttattgtggcacagcagtattgtcattttcttgtttgtttgcttagttattgtttatccttgaaatagaattaatggcttgctgaagtatcctttgtgcctagaacaatgctggcacagggcaggggctcaactgatatttattgcatggatggataaatggatgaatggatggatgatggattattggtggatagatggtgtattagtcagggttctctagagggacagaactaatatatataaaggggagtttattaagtattaactcacatgatcacaaggtcccacaataggctgtctgcaagctaaggagtaaggagagccagtccaagtcccaaaactgaaaaaaattggagtctgatgttcaagggcaggaagcatccagcatgggagaaagatgtagtctgggagactagacctttctcctcttttcacacttttctggcagcttttcatattctagccatgctggcaactgatcagatggtacccaaccagattaagggtgggtctgcctttcccagcccactgacccaaatgttaatctcctttggcaacaccctcacagacacacccaggatcaatactttggatccttcaatccaatcaagttgacactcagtattaaccatcacagacggattgatggatgaatggatgaatggataaatggatggatgatggatgggtggatgggtggatggatggatggatgaatgaatagacatggaagaaaaggaaaatagatgcacagatggacagatggataaatacaaaaatagatggacagatggatgatggatggatggttggtgttaaggacttaattgtgtccccccaaattcatactgaagcactaatacctaatgtggctgtatttggagatagagcttttaggaaggcaattaaggttaaaggaggtcctaagggtagggccctgattcaatgggactggtgtccttacaagaagaggaagagacactagagagctctctctccatgtgtgcacagaggaaaggccccgtgaggacacaaggagaggagcctcctacaagctggcaagagaggcctcaccagaaaccagccctgctggcaccttgaccttggattgagtgtgagaaactcaatgtatattgtttaagccacccagtctgtaatattttgtgatgatggcctgacatggatgatatggatggatggagggatggacggctcccccagcccctctgagtcttccctctgggtgcaggcaaccctattcagggacaatgtgagtgcatggctgctgctggaaagaccagtcttgggaactggggttatgtttgacttcctggctcttcagcttgatgctctctagtcccaatctgggacagggctcctttcccacaatgttcaagtttgcagagggaccctggaaaccctgaaggcaatgccttggggccctcacacctggacccattcacacatttccaggtattggtgcctcccccgggagcctgcccagagcccttgcggaggacctggggcaagggaacagggcgggaagctggggcaagggaacagggcaggaagctgagagccgttttcctccgagctaatggaacctcttccatcaccaccagcttagcctttaatcatcctcactttcaagtggaaggcagagctccccagacactggacgggtcagggccatcatcttccaactaggggtgcacagcagggctaatggacgggactggggccaacagctggaaatcaaatcatctcccagaaccacagctcagcagaccctgggggaggggcacctccactctctgcgtagctcttgggtgcaggctggcaaggctggggaacagtcctgaactgctccacccaggcgttaccccctgcacacttcttggcctcaaaactttcgttatatggaagcttgatgagtaaaagttggtctggttgacagcaggtaagggctttctccctttctgccaggctgaccctgggaagacaccaaatggcatattggaatggtccgcttccaccctccccaacctgcctacagtgaccatagctgtgggcggccaccatcctgcccagaccacactgacgacgcttctcacagcctcccctctgacccctcctcctccacctgcccctggcacctgctgtggccctgccaccactcccactgcagtcccagcagaatgaagaggcttgttcaatgtgtggtttcaaggagtgaagtgcaaagcttcccctttcctttgcagtctctcttgatgtgttgtggtggttatgtttgctatttaatggcattctagtcaagaaaagttgaaattataaattatagaaaaaaattaaaattttaattttaatggtaaaataaaatttaccattcatctttatatcattcaatgccaattttaaacataaattgctgtgtaagagcatttaactcatgcagaaacaccaaaatttctgtaactcgtacatgcatgtatatgttgtccttttcagaaaagcgcaaacacttcactgaactaactcacctgattgaatttcacttcctggtgcaggcgcattgtaccaaccctctctacttcagcctaccaggagggaggaaggccaccgtctttccttctccttccatgtcatcctcagcgtcggtgcttgtgcagtacaggtaggtgacagagccggcaaggatgcccagggctgctcctctgtgtttcttaggagcccgctgccccaccgtgctcaggcagggcagcacgtgttggccacgctcaccagctggctgagctccacccggaaccctgtgctggggccttgggaggcctgatggggatgggctcacactcatccacacatcccttctgctcagagggcccagggcttcatttagcacaagttcagacatgaaaccgttaagaattccagcgtagccgcagcccagcactgaacccaatgcctgctcctctgactgtctaccttggctggttcctgtgtcactggaaggaggaaggaacccctcccccgtcaccacggttgttctgttttggggcctggcaccatcacccaacaactatttgctgaataaacgcattgttcacccactgagtatttgctgagcacctactggcagggcgccctgagggcgcagagatacagctgaggacagcgcagcttctaaccttgccatccccaaggtgcgcggagccctcagggtgacccagcttgctgacgagcaagcggaggccgagcaggtgagactggctgagtcagacctgctgccggggcagacgcaggacaaggctgcttttttgcccctggacctcaggatccaggtccgggacgccgcgggcaggggctctggaccgcgctactcgacccctcccccaccgcctgggtctgccaggcaggagggagccgctgcagccaacctgctcctcccgcactatcgattttcaattgacctccgcctcccactttacacttcagagcgctcagcggcctccacacctcctgagcaaggaggaaagccagctgggcgcggggcccctgcttcctccccgagggagtcctcggccaggccaccaccaccaatctcgctcctctccctttcctctctgtaaatgacacgaatggcattgtaaggactataacaggcacttggcctttctaactttttatttgaaaataacatcacacctacagaggagttgcaagaacaggacaatggattcccgtgggccctgtacttaggttcgcccattgttaacaagacaaggactttctctttcgggacacagcatcataatcaaaatcaggaaatttaaccatgatgcagtactcttttctaatattcagtccatattcaaatttcatcattgtcccaaccccgtgtgtccttcagagctcttatttttccctaatgcaggatccgactccagatcacacatctcatttccttatactgtctcttcattcagaacagttcagagagtcatagcatatgattctgacaggcgcagtgccctgctgtcatgctccccacacgcgtgcctgttcatgcacatacaacacatgcacgcgtgcatgtgcacacatacatatgcatacatatgtgcacacacatgtccatacacatccagcctacagcgggcactcgaggtcccctgccatcctccagtacctccccagccctgtggccatcaccttctctgcacacagcaccccaccaagctgccacaatgcctgtgttgggctttctctgagtggcctccctctgggtcagggcccagtcccctgggccaaattatgcccatccaggctggccttgtgcccagctggcttgtcctggccaaacctgctccaggggcacctctagagctgaggcccgggcctgagggcagtcccccagacctatcgggaggcatgtgaagctgccagcacagcaggaaagtggctgagctcagtgactctgggactctccgtgtgacctcaggcagtttctctgctctgtaagccacaactctctctatctggaaaatgggaagaacattattatatgaacactaaatgctcagaaagcccttccttcctggaatgggttagtggtacagcactgccctatcccttcttcccttttgagaagcacagaaccctatgggtgctgtccccagggcactcaggcccccactgctccttggtgccatctgaggccaggaatcagctcaggctctggcaaaaggattcttgtttttcgttcaagcgccacctcttcctctgcagacactcctctgcagtcctgcatgtactgcacgcatgcacacatgcatgtgcagtggtcccagaaggcagccccaaatctacaggctccacaaccccagggctcagagcctggcctagcacagagcgactcacaggccacctggggccatggaaggccaggacctggcaccctccttggcagcagaaaggacagagaaggtgccagttggaggcatggcccgacacagcgacactgcctagttcaagtcacaggccctgcaggaagagtgcagggcttggatccactcatagtgctgttccaatgacctgtggggtctgagtgccccagaagtctcaaacaccaatgcttgggtctatacattcagacaagccagactccatgggtctgacccccaggcagcctcccgtgccaccttcccctggatcaggcgcaccatccacaccttgtctggcttcactcaggcctttctcagtgctaacccacgtggctgttggtttgctgcttaggtgtgtgagacagtaacatgcatcttctcccagagctcacagcctgctggctttatctggtagcacatctgctagtgctccactgacctgtctatttttcctacctcattagggcaactttgtttttctgaaggtgattatgactacttactgaacttgaatatactaacagatacttctcaagtatacgtctgaagacgctgctctgagatgcacaggagtgtagatgagacgctgtctgagatcagagtttacttcttgcaaggccatcagaggagaggacgtcatggaggatgtggtcatgggtagtgcctctggctccggacaggcacagtgtgcagaggaccttgcaggagcatgggtatgaagggaataatgagcgagggtaagccaagaaatgttctagggggcagagccagccaggggccaagccaggacagttggatgcagctagacccagcagggcctccgcccgggttggactctggtagcatccactgcagtctccatccagccacgtgctggggtcacaaggcatgaacatgatctcacgatgaaagctgtctgtctgtgactgtgggagtgattgcattcccatcctttcaagctttccccagcaggagtggcaacgctgagcctcactccctggggcctactgtgacagacgccatggccagctcctcagggtggaggtgagggtgagggatgcagaccccacaaagttcaacccagcctactcttcactgcagctctgacttgcagatgtcaatgggctccttggaattcttcaaattcagagtcacagcccatttgagggggcagcctgaagctggttcgctggaacctttttctgtccacgttgagtgcttgctagaagctatgagagcagctccttctcactgttgtgatggcacaaaccacagccttaacccctgtgtccgcctaggctggagttgggctccttgacccctccctctccctcacactccatacaattaagccccattcactttactcccataatccctctaatgagcaggctcttcacccacctcctgccccctcactgtgctgcccagtttaggccctcatgagccctcacattgattccctgcctccagtctcaccctctgcaatttcctcccaacttaagtgcaaaacagaagtggcatcatggcaatcttcagtctgaaatatctaatgggcattcaggtaacagaatacttgagcatgggcatccaactgcctctcccaaatgctagcccaaatgacttcagaaatagaaaaggaaggagaaacctgtatccattttggaaatccatcagggcaccatttacacgccacacgcagagccatttccataagttacagtgcaggcaaaaaacagcctgaaggaaacttgcaaccctccttgctgagcaagtacaggcatgggggaagaaactgcaggggcctgagaaaggcccaggaataacccagctatagaggatggtgcagatgatgagggcatgacatatggaacctcttagcactgagggtcagcatgtctcaaaagcagaccagggcaggggggccagggcaatacttttcctgaggggtgcgcagtagtccaggaaacaggctagacagacaagggatggaccagtccaagtagaaaattaataagaaaaataggttcaaggaagaaattcccctgtacagagaaaaaacaccctgttggaactgaccagaaccatctcctccatcttgggctctgagttgattgtgaggcccttaggcccttagcagaggattctgttgttatttgtgtggacagcaaggagaagcaatgatgtaaagaaatgccatacttgtttgaggcaaatgccagtctttcatagagaccttgcaattcaatgctaggtcaatggaaacagcagatatgagaaagagaaaggctttgcaaagaaaaataaaaacacacacttctcaaaagatagatgaagagtgatgaaaatgatttaccaaaggaaacagaaattgtcttagtccatttgtgctgttataacaacatcatggcctgggtaatttataaagaacagaattttttcacagttctggaggctgggaagtccaagctcaaggcatcagcaggtttggctgtctggtaagggctgttctctgcttctaagatggcttcttgagtgctgtgtcttcacatggcagaaggccgaagagcaaaaagggtgaaatccttccatcaagctctttttttttatttttaagttttataggtacataataggtgtatatacatagtagctatatatatttatgggttcaatgagatattttgatataggcatgcaatatgtaataatcatatcaaggggtaaatagagtatccatcacctcaagcatttatcctttgtgttttaaacaatccaattatactattttggtctgtcaagccctcttataagagcatttaatcccactcatgagggcagagcccttatgactgaatcacctcccaatactatggcattggggatttaattttaatatgaattgtggagaggacacaatcatttaaaccacagcagaaataaatctcagaaaccatccatttgacgttcccaataaaatataaatttaaaaatagctcttaggagtagtgacattgccaaaacggcagagtaggaagctccaagccttcattcccccatagaaacaccaaaaaacagccagaaactgggtatttaaaactttataggcactttggagagcagaaaaaggtccacaatagccatattcacaagagtaggaagttttctggcatttttacacactcttgcctcactcccttcttggcacagcacagccttggtctgcaggaggccacagcccaattctcagtttcctccatcaaactggagggagcagaacggatcttagttgcgatgttctttttttttttttttttttttttgaaacagagtctctctctgtagcccaggctggagtgcagtggtgcaatctcggctcacggcaagctccacctcccaggttcacgccatcctcctgcctcagcctcccgagtagttgggactacaggcgcccgccaccatgcccagctaattttttttttttgtatttttagtagagatggggtttcaccgtgttagccaggatggtctcaatgtcctgacgttgtgatccgcctgctttggccttccaaagtgctgggattacaggcatgagccgccacgcccggcctagttgcaatgttctaacctgtgtaggggctgcctgaagaactgctctcttccatgcctaaatcacatctcaggcagggaaaagtggcaaaactcaggactcaagcagggaaaaaacaatgggcattgcccataaaggtttcatggggactacagacccatagacacctggggtaaaagattacaggtggagacatacaatagaacatctaaggtcccaaggaaaactagggtgagactctttggaaaattaagacattcaaaagccactgtgtatatagacaaaattgggggtgggggtgcagaagcacacacacaggcacaggcaagatgcatgcttaaaaaatacctgagaaactttcacatctggctgatcttaagtctcagagcacacccagcaaagcaggaaatgattgccctggtaaagagtcagtctgaaaagacagaaagaggtgactgctttccaaatgcccaattttcaacaataaaaaattataaggcatacaaagaaacaagaaaacatagctcattcgaaggaacaaaataaaatggcagaaactgtctctgaagaaacatgggcattgcacatactagacaaataattcaaaacaattctataaatatcctcaaagagctaaagaaaacacagataaagaaatgaaaagaatccagaaatttatatagaatcaaaatgataatattaacaaaaagatagaaatgataaagaaccaaacagaaattctagagctgaaaaatgcaataatgaattggaaaattcactagaggggttcaacagcaaacttaaacaggtagggacttgaagacaggtcacttaacactagtctgaggagcaaaaaggaaaaagaacgaagaaaagtaaacagagcctaagagatttataggacaccataaagccaaccaatatatgcataataggagtctcagaatgaggagagagggaaaagggtaaaagagtttacttgaaaaagtaacagccaaaaacttgccaaacttttatatccaaagaaattgatataaaaatacaagaagttcaacaaattccattaggataagcccaaacaagcccacagaaagacacactataatcaagccacattataatcaaacctttgaaagacaatgtcaaagggatagtcttgaaagcatcaagagaaaagtgactcaccaaatacaagagagccacagtaagattagcaatgattttcctagaagaagccctgcagaccagaaagcaatgcagtgatatatttaaagtgctgaaagaaagaaaaagctgtcaactgaacattctatacctagcacaactgtccttttaaaatgaggaagaaattaagatattctcagataaacaaaagctgagggagctcgttaccactagacttaccctacaaaaaatattaaaaggaattatttaagttgaaattaaaggatgctaaatagtaactcaaagccatacaaaaatataaagttatgcaataaagctaaatacatagacaaatataaaaaccagtattattatcattttggtttgtaatgccacattttattattttatagagtttataagacaaaggcatataaaataattatggatctatgttaatgggaacatatataaagatgtaatttgcgacatacctcaataacataaaatgggaagagccagaaggttgtagagcttttatattcaattgaagttcatttgttatcagtttaaagtagattgtaataactttaggagttttatgtaattcacatagtaatagtaaagaaaatatctatggaatacatacaaaaaaaatgagaaggcagccctgatgtatggcacatatatatttataattgttatatctttttgttgaattgacccttctatcattacgtaatgcccatctttgtctcttgtaacagttataagcttaaagtatatcttatctgacattaatataatcacgcttgctccttttagttaatatttgcatgcaattttttcccattattttactgtcaacctgcacacatgtcctgtgcccttaaatctagtgcattgtagacagtatacagttggatcatagtttttcttttaatccattctgccattctaggtcttttaatgggggaagttaatacatttacatttaattaatgtaattaataataaagaaggacttactattgctgtttagtagtttgttttctgtatgtcttatagcttttttgtccttcatttcctcccttcctgccttcctttgtgcatagctgactttttgtattgacatcttttgaataccttcttatttccttctatatgtattctatagatattttatttgtggttactatgcccaacaccactaatcattaggaaaatgcaaatcaaaaaccacagtgagatactatctcatactcattaggttggctactatttaaaaagcaaaaatgaaaataaaaaatgttgtcaagaatttggattgggatgtaaaatggtacagctgctgtagaaaacaatatagcaattccccccaccttctccaagaattaccatatgatccagcaattctgcttctgggtatatactcaaaagaattaaaagcaaggacttcatcaggtttttatacacctatactcatatcagtgttattcccaataatcaaaaggtgaaagcaaccgtagggttcactaatagatgaatggatacacgaagtgtggtatatctgtatgatggaatattattcagccttaaaaaagaagtaaattatgatacatgccacaacaaggataaaacttgaagacattatgctaagtgaaataagcaagacacaaaaagacaaatatcgcacaattccatttacatgaggtgcctagagtagtcaaatccacagagagaaaatagaatggtggtcgccaggggctggcaggggggagaatgaggagttgttgtttaatgagtatagagtatcagtttgggaagatgaaaatattcagagctgaatgatggtgatggttgtacaacaatatgaataatgtacttaatgccattgaactgtacacttacaaatagtcaaaatggttattttatgttatgtgtatttaccacaattttttaaacagcttttgaagtaaaagataaaaatgaattagatgactgactcggatgaggaaaccagctgagctaaggaaaagatgaaacgactgtaatgaaacaaaaagacttttctctgctgaataccaaggggcttagggaaggcacagctcctccttaggtgaggagtagaatgagcaaggagcagagatgtatcactggggatctgcacccaaggaggcaggtcacacagttgaggttcacactttggaaaggatgcaaccactgaggttacatggaaagaaaggagagacaaaaggctgaaattaacctggaacaaaagtagcaaaatgaagctcagaataatgagttattggaggaaatggaaactaaatccataaggagatgccgctactagtcactactagtcatttagccatacaacagctaaaactaaaaacggtgacaatgccaagtgttaacagggatgtggagcagctgggactctcagacagtgccagtggaagtgtaagttggtacaactataacagaaacccagttgacaggatctactaaagctgaatatattcacccctataatccagcaatttcacttctaagtatttacacaagaaaagtgaaaatttatgatcaaacagccttgtacgtgaatattcatagcagctttagtcataatagcaaaaaaactgaaatgaatccagaagtatcacaacaggagaatggagaaacaaactgtgatatgcccacccaacagaatactgcttagcaatagaaagaaccaaggtgctaacccacacaagaaggacgaagctcagaaacatgatgttgggcaaacgaagccagccaattatctgacattctagaagagtcaaaactacagtaacaggaagcagatcagtggttgcctagggatggggcgggaggcttgactgcaaaggagtacaaagcaactttcttgggtgctggaaatattccagatcttgatggcagtggttacacgggtatagacatttgccaaaatgcatcaaactgtccacttaaaaagggtgcattttattatacaaattatataatacagttgttgttttaagtgaaggatttgaactttatatccaggacagatgagagtgggaatgagacatggattggggacagagagaagtataagaaagcaaggaactcacaggaactatagagggctctgggttgggatctgggtccagcttatcagctctctagaggcaaggaggtccagtcaacacatgggatatgtcaggaaggctacatcagagttcaatactaagctgcaagcagtgaagtgcagaatcagtacttaagaaaaacaatgtgggatgtggaacatttgcacaggaaaaggtttcaagacataaaagccatgcaagagaaaaggagagctgtgcaagagcgagaagagaggcccttgtgtgggccactgatgtccccggggttgaggccagaggtggagcagcatgatctggaaggaaagcacaggcgtcaggttgcaacagaggctctcatcttgagacagcaagctgagctttagggaccagggagaccatggctggtggtcgccgcctggaagctgaggacagagttgtttatgatgagcacccttctagaacatccaccagcgtttgcagcccgctctgggacagctggagaaaatggcctggaggctggtccagggtgagcagaggtccctggcacacgtgggctcctaccaggagggctgtctcctatggcacctggcctgagtcactggaatggctcctgagccccccacccctaggccctgtgctcctgcctgatgttgcccatgcctgcgtgagcctggctggtgccaagagccaaagtgctcagatgatccagtgctcatggaggaccactgggcccttggccaggagcagggggccctcaaaggcacctccacccttgaccgcccctcactgacccactcctagctctgcacatatgtgctgatagcctgaagccatgtacctcctggtccccatctctaggcacccacgggagctaaaggtgtggccttgggaagggggcttcatggaggctgcagtgcctggggtctggatgcaaattactttttggggtgggatgagctggggtctgggctgcacgccctgcctggtctgtactcctgctgcactctcacagcaatgggaaggagagtcaggtgggagctgcggctgtccccggcccctctgcaggtcttctgctgtccattctcacagagggtggtgggaacggtaaatagaagatgacggagaatggccaggtgaattctaagcctgtgatatctgtgtgctgttatttttatagctctgatgtaaacctgacttctcatccaacccagacatggggtgtggagaacggcatagagctcagaactggcctgggtgctggagtggggcatgggtgggagtggaccaggctgacctctggctgggcccagagctgcaaggtccccaagcggtttcctggaccagggtgagctggagaccaggggggttcccagaggccagagggaaacctgaggcaagggcctgcggggcccgagcaagtgggctctgggaagagaccaaggctagatagaatccagcactcgccactgggctgtcctctaagggatggggtgggtttgtgaatgtgaaccccaacctcgtgcctggcaggggcccacagcaggcccaggggcccacactgtcctaatacagaagagactgccaccctctccaactccactcaccttttttgttaaatattttttcccccaactaattcccttggttttcctttgtgagttttgtttttgtttttgtttttgttttttatgcttgaagttttaaaactatagaaaagtacagggaacagacaccagcatatccaccaccagcgcctcatttcaaagaaagggaaaccgaggcagcagcccacagctggaggcctaggagtgtccatgggcatggactgtggagccgctgctcaccagggagcaaattgttctgccacctccttactcggagacaccgagcccagcccgagccacagggtgacaggacgtggaggtcacaataacctcccaagctcactgtgcttattgtgtttaaggctttatcgcttcagtccttccatacagcactgccactgggacttgggtggctccctgggcaggcagggctgaagctgctccaatgaaacagctgtggccaggaggctgggagggtggagggaggcggggtcctcatccaagcatccacactctgaggagggcaggggccactcccacccaaggacctgcactccccaaggtgggagagcctttctggccaccgatgcttcccaaaggcccaaacccactccaagggcacctggagaggcttcaggtcctgagccccctcagcattgcacggtacagcctcctggaggaggcagcaagtgaactgcagcctgcctgtgggcacaagaggaccatgtgtgaccccagctatgcccctggccagtcctccatggccccacaatgcccttctgccctggatgcagtgggatgcagagggcgggtcccatggaggctgatgcgcactctctgcagctgtcggcagggctctgaagcccctgctcctctccagcttccaaagaacctgcagcatccctggaggctgtggtatctgtcactcagggccagaaaagctccagggtgaaaaggcaggtccctcagagaggcccacacccagtcgctcactcaggcctaaagagagctcagactcagtcatgggagccacagtccctctaactcctgccacaggacaggcttctcgggcccaagtcacatcacaggaattgagggagctgggaaggagtaggtcagctaggggaggttagcagcttgcccaaggtccctggctgagtgcacctccagggccgggggtattttgcacttggctgcagggagctctccacccaggaggaaagctttctcaccactgctcttgctggcttctccctgagctcctccaggctccctacccaagctggtgtccagcagctggactccagggtcccctgacacgcacctagtgccctatagaatgcatgcttcacccccactctctccgggtggggctgccctgagcatttgctgtgcattctaattttcagagggagcctgagaacgtgaaatggttcctgtccctgttttatcgatgaatgtactgagactgctgagatcgagccacagggtagggtcatggagttgggcctctgagtttccaaagtgcttaggcagcccctgatgctgtctttttaaaaaggcagagcaaagcctgcctcctctctctgcacagacccctaggtcccagaggagctgccgcacagccacatacacacacacccacgcacacatacacacacgcccacgcacacatacacacacatgcacacacacacgcacacacatgtatacacacacacacacctgcaggagcccccccccccccgcccccaccgccagcaggccagccattcccctggctccggggagctaattacatcacaggaaactgcggtgtgagtctcacatcatcatggtccccagtggagcgccgagacagaacacatgtggtggagctctgggccaggcccagctgcctcaggtgtccccccagctggagcgcagccaggcgctccatgcagctcagccagggaagggccttcttgctaggccaagggtggttagagtggttctgagagaggcctcgggcccaagcagcctcctctgcttccttcttgggtgtcctggcctggggcatgttgtccccaaaacaggacaacgttagtcctgtcgccctcagggagggtatgtgagaccctgcctagaaaggcggcacacaacacctggtgcagaggcacaaggacagtgtctgtgacaacagaaacactgtctctgcccacaaggggcacattcagggacacgagacccacgtgcccgaggctccatcctcactcatggcctgggacacacgggtgccactctcttaagtgacactgccagtgagcccatggcccatgggaccagaattctgctggggactccaaaattcctacagagggttggagggctcaggcagggcactccaaagagacatgtgagctgaggctgaggggagagggcgagtcagatcggagggagaaagggcatggggccgagaaaacaacggcaagggcccctggctgcaagctccagccagagaggtgggcagtgcggcccaggaggaaacatggccggagaaggaggggacaggtctcaaagggctgggccttcagaaagaaagcgggctgtatcccactcacagcaggaagctaccaaaaggtgtgcatgacagtgacatgcacacaagtccttttggaaatttcatgctggctagtattggggagggcacaggatggtggtggctccagggggtgatggtaacgatggagatgcgaggggtcccaaggacagaagacctgccatgctgtgggggtggggtgctgacaggacctgccatgctgtggggtattgtggggtggggctgacaggacctgctatgctgtggggggaggggctgacaggacctgccatgctgttggcgggtggagctgataggacctaccatgctgttgggcagtggggcgctgacaggacctgccatgctgtggggtggggttgacaggacctgccatggtgtgggggacactgacaggatttaccatactgttggggcgggggtgctgacaggacctgccattgctgtgggatggggctgacaggacctgccatgctcttgggggcagttgacaggccctgccatgttgtcagtgggggttaacaggatctgccatgctgtggggggttgggctgacaggacctgccatgctgtgagggagcgctgacaggacctgccatgctgggggagctgagaggacctgctctgctcaggagggggaagggggagaagacagagagaggagggtagaggtagtggtggtgggggatgaagtccaggcatgagtgaggaggaggctgggttagtgcaggaagctgtaagtagacatggaagggaagagaggttctggggtagaatcagaatcaaagaacctcagaaagttcagtggagaaggatcctgtggttttctatctcccgaagtaaaatgagaggccagattttacctctaaccgccattcactataacccatccctctataacccctgaagcattccctggagacctcatgggctcatggaacacacattgaaaaccctgcagtgggccagtgggtggcctagagccatgtcatgggttagtgctggagcagggcagttccaggacattagaggccagccctgggccagctccccaccagctgaggctgagtcccaccagcagcatccctcacctgagagctggcctgaagtcctttcttcctttcccctgtccctgtttcagtgaccagctgctcctccctcctcctgggcatgctccactaaggcaggcatgcaaaggccagtagggaggcggcccctggactttcccaggcagacagcagtcccagaagagcgtgctgaaggagggacagactgactgctgcgtcctgggtcacccccacccaactcagcccacctcccaaagctggagcccctctcaatgtctcagccatcagggcccaagagctggggcagcttctcgaagctcaaagctggcaggggcaatgccaggctttgctggcaccagagggaccctgtgggtgtagcactgacttcccccgaagccagccgctgtgtccacgcagcctgaggacccaaggggaccttctggctgtcccagcaggaatccccacatgagtactcttgagccaggtgcccagccagcctggagatcacccaagatcctcaaaggttacagagggagttctgcctcctcacttcctggtcctgcaccctccctggagcaccccaggagactgcccccatactagccttgggaacatgggcaggttggagaccagccaggaatgagctcatcccctctgggggctgcctcctcatggcaggcccttccccgtgagggagagatgggggtcttccagttttctggctctgcgtggctatccaagaccacagtcctggggggcctgggaagcccagggtccttcaaccttgggccaggccatgggaccattccccagggcagagccagagtaagtgcaggcaggaaagtaggggtcacttttagaaatgggacctatctgcaggtgtggctccctgtcctgggaggagaggacagttacatttttttcttccatctatgcaatacttaaaggccaagagggcatttgaagcagacctcccatgttcactccaagtcacacagatggcctacactccctcattcatgtctctgctccctacttaggaggggctgcagccagggtaggggaccctcacccatctcccagtgggctctgggcactcacctttgaggtcaggcacagccacccctccctctgggcttcagggaagtttgggccgggtaggcatagggtgcctcctgctggcactcagggccaaggcacggagtcccttcttgggactgtggccacgctgagggggctgtcatgccatgagtcagccagctgtcagggacctggcccccaattcttccctcctgccctccccacagcctgcttcacactggacaggtgccccgactggctggcctgggtgtcctcaggggccacagcaggtaccagtggccgcagcccctggagggatgtcattaaagccagatcagccacaatccctggctctcacaatcccagccctgccgctgacaaccctgacgataagtgcaccccaaagaggaaatggggcccagaagcaaagctctgtgccatcagttcagctctcagacctctatgggccctgccacgacctgatgggctccattcctgatcaggagctgcactgggcatcagtcgcatgcccatggggtgggcaggggtgctcagcacctccagggagccctgactatgcaaggcctccccacgtcagatgtgcttttgcccctctgcttggagtcctagttctgccccacgtgtgcccagaacaatcagtgtctccaccctcaggccaagagcctgtgaccttgggttggagcctggccctggtgcaggcctgcggatctccttccacctggctctcagcctccagctacagggagtccccagatctgacccagggggccgagaccccaaagaagaggcctctgtgtcccaaccttgctgtgaggcatggtccactgttggaggggctgcagccactggatggcttctcatcgccagccctcccccgagggcgcaatgagactgctccactgtgactcccatggtccccgagtccctgtggaaagagccccagagggaaaggcggggtggaactgggctcccagcccccctacctgccagggacatgaccgaggcccctgggcaccccactttcaccttgggaaggaggcagcatggcctgtgcagttgcccctcctaatccacaaacgtgtggcctttcctgctgaatatgatggtgactgtcagcagttggtctcagcaggatcatcgtgccaattaagatggaaatgccaccctgtgggggctcccccctctgccagggagctgaagtggagggagtatgtttatacccaaatgcaaagatactgcccagcacagacttctgtcccagggggccggagagggatgtcattaaggccagatcagccaccacccctggctctccctgccgggaattccctggacagcaggagtaagtggcccttccttccttctctgcaaaagccccaaggtcacaggcacctctgaaacatgccccacactccccctgcttaccaggcctcatttcaggacctcctacccggactacactccaggcccagtggcgagacagagacacctgcagggctcccggattgggggcggtgaaaacctgcacggtgcacgccccagcagaccatagtcctcatgccagctggccagcagctgcacagaggctggtgggaagcaacttcctgacacagtcacccctccccagaagtgccctgtgaggccagggaggtgaggacaggcaacccctcctcagaagtgccctgtgagggctgagggagaagcacagtctcagctgggcctggccatggagacggatcccagtgaacaatattgattgtttgtgcaaaatggcaccccagcccctcagcctgcttgctgccagggcccctggtggaagctgacacagacacaaaggagaggaaggggcacagtgcagcaaagccggaggcagagcagtgaggcacagctgggggcccctgggccagcacaggcatctgaggcccagccacaagaactgcagtcccatagaggaaggggagggtgtcgcctcactcccaatctgtgcagcccctcagagccctgcacagggccaacagagtccgggagggtccctgtgcctgcaagggctgcggcctaggcctctgcagaacagggggaggggagcggccgcacccctgtctagacggctcctgctgagtactagctcctcacctacccgccctgggtgccacgggccccaaggcagagggcataagctctgtgcaaacatcctgccttctccccaggatatttcctttaataaaacaccatggaaatgtcagctagtctaaacaaatagccaaggttttcagaggacgagcagcctgcataggagagcctccagggcctgcttttcggggtggctttgggaaattgtgtgccagaaaggcagtgggagcccttcctggtggggcgagcactgggggttgtggtgactgagcccaaagaggcagggcctgcgagttcccctgggaggaaggggcaggccctgagccgggtgcagggtggctgtccagggtccctgaggagcctggggccttcagatgagggctccctcctgaggaccctcagaaagggcctgccccagggacacacgcagaggtgggggtgggaggcctacagcacatgcttctcaggacaccctccttcccctcccactgcaggagccacttctgcagccccatcctcctccttgtccataagctccatgttaggggaggcccctgcttggggaggccccaggtcggccgggggaggtgagaagtccaataatggggtgaaacttgcaaccccgtgcctgacaaaatgtggcccaggcccagcggtggcagggttggggtaggggtgagatacgtgttacagcccccggcagcatccagggcctgcatctgtgtgggggtcaagtgttcccgtgatcctactgcctgagcagcgggccgtggcatccctgctcttccttggcagggcagacagacccagctctatccatgtgcagggcaacgtgggcagggcccagactgcctccccagcaaagaaagattttcagggtgtggatctccatgtgggttcagcctctgtgaatggtgtgtccgggaaggggccacacgtgcaagaattgctgaccctgcctgggccagtgcaggagagtgaggctgggcttccaggcactgggctcgggctgtgccaggtaggccaacgctcctcaggaggccagcagatgcctgcagggtggcagtgagggtggtcccagcccttggggcctccatgcagccacctgcatctgtggccacgggtggaaaaggtgagcccacagcaggtgggatggccaaggctgagcaggtccacaaggagcagagatggaagccagcagccagctctgcaccaaggcagggcctctgggcaccgcctgggaagaagggagtgggctctggagtcctgtatgctgtgctagaatcccagctccatttcctcgcctgtgaacagggaagtggtttctagccaatgcggtgtcagaaggagagaacaggatgaggtgcctgggcacggctcagcactgagcactcggtccctccccagtccctctgacgaggcacccaggcaggccctcccctagcagaggacaccatccttgggcctctgggtggcagatggcattttctcaaaatgcccacaagagtatctccaatcccacacattctcagaaccttgctactctccaggagcacacctgtttccccttccttggaccgggtgcagggcagaggtggtgggtagggcccgcagaggccatgcagagtgaaatcagagactggggcagatagggcgactcatttctgcctgattccctctctagggaggttccccttggagcctggtcccatgctgtgaggaagcccaggtccctggaaaggccacatgcaggtgtcccacctgagggcccagcagcagcctccgctgccagaccgagcaccaggagccctcagatgcctccagccaacccagctgacacaagtggagcagagacacactgtccccaccacaccgggcccaatgtgcagtttggggagcagaattaatattgtcagtgaagccactgtgctgcggggtggtttgttaagcagcagcatgacggagcattggtgcactggctgagtgacaacatgactgcagcgcccccatctctgtcagactctagccaggggacggggcccactcagaaaagcctgtttcaggagacaggacctggtgaccattctgtgcctcccatcccgaggccccagacaaggctaggcttggaatccagaatgcctgggccctcaggacacagtgccctgccccccaggagccaagtgctgagacacgcactgttcaacggcctcattcagaggatcatgcacccgggaaccccacacagtcaggactggtgtttttcgtaggaggaatctgaggctccaggatgggctgagtcccttgtctaatgcgccctgcttgaccttggaagagacacgctggggactgatttaaagccgccactccatacgttctccctgcagctcccatgccagccactgccatccctgctgcaggagcacagctctcagccacagacgcccccatcaatcaatatttttaattacttacatgattgactaataaaattctccaccaactaattgatttttttgatcagagagagcctttgtttttattaaaaggctacttagatgaatttttttttcacttaagtgggaagttgtatttcttttggtcattttggaagaagaaaaataggagggggctgggacaagggaagaccccgaggccaagaagattacaggcccaaactgagagacccatgataatcatcagaaccccttcaccatgtgcccaccaaacacccagtggctcggctctggccagaggagccctgtggcatgggtgggcagactggggacacataccacccaatcgccagcagcttccatcatttttaaaggtgaactgtaaacttttctctgcattttaataaaagaatcgggcttgaaattataaaagcaactcattcattgtgtacagtttggaaaagaaaggcaaatctcataaaactatgaaagtgggcttcctggcacggggcccatggtgcatggggcaggtgacctgaagctgtgagaagaagctgcagggttgacttcggtttcccaggggcccaaggccccaaagagccatgaccataaaaacaatctggacagccacccaccacccagaaaactgctcatgggctcacagatcagtgggctttttgttgttttcctttttcttttcctttttatttatttatttattttagagacggggcctcacactgttgcccaagcggcaggcagtggtgcaatcatggctcactgcagccttgaactcctgggcttaagcgatcctcccacctcagtctcctgattaggtggtactaaaggtgtgtgccaccactcccaactaacttttaaatatttctggagagacaaggtctcactatgtggcccagattggtctccaactcctggcctcaaactgaccctcctgcctcagcctcccaaagtgctggcctcccgttttcatttttcttttaccagattggcatcttactgtagatcaggtgtggccatgttcctccacttgcagtgacctttaaagaggtgtttgtaagtggctccagggcagcccatcctgggacctcttcatgtggcacacactgaggttgtcttccctgggcagctgctgggcacaggatgatgctgggcacaggatgattctgggcagctggtagggccagggagcttggcagcgacaattagggtaagggatggtgggcatgtttggtgaaggaggggcagggtacagggtccccaccacagccatgggatgctccttctctcctggctggagggtctcagccagggggacacagtggacagggggtgttgcccccagctccacactgggcctgccactgcctctgcctgttacttccacagtcatggtcacccactgatttcactgtgacctcatctcttgttggctgctccatgccctacgagcagagcagtacccaggatatggtggatgctctgagaccaagttacaaatgcttgctgagtaaccctacagaaatgaagaacattcttaccgtggcctccacatggcccttctgagtggggccctggggctgtggggaggatgagcctgctcccttaggagggtcactgcagatgtgcagaatgacaatggaatgcagaggtgatgggggcagagctgtccctgtgtcacagctcatccacacagactgggtgagggctctgtgcctcatgccagccccatgcacagaactgagtcctcgaagacagagggactgagtgactccccaggccacacagcctgtctggttctccccatgggacgcttctcaggctcacccggagctttcaaaacagattcctttgcccgtgacctgctctcagcctcatgtgaggcctcagaccagcagggttggaacagagctaatgacatggcagggaaacatgtggatggttagcgacatgaaggcccacccagctggccctagagtgtctcgcctgcctgacagctccagtctgtcaccctgactgggcatgtccagaagcctggccctccgtccttggtgatctcatgctgcgtggcttgcacccgctgggagccgatgccaccacgccaattgctgcaagcctctgaaaggcacctcgaggtgtcctgatctgtccccaacatgcaacctgcccctagatgccctccccaccacagcaggaggcagttttgtcctgctcaattggaaaccctgggagctgagtgaccctgccgtttcccccgcccactgccagccacatccctgctgagaaaaccaagaagggagttggagctttgatcctcactagctggtactgattcccccacctgcagcagtgtcagagaagaccacacagaaagccagaactcccattcccacccagctgtaatgaggagtccccacctgcacctcaggtgtcagcagaggctgagtgagaatcccaagcttctacttctacctggcagtgagaaggtactgcctccctttccctgacagaggctgacagaaagtaccagctgaaacagaggcttaaataagacccagaagccgggcgtggtggctcacgcctgtgatcccagcaatttaggaggccaaggcaaacggatcacaaggtcaggagtttgagaccagcctggccaatatggtgaaaccccatctctactaaaaatacaaaaattagccaggcgtggtggcgcacgcctatagtcccagctacttgggaggctgaggcaggagaatcgcttgaacctgggaggcagaggttgcagtgagctgagatcacatcactgcactccagcctgggcaacagagtgagactctgtctcaaaagaaaaaaaaaaagacctagggtctcataacaaaatatgagaatatctaggtttctaaagagaatttctagtcataccaaaacccagggaatctcaaactaaatgaaacagtcaataaatgctgacatctacatgaaagagatgttagaattacctgacaaagatcttaaagcagtcatcaaaaaagtgactcaacaagcaaatatgaacatgcttgaaacaaattgtaaaatagaaagtctaggcaaagaaagagaagatacagtacaaagaagaaccaaaggggaattttagagttgaaaattacagtaacaaaaatcagtggatgggcttaacagaatgaggacaaagggaagaatcagtgaataggaaaatgcatagaaatcacctggtcaaataacagagagaaaaatagactgaaaaaaataaaagaggaatccaggagactataatacaagacctaactttcatgtcattcaagtcccagagcaaaggagaaagaggattggctgaaaaaatactcgaagactggaaactccttgaatttggcaagagatgtaagcctgcaggttcaagaagcttcataaaccccaagcagaataaaaccagacaaatccatgccaaaacacatcataattaaatttctgaaacataaaaaaaagtcttgaaaacagcaagagacagctatcttggaagacagttcagatgacagtggatttgtcatcagaatcacagaggttagcaggcagtggtataatatttttcaagagctgaaagaaaagaactgtcaacccagacccttttacctagttaagtcatccttctcattcgcattctcagatgaagggaaactaagaaaatttgtcaccagcagacctatgctaaaagaatgcctgaagaatctgtccagacagaaagcaagtaataaatgaaagaaccatggaacatcagtaaggaagaaaaaatgcagcaagcaaaagtatggataaataaaaatagggttttgttatcccagagaaatgaagacatgttcacacaaaaacctgtgcacaaaaatttatagcagctttatttgtaatatccaaaaactggagagaaccagctgttctttatgaaatgaatggtgaaacacactctggaatagccacaccatgaaatactgctcagcagcaagtaggaacaaacttctttttttttgttgtttgagacagggtcttcctctgtccaataaggtggaatacagtgacacaatcatggctcactgcagcctcaacctcccaggctcagatgatccttccacctcagcctcccaagtcactgggaccacaggcaggtaccaccaaacctggctaatttttaaaaatttttatgtagagacaagatgtcactatgttgcccaggctggtctcctgggcgcaaatgatcattcctcctcagcctcccaaagtgctgggactacagtcctgagccactgtgcccggctggaagaaactattgatacaatcagaaacctgcatgaatccccagaattactctgaatgataaaagccagccccaaaaggttacatattatataattctaattgaaatgccaaaattatagaaatggataactgattagtggttgctagggattaaggggtgggagggaaatggatgtggctataaaagggcaactagtgattcttgtggtgatgggatattctgtatctccactgtatcagtgtcaaatcctggttgtgatactgtattacagttttgtaagatgttaccactgggggaaactaggcaaaaagttcagggatcttctgtattatttattacaactgcatatcaaactacaattatctcaaaatagaatttttcattttaaaaatatgatgataagattagaaacagacttgtgtcctgactatattgtttaattactagagattttgctatataaaaatattaagtactagagattttactatgtaaaaataatcttgcagtggtgggggatggggagttattcctccggaaaataagacactgagatgcctagagaaaaagatgatggatttgactagataaaaatgcaaaacgtttgcatgactaaaggccctatagacttcaaaagacaaaccacagaatggtttattattatttgggtttgtccactgtctcctcgatattagattcaggtcacgcatttttggcaggaatgctgcagacctacttccgtgccctccttgatgcaccacaccaggatgaatttggaagtttattccatcactgatgatgatatcagctttcactatttggtgaagtcaatattcatttgtagtgaaaattcactacaagacacacaaaatagaaaagaaatttaatacaaattcaaaaagcatttcatttagtaaaaacaaaaatgatctaatagaaaaatgagcaaagattacagatcatttaaaaaataacaggaagctgcgaatacgtgaaaataagctcaacatcactagtgatgagaccaatgcaaattcgagtacctgtgagttgccttttttgctcctaacacattggcaaaattatttttctccttaaaccttgtgtttgaaacaattccaaacttagagaaaagttaaagaatagtgcaaagaactcctatacctcatctccccagattcaccactgttcacatttttcttcctgtgttctcttttttttccctgtccctcccccactctctccacatgtatatgcaatttctctcttgaaccatttggcgatgttacttctattcaccatgcctccttgctcccaaatattaaatctttatcttccgtagacaaggacatgttcctacttagccatggtacatctgtcaagtactgaataggaaagttagcattgatacaatactgttatctaaccaaaattcatattccagttttgtcagctgtcccaatgttgtctttgacaataatttttttccatccaggatcacgctttgcatccaatcatcctgtcccagtggtctctttaaactgggacaccctccaccttcctctcctctagcattcacattttggaagggagatttccacttaggctgtagactgtgcctccatttgggtttttccactgtctcctcaggattagattcaggtcacgcatttttggcaggaatgctgcagacctacttccatgccctccttgacgcaccacaccaggatgaatgtggaagtttattccatcactgatgatgatatcaactttcactatttggtgaagtcagtattcactgggcttctcaattaaaaggttattatttttccttttgtaacaaaccaggacttttatgggcagatactttgagtctatgtgattccgtgttcctgcacaaactttcaccctcaaatttagcatctgctgatggttgttgtctgaatcagttattctaattgtcaaatgattatctttctaaattccacctacttttactagctgatgctttattatactataaggacaagcttttccttatctttttatttcatatcgttattggatgatgagctcatggagtcttattttattcaggggccataattcattcctatcattcattctgatgcccagaatgtcccagctgggccaatgggagcccctttgcttggttcctgtgccctgtaatatgctttccttgttctctgagtccttccttactttcagtgagatgttctaacctcattttttttctgctccagccctggaaacttttctccagggagccctggttccttttagtggagacagaatttagaaaccaagatgtgagtgctgggtgtgctcatcgttactctagaattcctgaaggcctggggatggagcgctctcattctcacttcggggagagagctgatgcaacagtttaaggggcatttggccatccttgtcaaacgtggccatgtgcccatctgcacacagacacaccatttgcaggaatctgttcgacaaagaggagcacacaagtgcataacaacaacccgtggaagcaaccagagtgtccatcaaggtcagctaaaaaaaaaaaaaaaacactgagctccctccctttctaaacgacactcagcgtacattgaaaataataagactgatttgttcaagttcaagaattactaaaggagaagaagcaactaatagagtggcacatgtaatctgatttttaaatacatttaaaataaaatgtgtgtgtgtgtgcgcgcgcatgtatcttatatacatgagtgtgtttgtataggaaatactctggaaggacgaagtccaagctcccaagtaatgttatcgctcagagagggtagtgagcagaggtatggaggctggtaatacaagcagaaaattatagtttttatttcataaacttctgaactatttgaagactttatagcagccatatagttcctctatctgtaatattttttaaaagtgttaaaagacaataggccaaaaacgacagccggctctctagcctacaaaactggccagcactgttgaaatatactaaagtagttttaaaaataaagagaaaggtactcaccagaagtgggatcaatcggccttggaagcagaggaagaagagaaggaagaggaaaccttggcagtgtttattgtacctgccctggagcagaggtggggccctggcccatcttggttctctgtgaagtggccctgcaggctcttggggacatccccaggctcttgggaacatccagctccccagctctgatcctacccaccactggcttcccctgagtggtccacagggggagaggatgtagtggcaccagccataggaccagaggtccctgacctgggctgtactgctcttcctcaacttctgatcatatagatggatccgcacgtggtcaggaggatggattctggagtcagactttctgaattcacaccctggctcaccgctcactgacttggaacttggaacatggcaatttcccccctacccaacctctctgtgcctctctgtgcctcagtttcaacatctgtaaaatgtccccatacagttgttggaaaggtcaaattagtaaatatgccaagtgcctaggacagtagctaggatgtagtagactctccaaaacgattgtttgtgatattattcctagaagtcacagtgggcacacccttctcttttttcagaatgtaacaggaatgaggccagggttttactcttaggtgtgatattcctgatcgtttgccatagtggtgtgtattcgctaggaatgctttcaactgcaacagttccaaacatagcagcttaaacaaataatgttttgttttgcctccatttacaagaggcctgccagtaggcagctgctggcctgggttcagcagttcaaccccgtcagagctttgtctatctttcatgcattctgcctcagggttgcaatatggttgccccagtgcctggcatcacatctatcttcaatgtaggaagaaaggaaatggaaagaaaagagctgcatttggctcttttgacaagaaaacaaaccttctcaaaatatcccagctgactgccacttaggtctcatttaccagaactgtgtcatttgaccacacttagttcaagagaggctgggaatatatttagacttttagcctcaatagtgcagatctcaagggaaaggcggttggaaacagcctcatggagcttgccactattttctttatcccattaagaagatccgtatggcccatgtttgagtgacatgtgtttgagtgaggaatggttggtggcatacaccaaatgttttctcagcagagggaccatcccagtgtctctatcccgctcctactctaggggtccaattaaatggagtcccacctattatgaagcagcagcaggggaaattcatctgtgggggcagctgggagctccaggacttagcaaacctgacagcctgtgcagaccaggatgcagggcttccaaccccagccacctccctgccgaaatggccaccactgccagctccaggttgctggaggaagctggaggctgccagtttgctagctccaggctttgacagcaagggcatctctggtcagtgcctcctggattgttcaacctgtttccatcttccaggctctcaggagcactgggcagtgcagtggggtgggggcttgggagctcccatgtgtgacagacacagctcccagcttcccttcacatccgcaatgcaggcctggctgatggtatctagttcctgagaccctgcagtgaactcagatcccagatactttcccttgataacagcttcacctttttcatctcttttaacaaataccaactcctggctgaaacccagactcctggctggataccaagtcctggctgaaaaccccttgctgcttcccagaaacagcctggtctgacatggtcagtggagaagagagtgggcctggtgcccacagccacttactgccttctctgggccccagttcctcctggtgaaatcgagagggtgggtaggatgcttcctggctgccccctctgtgcacaactggtggctgtgggtcctggttgcccctctgtgcacactctgtggttgtgagtcctggctgccccctctgtgcaagcccagtgggtgtgggttctagtcaccccctctgtgcacacccggtagctgtgggtcctggttgccctctccgtgcacaccccctgatgtgggtcctcattgcccctctgtgcacacctggtgactgtgggtcctggttccccactccgtgcacacctgatggccatgggtcctggttgccccactctgtgcacactcagtggtcacgtgtcctggttgccccattctgtgcacactcagtggtcatgggtcctggttgccccactctgtgcacacccagtggctgtgggtcctggttgccccactctgagcacacccagtggctgtgggtcctggttgccatctctgtgtacaacctgtgattgtgggtcctggttgccatctctgtgtacaacctgtgattgtgggtcctggttgcccctctgtgcacacccatcttgctcctcatctggatgaagtcactgcccatggtggcctcatgcagcctgtgatgctgggctctcacttgctccactttccagatgaggaaactgaggctcagaaaagctgtcccttgcctggatctgagcctggtcttgcagcccagagctcttgccacctggctgcacccctggcagtgaccaaaattgttggtcccgacccagacctcagagggtcagtgaagagtgtcctgggttggcttctcctcccctctgcaaatcctctcagcccacactctttcagcttctcacagaccacatgaaataatgtgatagatgcaatatgagattaggagctgaacctcacccaggtcaggaaattccaagcgcagtctcccagctcagctctggctcccgtatgctgcccccaggtcgcagcggggtgtgcaggggaccattgcaggctgcaggggcacctgcatcctctagaacttcctgaagaccagacgctctgattttccaaccagcaccagcccagtcatttccctctgcctccctggggactgtcccagccgccatcccttgctcctgcctccctggggactatccaagccaccatcccttgctcctgcctcatgcgggtttcctctctagccagatcctccccgtctgtatccaaaaatactgttacttccctgtccttaagacagtgtgtttgactgctttgcttgtttgtttgctcctcttgatggtaaaactgctccagagatgtggccccatctggggttgccccactgaagccctccacagagactttgtgacacctgaccactaacctcacctcgctaaactgaggcagagcttggcaacagtggtgactcagtggctcagccctcctcttgaaacaccatcctcccgagttccaggacccctctgccaggcccctccctccttctccatcccccacacctccccccatcttcccgtggggggacccagtgctcgtctctattcacactctacagactccgcgtgacaccaggccccacctctgcaccctccacctcaaggatggatacaccttccgggctgtacccgtgaaccccagcctccaggtctacccaaaacctgctcaccatcaccttctcaggtacaaaaacagccctcttccctcacacccccaccgcccaacctgtggtctaccttggaaataaacctcacacctctggtcatctctactgccaccccactccccacccaaaccactcaacagccacctggacctgggaacatggcagctgctggaggtcttaaaggcgccctttccctaaggtaagctgaagcccagatgccagcacagccccttctcctctctgccctggtccccacctcctctcaccccctcactgtactccagtgccctggtctcctgagcaccctcaaacacatgtccccaaatccaattccgcccccaggtcccatgattccctctcttccttctacaactcatttctcaaataactcctgccctgctatcccatcttaaaccgcacccaccctggtgttggttagccagtgctgaggaacaaatcagcccaaaccttaggggcttctgagaacattacagtcttagcttctgcgggtcaggagcctgggcatggctcactgccacgtcccccacccccagcccagggtctcccataggctgcactcagggtccactggatcgggtcatctcagggccgggtccacctcaggctcccttacaaggcaggaatgggctccctctcaaattgtagcaagggctgccccaagtccctggcacacggtcccccagagcgctgctgaggacatcgaagcaagcaaggcaagagagggagcaggcaccagtgagacaacccacaggcctctgtcagacgggggccttgggggtggcagccatcccttctgccttttccatccattagaagtaagtcctggcccaagcagcctctggggaagggcagctcaagagtatggccccagcagtgggcgtgaagctctcctccccactgcgagcttctcactccccacgtaggcggctccagtgcccagctctttgtctgtctccttcaaggagaatgcaggctcttgagggcagggcactccctgtcgtcccaagcttcatccccaccacctgccctgtcacagcatcagcacagctcacagcaggtgctgaataaacactcgtgaacttcagaaagcccctcacagcacaggaggagaaatggccatcctccccagagacttcgctggcattttcctatgttacagcctgatcctaggacccactgaaggctggtttctgcaggagtgaggaagcctgggtgtgagcccctgaagctggggccatactggttatctcggcccagcggcctggaaatcacaccctccccagacttgtccccacatctgagaggagagacacatcgcagagcctggcctcgaggtctcaggggtcccataagggggtggggctaggttcattcttttacatatgttttcaaatattgctaaaagtcataaattgggccaggcatagtggctcaggcttatggtcccagcactctgggaggctcaggtgagaggatctcgagtccaggaattcgaggctacagtgagctgtgattgcaccactgtgctccagcttaggtgacacagaccctgtctctttaaaaaatcataaattgttagacatacttttggggaagtcgtttggtacacactccttgaccagtatgtccagatcctggaattactgatttttttctatagtcacacatgaatgcagagatgtgcagtgcagctttgtctataggagcaaacaaatagaaaagctagatgtcctcgagtaggagtggatgaattattacagcacagccccacggtggaacactgcacagccactggagtcccaggcagagccgcatctgggtgcatcaccatctacctctttatgtaaccagcagacagctatagggcctgcaccttccgagcactggaggcagggaaccgcatcgctgccttcaggaactttatgtcagggttaatgccaacatgcaaataagaatgcaaacacacagacaaatgcagctatcacaggggtgtaaggaaggcagagcaggacagggagattgggaacatgtttcacacagcaatccgggtggctgcgcagatgccagggcacagtgagggagaggctgcagcaagctggggccggcccctcccaggcaggaggaatggccaggcagggcaggtgggggtgagccagggtgaggaggatcctgtggcacctggcagccacactggcattccatactgatctgtgttacaacacaggcacccacctatcagagcagcctgggccactcgttgccagctgcagacaagggtcaggctaactggtgctgataagacaccagcccccatgcacctggtgtgatagggcgttgctgcctgccagtgtcactctggagcagatcagcaggggtgagggcaagggcaggggccgggaggaggctgcatgacccagggtggggaggccgacctagagaagcagagtggggcaggtcggggagacagatattctgaggggcccaggacctccacgttctgagacgctccgcacacagcttctggaaatgttatgtggaatgaaccatcatctggtctttcccttcttttttttttttttttttttgagttggagcctcgctctgtcacccaggctagagtgtagtggcatgatcttggctcagtggaacctccacctcccaggttcaagcaattctcctgcctcagcctcctgagtagctaggattacaggtgtgtgccaccacacccagctaatttttgtatttttagtagagacagggtttcaccttgttggccaggctggtctggaactcaacctcaggtgatccacctgcctcggcctcccagagtgctgggattaccggagtgagccaccatgcctggcctttttctttcatagacctttgagattgccgaagtcccttccaagactcaaatctactggctcggatacaggacatgggcatttggagtagacctccacccagacacaggaaagtagccccccatctccgtcctcactggggtccacttggcaacccagcccagcacttggacacggatggcctactctgccccagtgcagacagctccaggtaccaggtgctcctgagccctggccacaggtcagaccccattctgagaatggtcagaatccagagagaggcctcaggtcctgtgaccccgaggtgctgaccaaggacctcgcatgtgtctggcagcatgctgggcctcacaggaggaaagggggccctgggcccttcatgtacattgctgcaaggtgggcgctgtcatgtgacggggagtgtggaggcctcgggtggcccacaataggcagtgggaggacaaggccagggcccagcgcctgcaattctccatcacaccctgtgtgctgagcagccatccttcaccctcaggctcctcctcgtgggggcacaggggaccctggctcggggagtccatcacttgcacaggtgtcacaggcatagaagtccaaactcaatggatgcccttgcctccagctcccagctgaacatcctggctgaaaggggctgaccgccctgactttcctctgaggtaggtgagctctgggggctccatgagggaggtggctgtgtccaggccacacatccctctccaccaaagcgtctgccctgatgacatcacctcacaccgccaagccattactcacagaattacggcttgtctggaagttggatgagatgtatacaatgcaccaggatgacaaatcctccctttgagtgggtcatttcccgaaggagattccaaggattcacagatcagcgtatcctggcattgcaggcagtggaagccgaggcccctgagatgtgtctgggtctagtctcgctgtgctaatgaggccccagggccagagtggacactgacgtccctgtggggcagtgccacatgatcacatccatgtagtgaagaggcattctggactttgtccctaactcctggtggtgaaccatctttggaacctgatccctgggcccagactccctggtgggtctgacctctagcccacagcacagcaggttgcagatctcattgtccagaaacagccacagcaatatttctgtgttcctccaggatctggccaccactcattgagaggcagagtctatttctcctctccttgaaaccaggggtgccttcacaactgctgagatgaagaggagagagggttttaggtgacttccgatgatgggtcacagacagtaacgtgactctggccaccacattgtaaggaagcccagcggtcccggcccacagctccagcaagggagctgttagtcaaccgacagtcaacaacagccaccagccaccagttgcatgaggggagctcagtgttgccagccccagcccgcaagccgcctgccctaaatgagacagagctgagcagagacaagctactgcacggagcgctgcccggattgcagactcaggagcaaggcaaatgatggtgttgctttaggacactcagcttgggggtggcttctcattcagcgctagacagggagaacacaccctaggtgattccccggccttccctgggacttctgtgtctgcagatccctggtgcagatcccaggcaggcagagggccagagcccatctgcagtgatggttctgcatactgggcgggctccgatgggtcgagaacagctccttgggcctgggggcaggactcagagccacattcacggctgcaggagtcatggatccgtggccaccagggtctgtgacagggaaagcgctacaggctggaagccctgtctggggttatctatttaatgggagataaagttttcatagtactaaaaagtattagtcttcagaattagatatttgctcatttttccaaaggctgtgaggtctctgaatccctcctgcagatctgtggcaagctgtgcactgtcctgtagagaaatggccctttctagatctccactctaaaagcagcaataacaggacgatgcgagagcagagcctggccccaagcagcgtgggtccccaggcattaaggatcctctgcaatgggtttcattagatgagttgtctttggttttattaaaatatgtatgccctttttattaaggcagtattgacctgtgaccatgtgggaggacaagcccatgccccagtctctggctggagggtgttgccccctgggcctccacaggcttcctgatcaaccaccctgccatccatgggcacagaaaacatcaccaggacagcaacagggggaaggcagagtgcagctcccaccacgccgtggtccttggggtcctcagttggagatgagggctgcagctccccacctaggtcacagcccatgcccctctatcccagcaaccactggaccagcctctaccaaggccaccaccaagacagcaccaggccaccttcccaccagtcagcagcttcctctcaacctctattcgttagtaaataaattctgattcatgaagccataacaaaacaaactaaacaacaaaaaaacctatctaagacaccaacatccctgaaaaacaaacaaaccaaacaaacaaacaaaaaacaaatggtgctctgcattccctaaagtgaattcctttgcaatgtacatgagttgctggggctgctgtaaggaagggccatagactaggtggttaagtttactgccccccagttccagggctggaagtctgggatcaaggcctccaagggccacccgcccccttagggtgctagggaagggtctattccagcctctccttactcatagacagctgtgtctccccacgtctctcctcatggtctcccctctgtgtgtctattggtgtccaaatttcccttttataaggataccagtcatactggatcagggcccaccctaacgacctcatctgaccttgattacctctttaataaccttagctccaaatacagtcgcattttaaggtcctggggcttagcactccagcatgggaagtggggcctgtcctgagtcagcccagggtgggcagtgggtatgggagttgcccaggctgctcagagcagggcacacaaaggaggcagcagcaaagaagcactgggaagggctggttctcccatcatcagggacaaaggactgagccccccaacaccagctagccctgcggggattttgctgggagctgtaagaccagggtccagcagaagcagagggcacacgaagggggcagggactggggtttcctgtaggggcagaggtgtgggcagtatggggaacccccaggcctggagagaggctgacccagcaggagctcaggggatggtactggacctccaaacctggctgagaaagagggacttgggtgtgggggtgggggtcaccggggccttgccaggagggggcaggggataaacacactgtcctccccttgctggtctcccccagggcctccaggtggagggacgggtggcacagttcaaccgcccccacccctccgccatcccccttctgccccatgtggtgtatgcacaggatggggcagagctgagcaagcacagctcctaaagaggagggcaggaaacttgctgctcttacagccctgcagccgcggggaggcttgatgctcccagcaggggaaagcagagaggcagctcaggcatggccagcaagggcttagacttacaactccttgagggcatcagcagcacctagactggggatggcagagtgaacagtggctcaggcgagcttccccgaagtggggagtgcgggcccatcattctcacagagccacagtggtggtggatcacacaaaggggagaccatgaggagagacatggggaggggacagctgtctacaagcaaagagaggctggaacacactcttccctagcaccttcagtaggtgggcagccctcagaggccttgatcccggactatcaatgccatgagcatctccaagcccaggccccgggagggggccccactgcatgggcctcagacagcttctgaccagccagccccaccctgccccacccttacctgccctctccttccctggagaagcttgatgagaggggccctgggccaggcctctggaaatccttctgctgcaggcctagagctcaccagggtggaagagggaggggatgggatagcccagatgggcccctgctcccagcagcctccccaccccctgaacactcccctccaccccacctagccgggcaggcccagctggccccatttctcattactattgattatggtggcagagacctgcagcacagaatgtaaatcagcatccctggggtatttaacctaggaagggttaggtggaggtggcatcccttataagtcctgcatctgatgtttttatattaattcctatagtggccagattaatttttattccactgactattatctcttcttcattgactaggagacatttctgagaagtgcatatgtgttgagtatcagtcatttagtggggggcttccctggctgcaaggttttcattaaagaaggaaaattcctttgctccaaagactcagtctggaaataatgcgcaggccagctggtgtcactgccagtgctgccgtcacctgggagtggggtctgcagctgcctgggagcctcaactaaaggggcagggccccctagccgtccctcatcctccctctcctcccagcctcccaggcccagctttggcctcacacaggctctgagtgagccttcagcaagtgaccacccccagctcctcagcccttgctctgtgctggggcctcccctcccacatctcacagaatccgtgccccgactcggagtgaggtgggactgtcactgcagccattttgcaggtgaaggcaatgcacttgctatagattccctgacactcagtactgtacagggtcatggattatcttgggtgggatccaggcctagatcacagaaatgaccaccctttttgatggggtggcagaggcactggatgggtggcttccaagggctccgggccttgcatgaggagtccagctgaaaaaacgggtgtcagaaggccgagagctgtctgcaaacccaagtctctgcagagtgtggtgtggtgtgttctaggagcgtccttccccgctgaccagtaaggccagggccaggggcataagtccagggcactgaggctgggaacagagaggaacatggggaggaggatggaaggggggctcggcagctccggggatgcctggccaagctggacatgctgccagtaggtgggggagtgcctccactctgagaccctcacctgtccctctcccatcctacagggttgagaggagtggatcccaagtgtaggcccaaatgtggagccagcagcaacccagccactgggagctcatggcaagtgtacaccccggcccacaccccacatcccaccctggggcctggtgaccagcctccactggcgcttgggaaccatgagcagggtggctcaagggccccagagaagaaacacctgagctggagcctcagttagctcacctgtaagatagggatgttgctgccacctggggatgctgtgagctgagtgaattggaggggccagtcctgggctgcctacttgcccacatggtagggaggatctccaccagctgttctcaccccccaaaaaagagggctgcctctttgtccagaagagatgattcagggaccaaagctttacctccctgagggatctcattcagcctttcttccaggggccagacatgcataactaaaacccaaacctttatgatttggagaacgctgataaattacaaatgcaaatgggtaaccaggcaacagccccccccgcctgatgccaggctgggtatcagggctgggaaatagagcagaggtcacttcctcccacctggcacaggtcacgagagcctcaatgatgtgtcctttacaaagctgcttttatttagttggaagctgcttcagagacaactgtgaagacaaaaaaggttgctgtgtgtggtggctaagacatcagctgcatctgaggggctggattctgcaaggaaataaactatgaggcaagagaaaggctttagaagatcctccaactgttctcatcgttctgttagctggtctcctgatgaggttctgggtgagtctcaggggctgaggaggtgagttcaggcccctaggagaagaaggaggggggaaacatttcccttcccagtgtgggcctttctacacctacccctcatttacagcctgggatgaatccaccagggcggctgttcacacacaaccctgtcctgaccccgtcccaaccccgtgcgcaccacctcccacccaggagggtgcctaggtccccatgagtgcagggctgggtgggtgagggtttgaggcaggccctgagggccaggcccagggaggcaggatacccacagaggtggaaaccttaggctgactttatcttggctccagtgccggagctgttgaaaacgtggccccaaatgtgcacagaagtcagcagggtgaagggtgagctgccttgcctgctctgccatcaacatggaggcctggaagctttttgcagccctcaggaggggtcctggaaaacagtgcagacacccgtcccgccgggcctggaaaacaagcgagcaatcagctcagcctggccctagaaccacccacccaaactggccccaagccacagcacggacgatctggtgtgtagtgcttagatgccagcctcactcgaagatgagttgcaactggggctgcaattccaggagggcacccacaccttcacagctcagccccatcttgggctgagactagagcaactcaggcaggatggagccagccccaccagcggctgcttggtatccaggcctaaactgggcaaagggcggctgcaggaccctgggcagggcccaggacggatgggtgggcaggagggtgggggcccatctctaagccggaaggagaagcttccagacatgattgcatctgaccttctcctagcgtctcctctctctggctcagggcccactgtgagctcagctccgcactcctgggtttcatcctggggaactttgtaaagtatccaatctacagaaaattgccaacctctggaagcctcagcaggaccaatgtcctccatgcagagcccttcttatcccctaggaccgcaggcccaggctcctctgggggtcagggcggggcacagctaggagggaaggggagttgctctgggtaagtaagatgcttctaagcttctaaatcaggttccagagagacccccacccctgatcccccaccccctgctggcctggagcactgaggtcttccaaaccttccagaacattctcagctgagcactcccagccctgggcaaatcccaagggaacctggaaaaggaagcccctccccttgctgggattatcgtacccttatgcttaaagggccagagggagaagaatgtttctgtgctttttagagaaactctctccacaaaacacttcctgatgcttgtctgacaccaaaaatctattaaagtcataaagttctcctgcagaacgcttctcaaaaatgtatttatctaaagggcatctgtgtttggtctccaacgcaaacgctccaaatgtcgggccccgggtgatttatttgggcgccttgttctctccctgcgagttgttttcagctcaagcccctggttgcgtcgctccttcccctgatgtttatagatggcttccatccgctcagagccaggccggccaggaagaaggggcttggaggagcaggtgagcgtgcatcaaggggctgcagagagtggggcagcggacagatgctcccagcagacccctgcactccccacctgctggctgagcacactcctggctgtcctccctgcccagagggcattctcctggcagacatttgaacagcagctaggaatcctcaccaggtccccagctgccctagatgctgggagttcagcagtcaacgcacctgaacccacgcaggcagacggggaacatgagacagaccaggaacagacaacaatgaagagtgatgcagggagtctggggccacagacattgcaaggccttcctcaggccacagggaaatgcagcacagctagggcgctaggctccatgcagcgccagtgccaagcatctaagcagggtgggaagaggtgacttctgagtgatgagtaggagttggacaacagaggggctgggaggagccaggaagatcctcccaggcaggtgggggtccaggacagggaacacctgggagtctgagggatggggagtctggggcagaggagagagggctggatgctgaggtcccagcattagtgatcaggcctgggcctctggctgcatacagagtcccctgacagctcttcatcagcctcttaatacgcagtagctcatcagcccctttccaaagaggcccctgagggcagggctctgccaaggctgagctgtgtctgtgctcctagccatgcctgctgtaggaaggaagtcctggggctgggcctggagggaagcagaagactctccagatagggggtgcccagggtgtacccctgcagtgccgcccgtctcctcagggctgtgcattttcaagctgcctggaagccagggcccagagggaatgctgcaagagcagagttccctggaacaattcaaccggctgcttctctgctctccttccagcagggaggtgggtggcaggagcccatcttccccaggcacccccaaggagaggctacggagatgttttttagagctgcattgctcaataagtatcctggccacatgtgaatatttaattttacattatcttaaattcaataaaattaaacattcagttcctcagtcacactagccacattttaagtgctcaggcagcacaaagttcaacatggtcatcgtcgcagaaccttcccctggacagacagagcaagcagggaggggcctctctggtttgtatgaggggtccaggcatggcgggaagccctgggcaggcctcagctcaggtagcagcacagggtagtgcaggggctggaggggaagtcctgagggctctgcctgcaaccagccccagggcttccaaagcaacaaaggcctgcgggagagccggaaggggtaccaagtgcctgggcccagtgcagtacctgagcaagtaccaagtgcctggaccctctgtagacacaggggctggaaaccacgcacgacctgcaccctgcaccccacacccaagggcaagcaggagggaggaaaggaaggtggccggcaggcagcttacagttccctcctgtccctgcagctcacagcagctcccgagtgtggagcaaggcaggctcccctgtgcacccacaggcctggagggccctggcagatacacaccttgccagagccacagccacctccatcctgggcccatggcagcctgcagacaccactggggcattcagtcactggcttcctgtttgtcagcatcccaaagcaccacagggttttttggctccaaaagacctcctgggccaaagtgagcctctgaaggtcctgcgggcaggacacctctcagaggacggagggcgcactgcaacttccagggaggccagccagaggctgctgagaggatgctctccgggaagggtgaatgcctgcctgttcctgctggggcactgcggggaagccaaggttggctggcctcccaccacctcccggtgtctccagggcagcactgtcccccagcaccatcttctttgcccaaggtcagctcccggggccgcccaggcctgacaaccatcacctacatctcttctgccttggacccctgcacacatgccttgagtttgggagactgtcccctagatgtacggggaatggagggacttggttttctccactgcaacgtctctgtttccaaaaatggtgcctggaatatagcaagggcccaggagatatctgtcaaataaataagtgggcttttcaagaaggacgaagggcaattgtgcagactgggggaaagagagattctcctaccagtgttggagcaaaaaacaaatcctcagtggtcattttgggtttggcgactgaagaggagaaatgctgagaacactgggagcaggcgggggcacacttcctccctggaaccccgctgaatggcagctcatggtggccttggatgccagggttcctccttcgaagtggctcctctgtggcccttctgtagcccctccagctcagacctggttgtagttgagaagcccaaggagaagttgtaaataggttttgcaatggcaatggtgagcttaatttttcattgaccttacctccagctaataacgaatcggggggcgctctttcactcacagaagcaaaaaggaaaagaaagggcttcctagtgacgagataatttgtcagaaagttatgagtgggcacggcagggctgtataggaagtgtgtattgaacaatacgacacactggcttctaattgctgctgcctttctgatcaataatacatgttttcaaaaagccttctgcttgcatttacacaatggactgtaactactgcaaagatccattaaggcctattttaaaaagcgcattcgtaaaaagttgtctaaatctgcattacaaggcagattatgaaactgccttgggagatgttttgtctaaaaagcattcagcctgtatctgctggacagctgactcgagcttccactctccacgttgcttggagccaggatgccttctccagaggatgcaccaagcaaggcaccggcaggcctgaggtcctgtccacagaccagccggcctctgagcccctcgggctggggctgccttatgtgagccaatcccccaggagcctgggtggccgcagacattaatcaacccaccactcccgaatgtgtaattcaaggtcagataagtggtcctctgcggcaaataggactctggggacccaggtccctccagcactgagaaggcttctggttgcatggggagggctcaaagcctgtggccaagccaggatgcagaagacaggtgtgtgctctagcaagccagtctcgttgaccaccagccccacacagcacacaggtgcgtgctgtcacctgtgcaggtgggaagcccggactgtttgggtccagggccccctggctttctatgccaccctagcaccatccagtgactgcttgggcctcatggcctcagctcctacagctgacaggacagaggctgatgacagcggcagctcgtgctgatggccagcgtccctgggctaaggactctgtgcagactgactgtctgcatccccggggaacttggggagaaggagctctgccttcccactgaggcacggagactctgggtaacccgccaaggacatggggacaagagacagagcgcagacacactcagagccccctgcagccttcccaccatgctactgccccaggccacacctagacagccccctgtaggagagaaaaccctggcagaggggcaggaaacactgccactgtctgctgagcccactgatgcatcattgggctttaccctcaaggcagtgcccatgttattgctctcatgtcacagaggatgacaccgaggcccagagaggaccacagaagctgctgagtggtgtggctagcctggctctggtgctgagcgaaaaggatggagattcctccaagggaaggggaggagaagacgggcagaggggaaagaagaaaggagggcgagggaaggaaattcacaagagaacaaagtgtggggacatggaaaactgaagtgggcaaagtgataatgataggttagtgggagtaggtgggcaggctggtgggaggaggtgggctttctctgaaccccccagggtctctgatggatatgtaggcccctgttgcttttgttcgggcacccggctcctaatcaggccccagggaggatgcaaaaggggtcttctcccaggccaggttgagggctcttctgcaaacacccctgagggcacctgaggcccacaggcaggcaggacctgcacagttaggtaaagcctgtcctgcacagccacaccctgcaggcccaggccaggtgttctgtgagcatgctcatggaagcagcatatttggcatagggtgggctggctgagcagcccctctgagtgccctgagagctagctggtggtcactggcttcctcctcgcagctgccctggagggcaccaacagcaaggccagggaggcaaaccgtggggagcagtagacctgcccctcacctcaatagcccgatgggggagcagagggcagtggcagacagatgggaaactgaggcaccgaccactttgctaacagtgcacacagccagcctcagagtctgtgcttccaaccaccatgtcacactgcccatgggagggacctggacccctgcccacgcccactctgagaggcctcggtcagcagttccaggaatgccacccagccttccagtatcaccaggaccgagctgcgctcttgaatgtgtttccccctacctgcaagtcacgaggcacccccagagccagagtttcctgtcactgcactcagcctcactccaaccatgcttctcagtgcaggcagagacccccatgtcacctgggtcagaggacacagagcatcccgcccgcctcccgccaggcaaacctgcacaggcatggcccagatctctgtccatgatgggtttccctcctccctcccttccctgtgctgcgttttggtgctttggggtcagacctgaggtgctccaggtaatcttcacctgctcagaagcaatgaatgacctccaagttctcacatgctacaggaagatggtgtgagccgcctgcccactgagcatcttaccctgcactggggcagagccttgaaaataccatctcctcacagtcaccagggaaggacactgtttcagtccccatttgagagatgacaaaactgaagctgaggagtaatgtatgcaatgtcacacaactatgaatggcaaaattcaaactcaggtctaatcactccaagcagatgcctgcaccagaacctcttggggaatttttttttttttcttagagatagcgtctcactgtgctgcccaggctggtctcgaactcctggcctcaagtgatcttcttgccttggcctcccaaagtactgggattacaggtgtgagcccttagcctggcccctgaactttttttttaacatggatttttagggagtgggggacccaggatgtgtgtcttcataaaagctgccctgaagattctccaaggggacctgcgggcagggacaggaagcactgaccacactgtgatgtgccctcctccagctcccagagagcccgcgaccctcagcagggcagtgtggccagggtgcccgagcccaggcccaggaaggcccaatggctacaacttattaagggcttcctgtttgtcgggcactgggctctaccctcacatgcacccctctttctagtttcaccccttcttctgaaagggagatgtttatagctggggaaactgaggctcagagagatgactaaggggagtcaagaaagagaggcagagccccctgcaggccctccccaccccatggactgagagaagccagggccaggactcctgggcagccaaagaccggcacgtctgctttgcacttcacctggcccccacctccccttgtgagacctcagggggtggcctcgcttcccctctgctgggcaaggagctccttcctgctgcctgatgttctggatactgagcctacacccaggcagggctgaatctcctttccccgcagtccctgaggccagcaggctctgggcctcacaactgtcctctgctgagcgaccctttggtcagatccctgggcgtgcacgtagcagggaggtatgcatctgtgtgcgtgtgtgtccacgtatgggaacacaggtgtatgcatgtatgcatgtgtacagggtacacccatgtgagggccccccagacctttttccaaggagtaaatgacaccctctcatagtgtcaggtgttcactcaggacccccaagggtgagggtggagcgagagcgtggaaaggcctaaggtaggctaggcaggagcacagccccagatggccccttaagatggccacacagagcccagccagacatcaatgtcagccaagggctggccagggtggtccccgggaggtgcaggggtggggctatttaagcctacccacttctctcttcattcacctaggaggcaatcacaggagcttgtctgtagccaaaagatgcccccagcccctccctacctatcaggtcccttccctgggcacaggcctgagtgtgtagcctaggtagccactggcaccagagatggaacctgtctgaacccaagggagccccttgtggccaactctagctccataaactggaagggtgtggcaggcagccggagtccagtggcccacagtgtctctcctgggctggcaggcctgtgccccggccacctgcccctcagcaagccaggtctggacatcacggttggctgagtgcaagccagcctctgtcttggcagctccccctcctgcctgtgagggtgacttcactttgacttcatatctgcagtgatgtgcagatcacttattcagccctgagctcagccaggcaagagggcggggttctgcacacagcaagcaagggagcggctggctcaagggtgccctgggcccaggttccctggcttttcctcctcaagggcccatgggcttcccttcttccatccctctgcgcctaagtgcaggccagacctcaaaaagcagccggggatggggcgagaacagaggacttccccactgagcccacatccaacctcacccagaaccccttctcaggtccagttgctgctccctattaggggtaaatgtgtttatgcgcatcatttccatcatttctttgggggaaaattggattctttcctcctcctcgctactcgctctccgactctgccagcccatctcctgagagttctcctgtgtaagggatgcaagggccaccagcaccaggtctctgaaaggacgccggagccagtttccggtttccaagggttggaccagtgctggaggggggaatcacaaactgcccttccaggaccctaccctctctactaccccaggatgctgaaaaaggctattctgcctctcttcccctgctcagctcttccccgcctcctgcctccggccccagcagaggccgcgctcccactgcgcctctcgcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcggctctgcgtaggtgcgcggacccgggctcctgggttccatccccgccgcgcacctcggggtccgcacccggctcctgccgggcccttttcggccgcaccccgctcccgcaccccgctcctccccaagccccacccggcccaagccgcgcgtcccgcactgagctcctacacgcgccgcgccccggccgcaccccgcgcagccagagcaagcactggagccccgccccttcccgcaccccacccgcctccggccccgcctggcccacccctggaccgcccccgccccgccccgcccctacccgctcctccggcgcagccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggctcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcgaagggcaggacgcctcgggccgggcgcctcgggccggggctgggcgggtctcgggcgggagcggagcgcgggccgggccgcgggggtcggtgctcagaaccctagccatagccgcaggtctcaatctggccgcgccctgcgccaaagccgcgtcctggagcaaacgggacagccgtttcggggccgacctggcggacgggtcagggagccccgaaagcccgcgattcgtgcggagagttctgtttcggcaggagacggctccgtcctggtttccttttcccgctcagcgtccgtgcgttcctcccccagctctgccgtcctggccagccgagggattcggaggctcttttgaaaagattgcttttccctcgtgcgtttttgccgccctgtctttaaacacctaaaaaccgtggtttctggggtggctccccccgaggggccgccgtgataggcgtcccacccggcagccctggagtcgtgtggcgctgcctggcagagatgctgaagatgcggccataggaggcccagggcttggggtggggcaggggtttgcgccgccagccagcgttggtgctgggcctggtgaaacctcaggtgccttaggatcccagcattaggtgtggccttgcaaagatggtcatcgaccccacccaaactctggcagagtgagccgcaaggctgtggaatctttgaccccttggcacgcgtttaagtgtccctcaaactggccctgacttgatcccctccaagcgcttgtgtatgaaccaagtttccctctaagagggaaggagccctggccatcctccctcactccttacaaagggctttctctccccacagcctttgggaacagaagaagccatggtcagtcaccctgtctctggccccaggccctgcacaaactgagtttccaggcctgcctgagacttcatttgtgtgacctgcgcctcagctcagcatatgctgaggccagagcgggtccccagtccacctagcgagggacaggggagaagcccttgcctttctatcttttctgagtgttaggactttggggtcccagtgctgcagggggaagacacggggcagaagcaaacaaggcgctctgacgctgtcttgggattctgggctgtggctttggctttgaggttgtgggcagggggccaggtgtgaactgctgctggtgtgctgggcagaggacttccccacacccttccacagccttgcgttcagttggggtggccagtgaggctgtgggggccaggctctgggggccggcttgtggcactcagcaggcatgcaggtagctttccgtgcccagacccctggcccacagacagcttcccgaatccagagatggtgagcccctagcccctgggataacccggacaccacagttggaggcactgggagtgaagaggcagccccactccctggagtagacagctggggcctttgaagaggctgcagagctctttcccaggagccacagctccggaggttcgagccgcactcttggagctgccaaggaccgccccagtgagcccctcggtgctccccaaccaccccaaggggacagctcggcctcaagcgccctcttgcggacgctgcactttagtggctgggcctgatgacaggcacagactgggtctctagaggatgagggttcttccacagctcacacatgcacactcacactggatcaccaagacacactcctgccccttctcacagcacttgctgccaaggctgtggacatgcacagcgtggttccttcacaccctgcctcacccacgtccacacagggaccccagcccctctcatcactcatacacacagggacgccacgtgtgtatatagggacacacactcctcatacctgcagggcatagcctgtcagccccaggtatgctggaaccagagtgagagaacctccatctaaaagttacattcatttaaaagttgctcttaaaggtttctggcatttcattgctcaacacagatacagctgtccccgttgcttggatgaggaaactgagtctcagcttctggggttccccccaggtcccaggctgaccctgcacctcaacctcccacagctcctcagcaagcctcttgtctcttgtcttcctggcctgacttcttgggtcctgttttgcagcaaggaaggacattccctctctgcccctgggccccggggccttctgttcccagcatggaagagctgggcactgtgacttggcagggcccggatccaagctgccagaccaccctctgcagagggcctaggcagcccacccctgcctgaagcaccaggtatcagcgcgggcagctcaggccaggggtacagctccccctgcttcatccttttccttctcccctttctctggccagaggcttcaccaggttcacctgggcctggcttgcttcctcctccactccagctcactaaccctgtctggcctccagaagctgcctgcagccctcactggtgggctgtgcctgctgggggcctgcaagcagagagcaaatggggaagtgcattgagctgattcactaaattgcctttcttctgcagaatcactttagggacaggctgaggaaatcactgtttccttggtggtgtgaagaaaatgggatgcgatcacctagcggggagctaatagccttttagccagtggaggagaaaaccaattaaaaattatgatatctgttaaaatggaacctggggtgccaaggggaagggaaggcccggaagctgccatctcccctgagaccttccccctctgcagcctggccgaagaccctctaggtcccctcgtcttaactggataaggctaataccagcagtagcaccccatgggggctcacagtgcactgcccctgtgctgtgcctactcacttcatcttttccaacaagtctgcaagggtcatggtcttggcccatttcacaggtgaggaaacaggttctcatagcctatggactcgaaccggtagagaggatgcgggagctccccagccctggccctctggcttgctccagcccgttctctgggccagtggtgtgggtccagggtggggctaaggagggcttccagggaggttgccctgagcctgcccacccactggtgagtccccccacctcgggctccaggtgccctcaggacatcccagcccagatcccagagtaatgtgtggcaccatgcacagacgctgagatactctctgggtctcgtcagctttagttgatgtctgggagtcctatgggtctggggaggagcaccaggcatggctgtgccagcagaagggccgactgtgtgtgctctgtggatggcaggaaggcatcttgctgccagtggcggtgcagatgttcggctgggacaccaggctgtggcccttgcagccaacatatgcctgaggccctggcatcggatggaagctactgctctgaagacaagggtgcagggatggggtttgggcatcagggatgggggtacagctgtgtttcctcatgcaggacagggccttcctcctcatttttcccatcctccaggacagcctgggagaagaaagccagggaataggggcaaagcagggtgcagccccccatgctccctgctgccctcctcccctcctgcagaggcacttcctttccacttcaggagcccctcccccagaagtgggccccccccatccccccttccttctttggaggctgcttcctggtgccaggttatgctccctccccgttctctgctgtgccctctatctccccactcctctgcaattatttttcagcagagtgacttaatagtaacaataacagtaacaataatagtaacaacagcaggctgggagcactcctgagggagcctcggctcctgccctgctgctctagggctggggactctccagagctgtctcatggcagggagagaccgtagtcaaggagaccctgtgtagggacttccgcatgcgtgtgtggcaaggggcggggactgggcagtgaccaccaggcagggagcacacctcagtcatggtcacagagaaggtgatgatggcaccagggctgtctctccgtgcccgtctgcacctgggcctgccagagccgtcttctgtgccccatggggtaggggagcaccccatggcccctgggaggctgccagtcagtgggactatgaggtcaaatggggaggtcccttggggtccatgacccaggcactgcaccccttggggctggaaggggagaaggccccaggcccaccagagcccctctggctcccccactagaacagcagccagggccggctcagggattgaggcgaagccttggtgcttgattctttgtcccctgaggcaggctgtacctctcataggagaactttggaggacgggccttctcctgaccaaggctctgggacacttggcagcccctgaggtcctgctttacctctctgctttctccccccttctctgagctctggggccaggcctgggcacttggattggcgctgagacaatgaggcctgaacctccatggagctctggtcccgcagctgtgtgatcatgggggcctcagggaccccgctcccctccattccccaagcctagaggccatgaagcctgtgggtccctgaactgtccaccctgagactgcaggcagggcagggctgggcaagagcaggcagcaagctgtccttgttcccacagctcctcctggctgggctcttggcccctgaaaagcctggggcagggagatggtgccagcaggaccttaaggacagcagttcaggtcgcacctggccctggagggagcaggtggccagctccaagcaaacacctctgtttgcttttgcctcaaggagtggctccacaaagtgtagcagcccaggcaccaccacagaaaggtcaccgctgcacctggacaggtgtgcgcctacctggtggaccagcgggcataggctttcctccctgatatcagggatacctggagggcctggtgctggggctctgtgctcaggggagaacctgtggccctacagccccaggttctagaccccctcccagattcgggtgctgcagctgcgcttccactcctggcccttgctcctctgtgctgctgctctccatgccctgcaggagccagggttccaaggaagcacctgaggggcagtgtggccccagggcaggagcaggacagtggccaccaagctgtttccagttcccttgtgtgcctgtgactccagaggattctcgcccttgtgttcctgagagggaaaaaggaaacatgtatttcctagaatttaagtaatgactggggagatgtgtgctctgggtgccgggacgagggtgggtgagctggaggtgcagcatgagctggtgcagttctggagggagggagagggctcattgggtttcttcctcatactacttggcagtgcaactggcacagacccggcagctgttgctgggctaggggccaggggcttcctcttgctctgttccccttcctgctccaccaccattgcctgtagggcgtctgccagccccaggaagcctaacacttagcccaagtggggctctgggcctggccctcctcacccagggaaacaacggggctcatgggcgcttggtgacatgggcacattgctctgccatcgtaaggggccagcctggctatgggacccagcaccggtgggcagcccacaggttgtctctgcaggagactcctctggcaggtcacatacaggatgccccacagcaccttgaaaactcgtgacccgggaaagcctcaaattgtctttgctcccctagcctccccaccacctgtatatgcaggggcatgtgagactgtacttggtgacaggaatgccccccagtctcaggggcttaacgccatctactatgtccttcttgtggcatagcctggcatggcccttacccactgggtggccacacctcccagcccttgtgcctggctatgtgcacaggagggcacagagcttcaagaagcctgaggcttaaggagctttgaggcctgggagggggccaccgtcactttccctgtgttccgtgggatcctgtcacatggtcgttctcaccccaggaggcttcaagtacagaggacgcggggatgggggcacgcaggggtgtacctgcacacacttctgcctaccagctctccatcccttgtcctggtccacatagcaggggctcctggcgggcccagcagctgagggggacagagggggaaacagggtagcaaataattatggtttactcttttttaattgtgaaatttgtgtaacataagtttaaccatttataagtgaaccatttggtggcatttagcacatttacagcattgaacaggcattgccttagttccaaaaaatttgcatcaccccaaaaggaaaccccatacccattaaacagctgcttcctgtccccgggcaacccccagcctgcgttctgtctctgcggcttggcctgtcctggaacatttcatctgcatggactgttgtctggcttcactcagcataaggtcttcagggttcctctaggctgtggcacacatcagccccttcctgtgaggggtaaatagtgtgccgtcacccattcatctggggatggacacgtgggtgctttccaccttttggcagttatgaaaaatgctgccagggacattcctgttataaatacctgagttcgtgctttcagttcttttgggtacatacctggacatgaaatcgctaggtaattctgttttatattttgtggagccgccaaactgttttccacagtggttgaattgtgttacattcccaagggttacaatctatccacattctcaccaccacgcattattctctgttattctctggttcatgtctcactctggccgtgcagccagtgcacagtgctagctcgttgtggctttggtttgcctttccccggtgatggcgtgctgggcatcttttcctgtgcatgctggccagttgcatgtctctttggagaagcatctcttcgagccctctgcctgttgtctaactagatggctgtcttgccatacagctgactttgctgttgcatctgcatcaagagctgcagagaagcagctttatccagggccgtcactgtcagtgattgagccccaggtcccttgtgaggagagtgtggattcgtctgattcctcacatgggcattgaatcaccactgccctcgaggaccttgaggacattctcggaagacctggactctgaggccacgttgagcaccaacatctggaaaccatggtgtcactgcttgtgcataagaaggggcctctcaggaaccgccctgtgaaggatggaggaaggggaaggtgcaaggagccagcagacccccaccccactgacaagacgagactcagcagcaggggaaccagggccgccctctctcgctcatcctgaaccctgactctaaaaataaccaggctgataatcggatccgctgtaagttgattatcatcattgccgtggtgtgatgtcatgctgccaggccctggggcagttttctcaggacagcggtggatgcacctaggcagctctggaggccagcatggagctggggggccctgaaccgagggtggcaggcagcctctgtgggctcctgcaaatctgcttggtgggggtggaacactggcatccataggcaggcactctgtgctcccaaggaggagttcctgtccccattcgcagctagggacagagccagggaagccaagtgcccagccctggcaaacagcggggaagcacaggggcatgggctgggccgctctgccctgcgtttctgctccttcctgctgctgaactctctcctttctgctgctgaactctctcctttggactaggcctttgtcttcttgcctcatcgtcagtggcctgggaggacacttgcagtcttaatcctgttttggccccatgtccctcaccccccaggggccacctaggccagagcctgtcctgatttccatctcggccaccgtctgcccctcggcccctggtcaggagctcattctgtggatactcctgcatagacatcacgtggactcaaagggcatgaggacctcggctgagaggagcttacacatcagtgcaaacctctcattttacacagggagaaatcgaggccctgagggaggcgtgagttgtcacacatgggggtagtgtcagatgaagacttggcaccacttccctgggcatccccttccctgcatggcatccccagccttgggtttggattcttcttcacccttgatgttgaggtctttgctcccaggacctggataacagcatccagatgcaggtggtgcccccgcatcgggctgcctggctgtgacctggggcatcaggattgtcagcttgtctggccccaggtctgtgctgggctgaaacctactgtctcagaggctcctggctctctccctctgctctccactgctcttaagagcagaccctcaagccttttttgtgtcctctctccagggagagcccagcttctactctgcagcccaatgcagaaggggtggtagctcacggtgcctcggcttctctgcatgcctgtcactgaacagagaagcccaggccagactgcagcttaattcctagcctctgtgtggcctccagcagggtacctaagctagtgctgcctcattttcctcctgtgtgagatgggaatcctcatggtccctacctctgacagttgttttgatgcagtgggtgatgcagatgaagcgcccggagcagacctgctcatgaggagcacaccgtggattcctactggttaatgttgaacagggatgagaaggggctggggtagggcgaaaatgggcaagaccatctcagcttgaggaacatgagctgacagattgacttaaatttgcacatggacatgatctgagtcactgccttgctgagtgcatggggacagttgcccaggccagaggcaccagggtcaaagccagtggtgatgccctggccccgttgccccaggccagggccagtgaacaatgtaatcagctggggcagactctacagccctgcagccaagggggccagtgacccttacatggtcatccacaggccacttgggtggccagtcctgttcagccaggccttgccctaggaaagaaattaattataacctaattggcagtttcctttgcatagaagccggaagcaactgccagtgaggctggtgattaactctgcagcagctgggaaattgcagttgggcaggagcgcccatcatcctggccaggccgctgcagctggtctgggtatggaagtgtgggtggtggccatcgtgcagcttagggcctgggcccctcagagcagaaggctgggtctgtgtgcagaaggtagccttgggctgccaggtcccccagtgcccagttgcggacctccttctcccaaacctcagccatgcctggaccccttccccactcacggcagaaggctgcatggcttttaggggtgtcaggaggctcatgtcctggttgcagttctaccatgggtgtgcagcgggaattctgggcttctgttttctggcatgggatggggtgaatgatatctctgttctacagcaggggctcagactggatgtgtgagaagagcctcagttaaggagggccatgttcgtgcgtgcagggatcgtggtgcctcccaggccagggccgggccccatctctcctcctcctcagctgctcttccagctactggccaccctgcctggctggaggtccaagaggagaggtatctgaggagatcctgcactccacaccgggtctcctgcccagcattttggaagaaccaattcttaagtctggtactgaggccgcactgccatgatgataactggtgtcaccaggacaccagggaaggagctgcccttggtgtttactgagcgcccggtatatgcactgagctgtccatcatctgcagagaccagtgttttcttgatggttttacagagagatgcttaaacccagtgaactaagaatgggacaggctgtcagatttttctcaaaggaggtattgacttgttagcgggtacaattaggccgaggaaccaggggctgatgcagtgtgctcccgaagaggggcttctatggactccagttaccagagcctgccccaggattttccttcacacctgctctttatgccagggatcaagcagggttataaatacaacagcgggcaggatgagccagtggtggccctgtgggtcttcacagcccaaatttccttccatggttagtgtaggttaaacctggcaaaaagctgctttcatttggaagtctcaggatgccagcaaagtgatgagagtggtagggatagaggtgagatgggggtggtgctggtgatagtgatggtcatggtgttggtgttggtgttggtagtggtggtattggtgatggtgatagtggaggtcgtgatgatggttgtggtggaggtgatggtaatgttgatggtggaagtcatgatagtgagtggtggttgtggtggtggtggtggtgatggtgaagacggtggtggtggacgtgatagggatattgatggtggagctcataatggtgaaggtggtgatggtggtggaggcagttgtggtggtgatggtgctggtggaggcaacggtgatggtggtggtgatggtgaagacggtggtgggaatggtggtggtggaggcaatggtggtggtgatggtggtggtggaggccatggtattagtgaaggtgatggtgaaggtggtggtggaggtcatgatggtgaaggtggggatggtggtggtagaggcagtggttgtgatggtggtgatggaggcggtggtgttagtggaggtgatggtgatggtggtggtggaagtcatgatggtgaaggtggggatggtggtggtggaggcagtggtagtagtggaggtgatggtgctggtggtagtggtgaggcagtggcggggaaggtggaggtaatggtagtggtagaggtgacggtgatgttgatggtcgtgatgcagccatcttctgtgagcatttgcttggtgccagccactgatctgtgaacttcatgtgcattaattccttctagctcccaacactcctgtgtggtgggagctctgagtctcagtgggtacagaggagaaactgagatacaaatatatgtcccttgctccaggctcattaccactgcaacacacactttctctccatcacccagatggagtccacagccttgcctggaatccacaagcttgcccaaccttcttcttcttcctaagttcatgccctcatggcccgaggagctggcctcctgtctccaaccagcattcacctccggccctgtgctgttgctgctcatctgaactgcctctacctcctgctgcttttcccctcctttcactctggctctgcccccagccctcccgtcctgccgggcactggctcctgcttgtggctgcagcccagagcagtcccttccctttagcctccacttgcctgtctgtggctgtctcttggtcaggcattttttcagaacgggcagcgtggggcagcccccttggcccctcagcctgggctaggcactctcctccatccagtgctgggccctttaaacaggtcaggcagcgtccgctcagcagaagcgtgtgatgacttccccagccggctgacctcagggagggtgcacatgggtgcccccagtcagctctcctgacgtccctgccggggtcaggtgtcccagggtctccagccttagggtctaacacattcatctctccaaaagtaaggattccttgccagggaaagggctaacaagctgcctgttttcttggccagcaggcatcctccccatgagcccagggctatgggtgaccagcaagccattagcatatgcgtgtccatctgtcctgcctggctggtgggctgccaggatagccgttccttttgctgcccaaggaagtactcaggacccagttactgtcacctctcccaaggcgtgcaggtggcgtaggaagtgcatgtccgttctttctgtaggacacacctcaggaccccaggggacattgtcaagaggcagaaccagggtgctcctgctgtgtaccagggccgacagcattgtgtcggggagcccgcccccacatgcaaggacacaccacacacagggaggcgtggagcacatgtggcctgtcccacctgctaacaggccggccatcggggccctcctctggctcataggcagggcatctggaggaagccgtccctgccaagagcaggttgagtgtatgggcactgtctgtcagcctcatactcttgttatcatcagacaagaaccctgagagttaagggaggcaaaggccagcaaggtcaggacttggggcagagatcggggctgggacaggagcttgttcaggacagtgggcaggactcccacaggtggagaggacagggatggccatgcacctgggagccctgggccaggctgagcgagcgagcaccagggcccggagtgaggggctgatggcaggggcatgcaggcagctgcacataccaggctctgtgtatgaaagggaaactggacatgtgtgagtaggcccaggcctggcaaatggctcagagagacacctgtgaacagctgtgtttggtggctgccctgggcaggggtgaggctgagagcccactgaacctcctgagtcagaggtgatgagagccacccccaggtgcagggaagacacagggaatttaggaagagagcaggacgccaggcagggtgcacttaatcgtcacttggaaaccagtgtccagtagtggctgcccgggagcctcttgggttggcactgggctcgtgtgaggaggaggcgtggcaaagggaagggctctgtgacagaaggcagttgagactgggccgcttctgggcgctgcctcctctgctgaggcctcagatgggtccctgccttgctcagggctgtgtgctccatgctaagccttgtcctcctgggggctcaggcacaaccaggtgactctcaagccagggccacatgcgtgcaccatgggcccctcccacatccaaaagcaaaattatattctgcaactgtgttggtataagacaaacacaatccaggccactttattattatttatttcttattatatttatttcatccttttgattttaaaatgaattaaaacaaaaaccttttttgcgcacccaggcgcatgcagcagtggtgccggtcaggagcagaggttcctcctctgcaggctcctggccccctgggaccctggcaccgagggctggccctagcggcccagcccttgtgagccctcacacctgcctagagatggcgcgctccctagccagtcagggcgctctcgtgcctggatgctgtggtctcatgagtggacagcagctgaagtgggaactgcagcagatactggccgtgcccaggtgtgtacctgccccaggcaggtgaccagggcagcagggtgatgccagatggggccaaaaatttcatgcttctgtttgaccttggttctagctgaagatttagctgtgtacacatctttaaaactgggatccccctataaaaaccagatgcacaggcagccgaagaaagaatggatgaattgggctacatcaaaatgtaaaacttctgtgaaccaaggccacaatcagaagagtgaaaacacagcccatggaatgggagaaaaacttgtaattcatagatctgatcagtgttaatccagaatctgtagagaactcctcacactcaacaacagcaacaaaaaaacctgattccaaaatgagcacagggggccaggtgcggtggctcactcctgtaatcctagcacttggggaggctcacgcaggcagatcacttgaggtcaggagttcgaaagcagcctagccaacatggtgaaaccttgtctctactaaaaatacaaaaaaattagccaggcgtggtggcaggtggctgtaatcccagctacttgggaggctgaggcaggagaatcgcttgaactcaggagacagaggttgcagttagccgagatcgtgccactgcactccagcctgggtgacagagtgagactccatacaaaaaaaaaaaaaaacccaacaacaacaacaaaaaaaatgagcacagggcctggatggacatttctccgaataagatttacagatggccccaagaagcacatgaaaagattctcagcattgccactcattagagaaatacaaatcaaaatcaccatgtgataccatctcacacccatttggatgtctactatcaaaaaaaaaaaaaaaaaaaaagaaccagtgttggtaaggatgtgaagaaactgaacccttgcgcactgctggaaggtaaatagtgtagctgctgtggagaacagcaggaaggctcctcaaaggttaaacctagagctgacttcggctccagcacctccactctggatacatacaggaaaggaagcaggaagcagtcaggatatatttgtatgtccccattttcagcagcattattcatagtaaccacaaagaggaagttacccaagtgtccattgaccaatgaatggataagcaaaatataatacagacatacaatggaatattacttggctttaaaaaggaaaaaaaatttgccacatcctatgccatggttgaacctcgagggcattatgtcacagaaggacaagcactgtatgattccacttacatgaggtccctgcagtcgtcaaattcgtggagacagtagaatggaggattccaggaactgggagaggagaggagggggagtaattgtctcatgggtacagaatttcagttttacaggataaaaagagtgctgtggaaggatggtttgcatggcagtgtgaatgcacttaatgccactgaattgtacacttaaaaattttaagatgataaagttcatgtgtattttaccacaatttaaaataactttttaaaactagaatctctctttatatacacctccaaatttgttatttacagtagagcctcccttgatccgtgttttttccctaaatgcaaagttagattatagtcccaggcaaaagcagcctccagctgggacagagccgaggacccaggtttgtgcagcatgctgcaggtggtcctacccgagtgagtctggctggcagctccggtgcccagggctcctcaggcactgatagatcatttcctgagctgaaaaggagtggttttgtcctcagcctcaggcttgtttgctcagcacagtggctggccccacaaggttgctggtgcactagtgggcactgcacgtgtgcacagggcgcatccacacagctctatcctgccactgacagcctgcccgtggctccagtgcccgtgagaccatgtcacagtatctccccgtcctcttactcccttccccttcccaaattctgaccatttcccaaatgtgcccagccctttcacactcctgtttatgaaaccattgtactggctcgttgattcattgattcattcattggttcataaatttattcattcagctcacagaaagtgagttggcagatgtggcaggaaggtaggcaccctgtaagagtgaggaggaagtgagttggagggcagagggggccctgggagccctgatgaggagctatgttttattctgcaagcagcggacagttaacacagggctccacagagggtgccatgattcagtggaccctggctcctctgtgcgagattgcctgtcctgcccagcatgtggtccagggttggacaggggtggcagaggggacttgggaggtggggtgaggggtgaaagagaaagggatctggggactgaggtgtgtgacctgagcagtgaggtggggccataccgtgatgagatggggaagagttggggacaatttggggtgaggaggggccaaactgaggcaaaggagtagagagagcaaggcatggagatgcccaggctgctgatcagcatgctgcacaccagcatagagacaggattaacagcccagggcctggatatggctggtgagtgagccactgccaccatctggaggacagggtgcagaggaggaaaccagccgagggggtgagcagcctcggtagcatcccagcgacgctggacagcaccaaagacagaggaggtcctgggagcagctgggagaaagtgggttacccaggaggggccggcctgagcatgggccctcagcagcagcagtgaggctgaaagacgggagccagaccttatgtagagtggaggaaaatagctgtccacatggaattctccacccagcaaaaatgggccttccatgaatgacgtcaaaaaatgaggcaagaagaaggccaggcgcaggctcctgctggtgggggtgggacacagtggcaggtggggaggcgggaggagcagcagtgtggccaagcatccagttcagcagggccacgggctccagggtgtttgttcagcataaatgttctgtgaaatgtattcgttgtacatgtcaaatatttgactatagtaagagaaaacgtgagtgggaagtgggagggaagcggtgggggggtgggggtggggtaacaggtcacatcctgagaggataacagtgctcagcatggggctggagggacccccatagggacagctggcctggggaggcggggaccgcctctttccacccccagcccccagggaggagccctggggcctgtttcccattcccaggaagatgattgcattaggaaatcgtctcttaaggagattctgctgggccataataaagctgtcatctgcatcgtctgccacccatcaagggcaggcgtggggctggtgtcgcatgaggggttctgcaggaagggcctgctctacacacatgccctacgctgcttctaattcatgcagtttttggatcatatcgttgttattgttttcttttttggaagtcccaaatttcggcccttgtgctgccatcctagggaagtttttcatggtctggagctccatttgtgtttctgtggcagggtcaccatgccatggcaagggtgacctcacagtgccccatcagagctgccgggtggtcggcagtgggggagtgagagaccaagggccacagccaggagccagtggagagctggtgagcccctgcctccacagacagggccaggccacgcttagtatgtgtgcaccgagggtgcaggaaaatgtgtgtgcttgtgtgtgaaagcgggtatataccagtatgagcaaatacatgtgcttgttagagccctattggcagtgtgagaatgtgtgagcatatgggagaacaagtgtataacagtgtgtgcccccgtggtgtgtaatggtatgcgtctgagagaatgagtgtgtgtgagagaaggaatgcatgtgtgcaatgtgtccgcctgagtctgaccaggagacagccccacgtggtccctgagacaggagcagtaacatcagaggcactaagctgtgatgaaagagggatgaatgggggtggggagagctctgtggggcaccctcagctgcaggtgggcaccagggaaggaaccccttcccagctggggtcagagcctgagggaggagctggatgctaggctggggctgctgtgcaggctcaggtctggcaggaactatccttagggcacgggagctgaggctgggggctgcaggaagctgatggctaggctcaggtatgggctgcatcagtgccgagggattgcatgctttgggtatgtgctagggtggagcacatagcacaccctgtctcgtggactgcccgggcagcaggacctagaaaaggcaggtgtaacaaccggagacaggagcaacccctggcctgtcccagcatctctccaaagccctccaccgatgaagcttggccttgtgctgcctgcaaagtaacctgctccaggcccgcctgggcatgagaacatgcacacctggacggagtgtgtggattgacaaggtgtgtgcacgcgcacatgtgggacgagggggctcaggactggtcccctctgcatccaaagatgaataatttaaacagcccagccacgtgtggaacattggaaacagtctagcacttcactctgtcaaacactagggcagactctttcctgctgagctgggcagggtgggagcagatggggtcttaggtgggcatgcctccatctctttttctgtctcctgcatgccctgtgcgtgcatacatatacacacactcatgacacacactacataggccttgaaggtttctgaggtctctctgaatgtgagcagcaacttgggtctttggcaagtgtgctgtgagcaagcaggaccttcccccaccccatcctgcatggtgcctgggcacagccagcctgaggaaccagaaccacggtggcgggggtcattgagggttgatgtgggaatcctcttagtttctcagacaagcgacactgccatttgcaccgtcggtgggtgtggtgtgtgccaggccaccgctgtgctgcagaagtacagggtgggcccagccctggcaaccaaagctgtccaggcagacacctgtgtgctaggtttgagggaggattctgtcaccacgtggcatttgggctttgaaggcatggggtgggaaaagctttgtaagtcctgctggtgaccttcccatggtgccaggagtgggagtgtctgtcaccagacgtgggtctcgacccacgggcctggccttggtccacaggccaggcggcccttctaggcagaaaggcggcagcaggatgggaagccaaccagcagggcactgggcctcctggcaggctcagcacctgctggcgcctggcttccaccatcactttcttagctgttatcctaacccccgagacacaaagcctcacagcatgtccagctatttcacttggtcaggcttctcgccacccagccttgctgttcttatatgtgaaatgggcagtgaagggatctgcacccagtggctgagtctgcagtgagagcctcatgatgatacacccctgtgcagaggtgcacgcctggctgcacctgcactggccgttcctcctctccttagcatgcctcccccacttcgaagctggggaaactgaggcccagaggaggccagtgttctgcagagtctgcacagtccggtggttcctgatgccagcagctgttccccagctctcccctgtggctgacccaccacgattggctgcatcatttgtgggccccttgatctagaattatgaagaatttcaagactgtagcaaagagcattaaaccaagcgtgagacctctgagcagggcccactgggactgcccaggctgcagtccgctgaggcaggtcctgcacccacctccttcattctcccaccttggaccatgtgtttttccatctagaagtgtctgtgacaagcgggaaccttaagacagctgtgcccagctgcagagaccacctgggaggcattttaagtgcatttaagtctgtttctgctcgcaatcattgcctgacccacaaatcccttttggcagcagggagaccaattgggattgggccccccacgatcctgtaggggtgggctctgccagatgggagcaggaaggcccgttctcccctgcacatgtgggctttgtggtgggggctttgggaagcccaggcctgtcctacctctagtccctggaccactaaaggtgcttgcacatcatggaggccccagaggagcacctgtgggattcccagactggatctgctcctgcgacagatggggtgccagggccctacccactcttctgcagcctgggcatcaccagagccaccccacggccacccaagggcaaatggttcttattgggaagaccagggccagaggtgtgtgtcccagagaaaactagacccagctgagctgcattgcctctccccacctgagctcagccaacccctagcatcctctctggggtaagaacatggaccccactgcctgcatggatagcccagacataggatgccacatgggattgggagggggctcatcggggccagggcatctggaccctcctcgccctgtgaggccactatgagttacaatctctcaccctctgtcgccagaaatgcagcaccccctcccaccccgagggcactgtcatgggagcagtgttcctgatgtacagtgagcacttcaagagaagctttctcctgttctattttcccactgtgggactccagacgtctcacctgttctcttccaggctccccttggcacttgattgtttcccccaggtgtgtcctggaggagcccagcggccctgggggcgttctcaactgctgctgcaggccccgccctccagacccctcagcgacctcaagcagcaaccgtctgggtgggagcaaactgatcaaaaagagagatcgattacatacaagtgcagtattcctaatgtgtcctttggatgttggtattgtttgggcattctagagtctatttgcaggttcttaatggattttaagcattttttgcctatttatccatctttttaaaaattcatacgattttttattgtggaaaaatatacacaaaaatgatttacaatgtaactatttttaagtatacatttcagggacattaagtacattcacattgttgtacagccatcaccacctccgtccctgaacttttcatcttcccaaacttaaactctgtccctatcaaacactaactccccatcctgtctcccccaagccctagcaatcaccatcctatgttgtgtctgtgaatttgactactctagggatctcacataagtggaatcgtgcagtgttcatccttttgcaatgggcttatttcacttagcataatgtgctcaagggttatcagtgttatagcctgtgtcaggattttcctcctttttttttttttttttttgagacaggtcttgttctgttgtccaggctggagtgcaatggcacaatctcggctcactacaacctccgcctcgtgggttcaagccattctcctggcttagcctctcaagtagctgagattataggcgcccgccttcatgcccagctaatttttgtatttttagtagagacggggtttcaccatgttggctaggctgatcttaaactcccgaccttaagtgatctgcccacctaggcctccgaaagtattaggattacaggcgtgagccactgcgcccggccagatttccctcctttctaagactgaatattccattgtatgtatagaccatgttttgttcatccattcatccattgatggccactgaggttgcttccaccttttgtctatcgtgaatagtgctgttgtgaacatgggtgtgtaaatatctatttgagacttggctttcaattcttttgcgtatgtacccagaagtgggattggtagatcatatggtaattcaatttttaagtttttgggaactaccttcttgtttttcatgataactgtatattattttccattttcaccgacaatgtacatgagttccaaaaactattttaaaagctttccactgtgggaaatgttggccacacacagtcagcagcatagtgcaccgtgcccctgcttgggctcactcagccacagccgaggctagcatcctgccttcttcaaggaagctacgcctctgtccacagcgccttcagtgattcatttttcagttatttaggtaaaaattacatagataggccgggcacggtggctcatacctgtaatcccagcactttgggaggcagaggcgggcggatcgccggaggttgagagttcgagaccagcctgaccaacatggagaaaccccatctctactaagaaaatacaaaattagctgggcatggtggtgcatgcctgtaatcccagctactggggaggctgaggcaggagaatcgcttgaacccgggaggtggaagttgtggtgagccaagattgcaccattgcattccagcctaggcaacaagagcaaaactccatctcaaaaataaataaataaataaataaataaataaataaataaataaataaaaattacatagataagatgcacggaccttagctgcacaatactgacaaacgaatatgcccacgtgatctgcacccttctcaggatatgggaccttcacattccccagaaagtgccctgtggcccttcccaatctgtccacctcccccacacccccgcctgccacaggcagccagtctgatccattgcctaacatccgtccagaatcatgccatgtgcgctcttctctgcctggcttcctcaccttggcatggtttgtgtgtgtgacccatccaggtgtttgcgtgtatccatagttcatccttttccattgctgggcaggattctgtggcatggctggaccacggtgtgcctgtccatccacctgctgaagggcctctaggctcttgacttctgtgaatcatccttccatttccaactatggcatttgatagacgtatgttttcacttttcttggatgaatggagtggaattgcagggtcatatggtaggcgtatgtttagataaagatttatgactttcctgtaaagtgctttcttcattttttggcaactgttgcctgccccacatgggtggcagtgtctcctgcccttgaacactctggctctgggtgacctgttgagaagtctgtatggttcaggtgcccttccggcttggatgattgagaataggcttgtcactgaggatactgcttcccctgtttccttttctttttctgttttaaagcagttcttttctagcccgtgtgtaactatacaaataattgagtgttcatgttctcaggaacagagatgaaaaactcctgctaagatcggaattttaaattaatgattttttttttttttgtccttgaagaagccttattctcaccatccctcactcacttccctacttcccacagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcagtaagggagccgccccaacacccaccccgtgccccaccccaccccttcctcaagccgcccttatcacagccgctgacactgaagcttggcatggcttcccccccaccgctggtgtggaaggcgtcaggggttaagtgaggctggcctgcctctgtgtccagcctggagagaagccaggacaagcttcagggctgcgtgaggctgtaggagtttggagacacacgggaatcatccgggtacactcttctgccagacccgaatccctcttccagtggggctaaaaaggattaggaggtttcgagagagggagtaagtggggctggaaaaatcccaaggttttgatttagcaaatgacctgcaactctctggagaagcggcagttcccaaggaaagcctgacttcttatcagcagctggctgcccttgtacctggcagggacttgggcctgtcccaggtgtccagggaggaaagaggagcagtcagagccagagtcacggccacatgtgacattggtaatgggaggggtgggggggaagcagagcccctgtgacaggaaacggtgatgctgcacctggtagctcccatccctagcacccctccagggccacagcttgcacagccctcacaaccaccctgagccctgtctgctggtgagaggcaagcctcaggctatgaatgcagagcaggcatccctgccctacccaggcctatctgccagggacagccagggtgcaggggagggaggagacttgggtgggcaactccctccggcgcagcccaggcagttcctggaggaggcagcatctgaggttggtcgtggttctacgcacttagttgctgccctcttcatcctgagcctccagggtggagcttgaggaatgggagtccctgggtgggggccagtgtggaatttgccctgggcctgcatttcgtaggaggcctaagccctccaaggtggggagaggcttcatgcacagccagttcctgtggaggaagaaaccacagggtaatttaacagggagagtttgtgtaaagaattaattacaacaggggattggagcaatgagggacaggctagcaaaaagcaaagagaatgccagagaatatgggaagagcagctctgaggagcagccgcccacctagggctgagatggaggctgggaaagccctcgcagcccagctgaaatggctatggcgcttcggtgatggaacttgccggaaatgccccctctaggcattggggaagtatgtctgcggccactccaaacctcctgaggagggtgtggcagggggggtgctggtcaccccttactggagaagttgccaccatcagagttggggagccttagacccagtgctcaacacacctccctgaggaaggggcctctaagccaagaactgaatgatgagagctaggcctgtggggcattggtgctgggcagcagggctgtgcagcagaggtaaggaggtggcaggcagagctggaacaccagtctgagccttgtggaccttggtggggaccagggtttacaccagccctggagctcctgcctcctccccattcccgactgcctggcagatgtggccgatgcccccacagacctgacttctctctgcagaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaatcttgcctgcctgcagctttcattcttgtggggcagacagagcgtctgagcatgccaaggaaatcaggtggcttctggaaggagctagctggggaggaaactgggaagagggaaacgctgaagaggaggggaacagacgaggagacctccattcctctatcgtaaattgggtggtcagggtgggggctagcagagcaaaggtgggagggtgccgggtaggcaggcctagccccttggagggcaccacagtgtgaccctcgtgtgcctggagtgcactgagcgacagggaagagctgaggctgatggggcagaatagttcctggggcagggggcaggtctgggagtggcttgcagggctttctccggaggaacatggggagctatggaagactttggagggagggagtgctggcaggacctgacttagttttaaaaggattagtcagactactgtgttaggaatggtttggggtgggaaggttcaggggcgaagctgggagacaatcagaaggctacaggagaaacctctgaacaggaggatgtggggtgtgatgccgggatacgggtggaagccgaggcatggcgagaagcaggcagctgcagccagtcagagggtgggatgagctggatcccagtggagaggggagaaggcagctgactaggtgcagggaggccccatttgaccatcagaaagtcaggaagtggggctcaaccaggtcacagaggctgcaccgctggcaagtgtgtcctaaattcacactaactttatcacacaaacatggcaagaatattaaaatctcagtaaaggaagacaagccatcacttatgcttccccagattcctttcattctctggggcagggttgatggagcacttggttttttgcatgctgccctttttcactaaaaattatgtgattaaatttagtttagtggggggttttttgtaatcacactcaacagaggaaagcattatatgataagcatttcccacatacgtaattcatgcgcaaggcatggttctgcctgggaggcttgtggagttgcccccgcctccttggggtgggttgtggggtcttcagcggtgaccttccgccttcagcatgcccccttttctggattatttctggaggacaaatccgaggtcaggctcgttgaagactgtgttgtggttcctggccctgcttcaggggcgatgtagtctagcgcgagctgccatgcagggcacggagcattcgcttttgtctcgacatccggccttcagaggatgaccagcctggcgacgcactggacaaggaggtgtagagtggggatgcacactaggcggtcggaaatcattatgcgttaatgtcacatcataccccagatgtccactgtgtttgttttcaagtggtagaatcgtggctttctcacgttctctaaaatgaacacatattgcttccataattgaaaaaaaaaaaaacctaacagtttttaaaaagcagccaaggtcaccaatatggtgaaaggccgtccctactaaaaatacaaaaattagccgggcatggtggcgggcgcctgtagtcccagctactcgggaggctgaggcaggagaatcgcctgaacccgggagttggaggttgcagtgagccaagatcgcgccactgcactccagcctgggcaacacagcgagactccatcaaaaacaaaaaaaaagcagccaaggccagtagctggctctctagggctgcagtgcagcttgggctgaggcaaagccacccttccccacacaaggccactcctgatcaaggccaggtgggcggaggggtgtcccagtccctactggttgatcagggtgcctggtcctggctcttcccaaccagcacgagtgaggacgcagctgcagcaggacgtaagcacagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcattctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggtccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttcgagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcaaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtccgatctgtcagtcttatgatctctgttttaatgttaatgccggtcagttgtgtccaaactccagcaggaagagggcctaataaggcaagtccaccctgccttcctgtcatggcccagaattctgtttttaaggtttttctggtgtcccttggccaagaggggatctattcagttggtccggggactcaagattttagtttcagtttacaactctatacacaaacaccccatacacacaggcaccaataccctatgcacagacaccacacaaatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgagtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatactgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccgctctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacttgtgggcctgggagagcccagccctgctctggcccgcccccatctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatgtgagtgcctgctccagggagggagggtcggggtcctgggggcttctggagcctgggcctcctgccctttgagaaaagcagtacagctgcaaggcttagctggggagtggggaaggcatggaccagcttcaccctgagtgacccagcagtaaatggttgctccttccagataacatacaggaccttgggtaaatttgaattttgggtaaacaacaagcagttttttggtataggtgtgttccatgcaacttttgcagcttctcgaaagacacacctctaggtccatccatgccctcttaggaacatgctgacacagctgccattcatgccattcattgtgtatctgaaatgtaggtcccacagggcgtcgttggctgaatctggctgcactcacatccttcctcctgtacttaccccagcccaggtgacccctgctttgtgaccatgatgtcctgtaccctgccctgcgccctgtgctcctggcactgtctttgctgccctgggtctgtcactccggtccccttgggctccatccgtgggcagctcagctggtgctgttccctgtccttgggcactagctggacgctgggcccaggccagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgcaggggcgatggcaccggtggaaacggggtcctggggccctgccagcctggggtggctctccctgctccaggtctgcttctggcacctcatcccccatgtggctctcgatgccagcatagcgggcagcagtgcagggcttgggagagggcttgtgagtacagtgaatggtccccaggccggattcactctggacttgggaaggtctgaaccaaagttgggatgtgctggggacagaatggcgtttttctgggaggtcctcggccaggggatgtggtgtgggcaggggactcattgtctgcatcagccagaggccagcctgggtgtgcccaccaccatgaggggccctcaccatgcagccctgagagggtcccggcctctttgctgtaagggccacctgtgtgaggaaccccccatacctcctctcccataagccatggctccccaggatgcttccgctggcaaggctctgtatatggtgtttccctactcaggcctccagttgctcctccctagaggggcaggatctgcctaggaggtggtgggggcgtgtggcggggctcccacatgggtgacagcctgctgtgtgtcctgtgcagggatcaccaggaacttctccacctgctctcccagcaccaagacctgccccgacggccactgcgatgttgtggagacccaagacatcaacatttgccctcaggactgcctccgtaagcagggtttaatcagggcatgggaacaggtaggagatagtaggggaaacctggatcccacaggcacttcagccagagttgccagggctgtcagttctatgcatcaagctgagcctcctgtgcatttcagcatcaccctagccatggggagggagcaggcagggtcagggacagggggaaggcagggacccacagactgtccaggcccctgctgaggtcccagaagtcggcacacacagatttcagaagcagagaatggtcagtagggacactgacagggaaagtgcggccctgagccagacgagggacactgcaatgtgcgggtcaggccaccaggctccagttttggaggcagagtcctttgttcagatgaaatgttaggagggggcctggcttcacccatggcttcagaaaggcactgtgaccaagccctgcccggctaagccaagctgctgggcccctggcctcactgggcctatgcttgcgacaccagttggggagggggctccttgggacactgccctggaaatatgggcgcctggggtggtcaggcgccccaggaggctgagtgggctacgtctgccctcagggggcagcattgttgggggacacgagcctggggagccccgggggattaaagctggctatggcacctgcaactgcttccctgaggaggagaagtgcttctgcgagcccgaagacatccagggtgagtgggtggcggccgggaccaccaccacctcccagccccacagaggtctcaacagcacatctgaggtcccaacaagggaggaaattgctgggaggcgagtgggccccatgaaacttccctccctccctctgggcctctgttactccacccaggagaggggccagggcccctgtaaagtgtcttctggccataagttctatgatggacaggccagaaaagcagttcttccaccaaacaacttgtcagcctgacaagtcactgtccctgtgaccatgcagctgggacccacccaggaacacatttcaaggtcagcaggtatggtgggttgcacagccacactgactacactcaggggtgctgttctgcctgagcatagggacacgtttctgtcattgagttttctggtattatatagccctacgtccctagccacttagcattttcataaagaaaatgccaaagacatttggaacagaggaaaattttgacctcccctgccagccctccagtgccagctggtgtaatgagcacagcctctgctgtgtgaccttggcaggctgctcagcctctctgagcctctgtctccatctgtaagagggcaatagtggtctaggagggggcagtaaatggcagtacccatgctcgatggggtgttctcaggccttcccacacctccatggccacttcccagctggcgcggacacggcaggctggagagccatgaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggtgagggtccctgcggggcagggaagatcccctgccctccccagctgccttccagggagggaggccagctggggagacagaggccatcctgtgaggggctgccaacgctgggcagacgaggcctgtgttctgcccccatttccatagggcgctgtgtggggacagtctgtggggtgggactgtgatgaggtgccgttcccatctaggtgagaggcagtggtcagggtcacagcatcgggcaggggagcagcagtgtggatggaggggcactgaagtcagaagggggtgcctttctggggagcctggcctgcaggtctgcatgtgctactcagagcctccaggctgtgccgagtatcctggagcctccttgtcccggccaggcaggcctctgccctctcctggtggtggcctgccccttcagtgttcctactagcactgtccagggcgctggaagccaagcccagttctggaagtaacagaggctcagagccaagggtgtgagtgaacggtgagccacgcagcttatggtggcgtgaatagctcctcggcaggagcctccagggaggaagctgagcacccagtggccacagggccctggcagttcccatctcaggctgggaggtggcctgggattcctgggaggggccatatcccacagtgcagctcagcctgaggcctcggccctggagcctccgttcaggcaacacccagccctcggtaagggtgtgagccaaggaggccttcccagatgtggccactgccgcttccccaccagctttcctaattggtggtccccatcctggcctggctgcagcttagcctcatggcagggctctaggatgagccaccagagtccttcataaacccagtgggtttgtgtgaggctgcccaggaaggccgcactggtctgggctgctgctggcagagaccaccaccctaaccccagtcagctccagagtcacactcatcagcaccaggtcttggacccatgactcaacctcagtatttgagaggatcaggttgatgtcgccctcatgtgcttattgcagtctctagagtgtggtaaacaggtttccagtgccagctgtggaggtgacagcggcagggaagccatggcagtgtcgacactgaccttgactgtgggttcccagggaatgtggggccagaccaggacagcccaggagcaggagacctggggtgacggatgcccagagctggcacatcaagggagggttcctggatcatggcaggctttggcctccctggtcagagttcaagtactgggggccagggtgggggtctgggaaggcatccggagcagtcccaagtgggcccaatgtgtggatagaactttggtgggagggcagggtggtagtgccagcaggcagggtgagcgggtgcgtgagggccagtggcagcccttgaggagcagtgcttccacactctgaggcggaacatggtggcgcctttctttgcaggggtggctatgtagagaagttgtcctggacacttccactgtagtcagaggtcctgggctgggcctggtgctcatttagtcctggggcaggggtcaggggagacagtagaccaggaaccagagagggtcgaagtactgagtccaagccatgctgtgaccacacctgtcatgtagcagctttcaggggcctggctgtggggtcctgcccagggcagagacaggcagcgttgccgctggctcagatgacagccggttctctgcacattggaacttgtccatggggcctcctttaagggtcttgccttcttcctcccctgtcatcctcacacttttcccccctcttctcccccttccctcatttccaacataggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaaggtacctgccaggcacaggcacagtgcccctgggggagtctccggggcggggggcgggtgaggcccctcctgcccagcatgggaccctgaagagcccccaatgctgttctagagcggctgcagttgggggacccctaccatgggccacttgggcctagagaagcagagcgaggactttgctctccctggaaggctctagaggtgttgctgtgccagtgccactgaagatctaagctttaaacatttaaaaagccctttgattttgagctgacagctgtcttcactccagtctgccccattcattcctctcagcccagtgtctcctggggtcttggtgaagagaccaccagtaaggactggccctcaatctcaagagacccccatgggcctgtctggcctgcatgcccagtcatgccacaagtttggctctcgatgggcacatgcacctacccacacaggcatgcgactgcactgagtagccccctcttctgtggccaggccccagccctgtgaacagccaggctgaatggcggtgagggagagtggttggtgtacataacaattatctgcagtagtcgggggctgcacagcacagggtgcttccagatgcctacccagccccagactgggttcacctccaagccagtaaaaccccggactctccaggggcacagggagacccttggatttccattgcagccatgcacagccccaggctgcccacacctggtccaaggggtcctggggccccaactcccaactgtcctctcccttccagacaacctttcaggacagaggaggtggcacggcacagctgggcagtgggacagctgacctgggagggatggcttagccatgtgttctgactcttggaataccttcaggcccaggcacctgctgggcattccagcacagctctggccaccatcgggacgcatgtgctgggcaggtgatccctgtggtgcctcgtcctgtttccatcatgcctctacagttagactctctggggaatcatgctattcattaagaataagccagaatgtcaggtgtgcagtgcactggtaacactgctttatctcaggtgctaatgtgggtcttcttggtaactaacggagtgtgagctgctgacgtgtgtgtgacggatacatcagcagcacaggagatgcctgggctccaggctggccatctcagacaggagcgggaaatggggagcctggtcgcggtgtgtggacctcctttatggctctccaccttctccagggcctctcccgacaagtgggtgtgtgggtacccctcacctttccagaatgattaatgcggggaatttctgtggacgactgtcttctaaagacaatgactacaggaacataatgccacatacacaggtggcccagccctgggacactctggggaaagatccggcatgtgtggttgctggctcctcagggtgcttcttcctcagggtggatgaggcccctgtccactgatcccaaaggctgggagaagcctcaagcagcatcgtctttgcaggcctctctgtctgaacttgggcaaggcgatgcaggtccatcctgacctggtatggtcatggaaggggcttccaggagcgatcgtttgcaacctgctctgtgctgcatttcagagaacgcctccccgagtgagctgcgagacctgctgtcagagttcaacgtcctgaagcaggtcaaccacccacatgtcatcaaattgtatggggcctgcagccaggatggtaaggccagctgcagggtgaggtgggcagccactgcacccaggctgggggctccatacagccctgttctccctctttctccctttccctactgctcctgccctgtttcctgttctccctctttctggaagcctggctcaggccccagcctggagcttgtgtctagctgagtccacgggctgagtggtcactttccatcagaggggccccgcgctagcggcactccctgggcccacagggctactcagaggtctctggtgtgacactgccatgtgtcctcacccagttcggggctgggcccgtggggcagggagctctaggaatggacagtgcatcctgggtactagggtaccctgggtaccacagggcaccaggtgtgctgtgacctcaggtgaccccagccccgccctgcatggcaggaacattgtcaccatttctcagataaagacccaggagaccagcctggtttgttggttttccaaaccaccatgctgctcaggggcttcccagcatgcgtgtgtgggtgtgtgcgagagggatagggaacccaaacaccgggagtgcgcagcaggcactgtggtcggcaccagtagagttggaggctgggcctgggacaggacaggtgggaacagggagcaggctgtgtgcagagcccagcgccaggcaggaacccttgcatctgcgcaggcctctgcctccatcagcatccccagcctgcactggggcaggacccaggaggcaaaaaggcttggcgtcctagcatcagggaggggtgcctcccagggcagtgtcgcctgcctcaggcacctcgagaaggaggcacccacacgagcagcaggaggcagagagcaagtggttcaagagaaagctgaggcttcaaggtctgcgctctccacagagctgcagcagtgctgcctgaggcagggctgtgtccacccccttactcattgggtggccgggcctggggaccctgcggcctcccacccctggctcctggaagacccaagctgcctgacccgcacgcccagggccccctctctccgcccccaggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaaggtgcgtgcatatggctctgcacccagccagccccggccaggccacaccctgacccaccacgcccctgccacccacaccctggcctgccactcccccaccatgccacactctagcccaccatgcccctgccatggcatgccatgctatggctcaccacgcccctgccatgtcacaccctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagccagaaacatcctggtagctgaggggcggaagatgaagatttcggatttcggcttgtcccgagatgtttatgaagaggattcctacgtgaagaggagccaggtgcccagtcccggggatgaggcggggctcccagggatcccaggtgcaccatggggcaggcagtgcccttgggaagcctaggaaagataccgaagattagtggagctctaagctttttatagccctcaccccaaatctttctgaccctgggtccccaaggacccaattagaactccgctcagcctctgccatgtccttctcctccagggcctccagggcacccctccctggcagcatactgacccgaggcccttgccgcacttttcagaggccacctcatgctgcggaactaacagtcctcttctgcagaataaaggtcaccgttctgatatgaccttagctcttttctcaaagaagggtgggatgaaattagcaggatcgtcattctttgcaaaaaggaatgaactgctttacaagtgaggcttctcccgcacaggggccttggacactgggctgggtgagtttagaggcataggaaccccctggacaggatccagaaacgcagcccagctttgtccaagtctatgaaacaggcagtgggcacccttggggacacctggttccctaccatggtcctagtcccgggacaactgccttggccctcttagtttttctgcccatgtcagcccctctcctgcagcctcccagtggcagcccaggcagggcaagttcaaggggctgctcaaaggccatgccgcccagacgttcagagcagaccctgctcaaaaaagaagaagaagaaaaaaaaaaaccacaaaaggcgacttcctatgattcagctttgctctgaggggtctggagaagccatttgtgttgccaggggttgtgagctgttccgtttcttctggggtttcccttgtgacagcagatctcagaactgctgtggggggaagtggtaggggctggcccctgccctgtggagggtgtggacagagccttcctgttgatgcactggtcctccagggagagaagctgaaggcattcttatacaagacgtgcaggctacactgtcacacactgctgccaagacagccacactgcactaaggacataaatccctcatgtgtttaagtaaaagaagtgacagtaagattgtgttccaacccaaggcacacattttaaaaatggacttgcaccttcaggcttgtctgtggagaagctgtttctcaagtcaccctggaaaggatttgttaggtcagaccccagcactgatgagggatgtagggggctgggggcactcattcagagatgctaaaagcaccctgcaatacaataagagagaaaaaacagcctcccccaaggcacacagacaaatcccttccctcaaggctccttcagtgtggtagctgctggcaaagtgcccaacatggaaatgctagatgttggtttcccaaacacattggccctcagaaccccaggggagatcttgcagggggagttccaggcccatgcatagggaagcactgctctgcactaccagcaggcctgtggcatgtgacaagctggccctgtgtgcctgtgggtgggcagctgactcccgccagcatctcagcaatccacaggaggttcaggctggagctccagccccttcaaagatgtgtgtggccagttctgtgcccaggagtgtctacagcactcctctggttactgaaagctcagggatagggcctggccttctcctttacccctccttcctagagagttagagtaacttcaatgtctttattccatcttctctttagggtcggattccagttaaatggatggcaattgaatccctttttgatcatatctacaccacgcaaagtgatgtgtaagtgtgggtgttgctctcttggggtggaggttacagaaacacccttatacatgtagtggggccacgacgcccgtctgtgcagcttggccagggaattgcactggccctgagcacctgtctgcagtgctagccctctgcaatgaccccctcactgaggggccttcatgatgtgttcgtgaggcaaatggctgggccaggccgggctgcagttctgaaagctccggtagagcatgagagccgagcaggtggccagtaacccagcctcccccacccttgctagtcccatgcctccctctgggtcccttggtgactcaggcccagcccagcagttaccctcctgtggtcctgagtagggctttgggctcaggcagagcacccagtgacttgcccccacccacaagtggagcttggggactccacctgaagatggccttgtgtgagtttatagattggtgtgccccaaactgctcaaaggtggaagccaaaatctcattcttccaggtccaatgacaagagctgatcacttttaaaacacaggattcttgcctctaaagtgttctacagtcagcagaggtgtgatgtgcctctctttttttgtggggggaggggatagggtctcactctgtcacccaggttggagtgcagtggcgcaatcctggctcactgcaacctccacctcctgggttcaagcgattcctgtgcctcagcctcctgagtagctgggattacaggcacgtgctacttcgcctggctcatttttttgtattttttggtagggacagggtttcaccatgttggtcacactggtcttgaatcctgacctcaaatgatccacccacctcagcctcccaaagtgctgggattacaggcgagagccaccacgcctggccaacatgtgcatcttaaatactgtgggctgtgaataagcaattggacaacagctttccgattatataagctgactgtaggctagttggaaaaggcagagaaaagcataaagaagagactgaatgtcattggaccacaccgcccagtgacctctggctgccctctggtgtgctccgtggtgtgcacatgtatgctttttattgccctaaatgggctcatgcgatgctgttttgtgatatgattttgttcccattgcaaagcgagttttccttcacagttaaaatgtttttctatagctttttttccttctaagattttatgaaattttccaagcacatagaaatggcaaaagaactatacaaggcactctgagtctggtggcctgcattctcaccgctttaagtgtgagaatcttaagaattattaagattaattcatgatattaattaatgtatcattaattcattaatcatgaattcatcttaagcctcatgtgtcccttgtgcgtgtggctgctctgatgggagtggcttgggcaaggacttcagcttcatggagtaggggccaggcaggcaggcagcccttccccaccttcatgctacatccatctgagcagccagacccaggctgacatctgtgagcatctgtgcttgaagccgacagggtcagcaggtgcttggtggtgggggtggatatctgggccccccggagggctctgtgagggccaggtggagccactcactggtcctttcactctctgcagatggtcttttggtgtcctgctgtgggagatcgtgaccctagggggaaacccctatcctgggattcctcctgagcggctcttcaaccttctgaagaccggccaccggatggagaggccagacaactgcagcgaggagatgtgagcggggactggctttggcccagcctcacttgggaagggaggggacatctgtgtgcattccctccccatccagagcagccccaggagaaaccaggagaagtggggggtggggagtgggcagggcagaggttagagagccatccttgggtgtggcagtagatgctgggggtcctaccccactgagggctggtgggcttcctagggggtcttataaaaatgagtgagagcagagactggtgcaatgcaagctcaagggctgagagctgtcccagcaggacacttagggaggagaaggtaattccagatggcccagggggcacgtgttaaggggtgcctgagtggaggtgcagagccaggcaggggcagcctgggctgcaacctgagaggttgaaacctttacactctcaggggagatggtcttagaaaccaggctgagaacagatgagaaagggctgcccagaggcagagatgcatggtacatgcattccacagagtgtgcacactgctggggcgtggagggggcatgctgggccgagaagccaggtaccacctccctgggcccccagctggtggccagctggagcgctgtggtctgcctgggcacccaggcaagcaaggacggtgcaggacagacgtgtgattgccaaaggttcttgtttgtctgtctccacacctaaaagccctcaatcaattcattcttcttgagagttttaaggactggcacttctcacttagctgccagagcaagcatagtatccagtgagctgtttaccagtgtctttgcaagggaagtaaaaatgaatctcccttggagggaagggaagcttgtaggattctggaccacagctctgagagacctgagcacagtggcccacgggctgggatcctgcaacaggccatgccccagtcccacgaggctcagagatgtcagcgatgcagaaatagctttggagttggagacagagcacactgggcccagggtacagggcagggtgcgatggctgtggtgggctgtccttctgagacctggccctgcttggatcatattggcctgtctgctcttcccaccaggtaccgcctgatgctgcaatgctggaagcaggagccggacaaaaggccggtgtttgcggacatcagcaaagacctggagaagatgatggttaagaggagagtgagtgcctgggtccaattcccacaagctgaaagtggcttggggagactccagcctcaccccagggcagtagttttagccctcagagttcccagtgtggggccacagtgggattgtgcagagagagagagtcatgctctcccctgcatgcagacagcagattgaacccttctcaggccaggccgcttgggcttcttttcaagtcatgaagaaaccaagattcttgacatttaggaaaagctctctacagacaggcatgggaggaaaatattccaaagccaaaaagaaatagttttccataatggaaaatgagaaagttgagttaaagcaagtgcccaaaattcagatgcccagaggggggtccggctggaggagggcagtgagtaaggagcagtggagactgtggcaaacagccagccccctccaaagggttccttgctggagtacctgtggcctgcagaaaaaggagccaggaatgggctgggtcttctgaattttatgaggtttatgttgtctcccagtttttattgttaacaattcatttaaatttcccagagccgaacgcaggccaaacaaagcatatcggggggtggccagagtcagcctgtgtgcctggaagtacagtttgtgaggtctacacattttcaaccaatattcatcaggcagctgctaggacccatactatgtctcagaggctgggaatgcagataaacaagaccagcacagccctgccctcacggggtttacacacaggccttgtcttaacattggcacatttactgagttgtcacttcttccgacttggatagcgggatgcaggacctaggaccccataggaaaacttcacatcactgtctcgcttggatgaaaacttcaagtcctgagaatgcagcgttgttcaaaacagaagcgatcactggtgctggccttcctagaacagtgctgagaaacagccgggaaaacgctgggcccctctgtgcacattcaagctgggcattgaaaggagcagacgccagtggcccctcgtgctggggagcccgtgcctgtagcagggtcctgtgcaccctgacagcgctgtcagatttcagaactcagccctgacgtgacgttctagatggcaggggtccttggggaaagctggaaaacatcctgcaggctggggctgcgtcctggcatgtggctgcagtgggctcccccagagcccaagggtttgtcagcgggctggttccgtgctgcccatctccgggttgggccaggggcagctagatgaggcgtcccccaaggctgccctccaggccctggagataagacgctgagggagcacatttctttccccagggaggtgactttccaggggaagagacagaatagacaacacccaggggagtgatggggacctcagagcaggaccaggccagccaggagtcctgggagctctatgcagcctggccctggtctcttggagaggtcaggagattggtgcgaggtggagacacagccagagcctctgccctgaggatggcttgttgtatactgagttgtatctagttgtggcacatggcttggagtgaccggccatctctgtcttccaggactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttcaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaatgtgtaaactttttttctttttaacattctagttggaaacaacagatttctgattttgtagtttccatacaatatttaaaacatcacaaagaattctatcatgataaccactgaggcatcaatagtggtcgaggactaggggctctggagatatcgctggcttatctggtacatttgcgtgtgaataggcacattgatagaaactgaaaaactcagctaactccactgttcaaggaatcccttccttaaaagtgtccatccctagaacaaagcagcagccagtgtcaagtttaggtcttcacagttctctagcaatttgcttgttgctgatcttttgaagttggccttagagctgtgggagacagaatacaaaatgccaagtcctgaggaaggccattagaagtgtgagggaaaatgctgtcctgaaccaccatgaagcctgacatactcactacttctgtttatgtcttccccgaggaattctctgagcttctcatgccgggcgtggagctgatgggtcagtgggcaaacgggagttgttgtcaacatcagtctcatctgcgattgcattgtgtcagatgccaacggcctgtgtcacacacatacacgtgtgtatacgtgggcctttgcacgcctcgccaggtggtgtacatgcaggccttggcacgcctcgcccagtgcccgccccaggcccatgaggccccgcttcccagccgtgggtgtctgtgtctgctcacggcttcctccttcagcctggaccacgggctggaagtgaacgtaatctccagagccagctgtttgctgtagcctttacctctgaaagtagaaatctacgccaagaaaagttaatgctaaaagccacccctaatgtagactctacattaggactatttgtgtgtgtatgtttgctgttttattttcccctaaaaacacattttctgccaaccttcacgaaggatttcttcccaccacgaggccagcttatgtgggcagaaatctagttgaatgtgcctgagaacagggcttgaacaaatacttcatacacaaaagaaattttgaagggaaagcataatttctaacatataaagaaagcctctcccgcaggcaggtggagcagttagcggtgcctctctctgcctcgggtgcgttcacgcatagtgtctggcacaccttgttttattgctctttgctttattgcgtttttcacaaattgaagttttgtggcaacgctgagtcgtcgagaaagtctatcagggccattcttccaacagcccacactcacttcatgtctctctatcagtactgttaagcagtaaagaatctttaaaccaaggtatgtacattgttttttagacatagttctgtcacacacttaacagactccagtacagtgtaaagtgtaacttttatatgcactgggaaaccaagagacttgtgtggctcacttatttgggatcttcaatcttctttgctttaccggagtggtctggaacagtatctctgaggttcgcctgtgtttagtggtcctcacaactggggggtggttctaggaagtcctagggaatcctaacctctgtggccctgaaaaagcagaaaggtgggtcttcagggtgcatgcagcagtgtgcgtggccccacacgtcttccacatgaagatgctccaggtgcaagtcctaggcttgtgcgcctgcagggaaagcaccctctctgccagggctcctgctgtggccctgtcccttctccatggcagcagccttgaccgaaactgtgtagagtctcccacctcttcagggagctgggactcaggaaggatcatcttagctgaggtcataagaacctgcatgtagagaacttttcagcgtggggccactactgtgtcctgctgctgaggccaggtagtggccgtctgagggctgcaagggcaggctgctcccaggagttaaggaggcaaacactctgaacaccctggagaaatcacagtttatctttgcaactacaaatttgagtgctgtgtcaagtgaccaggtatttttgcagatgtctctgaggtgttaaatcacaggacctggccaagcaagatctctcagctggaccccgggcaggggatcctttatgggggcacatctcactgtgggggctgcagaaatgtgaaggtcatcatggagggagcttgcggtctgaaactaccccagccactgtgactaccacactgggagagatcatagacctgcatcctctcagatgacactgagcagttcaagctaaaaatgtgctggtaagcaaggtaagtgaattctaaagctaaaaaaaatcatttttcattttctgagaaggaaacaagtttgatatttcatacacagacaatatttaccatgcagactgtcaatttcttgaataaaaatatgaaattcatttaaaacattcaagtttttgtgtatttttctcaatgtattaacagaagagcaacctgtttcttggctgctcgattgtctcacctgcacatcaatccttttctatactctcccatggaagaaggggtctccaggggcaagagactttggtcagaggactgcagggagccaggcagcacccatgtcttggagcctcccctctccctagggcgtgtgccttgctccatattttgtgcctttcttctgggagttttcaagagcttgagaattttcctggagactctggccacagggcctgaagctcttagattgctcagaaccccatggtaaaggagcacactgagggtttgggggacttcagtgtctgggaagaaaagtaagatcatagcaaatgatttctaaaaataagaatgacaccaaggatggaagagctgtagtgtctcacaagacagtcactggaaaaagtagaggaagtgtggttggacactatttttaaagagatattcacacaattacctctaatctttaactttgtagaaataagcaaaggctacccatatgagaacccacaggagccactggttctgaacttgctatagcaagagagtcagccaggatcacttacttttggcagacactcaaaagcaggcagaggagtgggaaagccttatagtaaaaaataaaaggtggggagggtgaggagaagccttcagggatgctgtgattggggcttgttggcctggggaagctggaggcagctaaccaggaggagggcctcttatgtgattggtttgggggacacaggtggctttctctgtttagttcagtgggcaaaaaatagggaagcttgcagttcctgaccaagtcctaaccattctgggataattgttacagaggctgtggtttggcttcctggctagttctgcagagaatctgattcaaatcctctggccgtatgtggtctggccattgtctgtttgcatgttcagtctcttagtcccccttgtcggtcattttcttgtttgtaaaaggttggccaactcaaggaagtctagagatccagctcttcactgctcagagattattcagttgtctctctggtcaaccgtattgtgagatcttgatccttctgttgttatagcatcacagtgctcatttgacaagaatgggatgcagtggaacaacatcaggaccactatgacagaaacaagagcaactgtccctgtgagacgctttgaacgcaaacctcagctgaccaatgcaggccaagagcaaatcccatataggccatgaggatcaaccttagaaagccaaatagcttttgcctcaaggtgatgtgtgacctgttctaccttctcttgtttcactgatccagatgcagtattagcagtggcagaggccatcaccaaccaacaagaaatctacagcaatgagactgtccatcactactcatgccaatgagttgagactgataggtgccccatctagggaagaaggggcattgctaatgacttctgccagggttaatgataagtttatgacaacaggattcccacagatgagaacattgctctgattgtttgcataaacaatgagtcagtaactccccagttagagtgctgaataaccaagggtgatgttacggtttttgcagttttacaccaaccggtttgtggtaaatcgttacagcaaccctaggaaaaccaacgcaccatttctatgtatggttaatgcatggcaggtgtttaaaggtattgcaggatattggtgcttttcctttccccagtgcacctcattgatctcaagtgagggatttttctttttgtcttgatttttgttttctaagttgaacaatctttttttctcagtgtcctttctgtatacagtatctataagtgcccttgtcagtagctgactggttggggaggggctacccagctgtttgatcagcagggccacaagttaattttaggtcctgtcttatttttgttctaaagcacttttaaaatgtctgccaggtgttgtagttcaggttaaggggctatttcccattctcatttctgtttttgattaggtctccgatttcagatttagctccttgacaacaagcaatgaaagggccactttctagactcccaaatgatacaatgtattttctagcctatcccaaaaaaaactcctgcaggtccttttgtttgtttgtttgtttttgcatgacaagggattatggtctaatctttttggtggggggaatgtttgagatatggcttttagaagactttgccctatgttttgagcctctttgttaactcttcagttttattgtggacagtgggatcctaggatcccttttgggggagtctagtcaacttttgccattcaggatttagcatgcaaggttctggtcaatgtgtacaagttgatatgggttaggtaacactgggtcacatgcttccccccgccgctttgcgatagggtcttgctctgccaccaaggctagagtgcccgtggtgcaatcatggctcactgcagcctcaacctcctgggcgcaagtgatcctcccatctagcctcttgagtagctaggactacaggcacacaccaccatgcctgggtttttttttccatagagatggagatctcactatgttgctcatgctggtctaacttgtaggctcaggcagtcctcactgattcaccttccaaaatgatgggattacaggtgtgagccatagtgcctgaccaaagtattcttaattattttatgcatagttgctgatcttgcctgggtttggggaaatccttaattatggttattaatttagcttgggtctaaggtttaaattccacagttgtctgtatatggggctcatggaggaataggccttcagagaggcagctggcatcctggggtcataggagggttgttgtgaaagggcagggatctggacaagaggaagagaagtgtggacagatgtgtggaagggaagagatcagaaggataagggggagaagagggagagctgtattagggaagcaaatggatgataagcagaaggatttactaggaaaatgagtctaggttgttgctgcttaagtttgccaaatcgctcatcagctttagccagagtctttcagggaagcactttttgaatcagaatatcatttggagacctctgactaccaatcaaaaaaggctgctcattgggcctaagaaatcttattctctttcgtttctaaggcatctctcaaatgagcaattttgttcaagttagatgttctccaaataagatcttcaccaaatcaaccttggtgaagttaatgcttttcagagatgggcgtaaggattagaattgttagagagtatatgtaagaagcaggagttttttctggaggaggagatttaaacttagacaacaccatgaatgctggctggtgaggctggcgagaaatggaatgtttgtgtctctcaggacatgaaagcgagacggaaggagaacctcattcagttttactggaaacccacagcaaagtttctccaagtagaggccggtgtgatgagaactgctaaatcatgagctgcgaggctggctcaaacaagaggcttatgagccccatgcctgtgtcctttcctacggttttccttcttatgacaagcagcactttttgacagcacaacactaaacactaacacaaaatacagtgaaaagggataaaaagaatggcctgattccactagagatgccagacaaatgagaatcaataacaaaaccagagtaccaaactgagaataaatagccagagacctccacgcagagtgaggtgagccctagtgctgaccacatcggcgcacctgataggccgagaacatggaggcatgaggggcctctgggtggcacaatgggtggaagcctggggacctcagggacaagcagtacagacttaccatgggatcaccaggaaaactgtggaaaccagcaaaggctatttattcacaacttgctatagcaggggaatcagccagcatcacttacttttggtagaaatttaaaaggcccgaaagagatgggaaacttttattgttttgttttgtttaagtatcagattggaaattattggcaggaaatgtttttaattacatttttctgatattaaacccaacacagttgtactttaatattttccctaggagaactacttattttacaactatatcccagtgtatcacccatgatcagccacataatttgaatcatgcattatcttctctccacattcaaattacatacatttagtatttggctacttaaaaaaaaatcattaaaaagtaacaatttaaatccattgatgggagaacctcagttagtttcaaaacaacaattcttgccaggcggggtgactcacgcctgtaatgccagcactttgggaggccgaagctggaagatcgcttgagcccaggagttcaaggccagcctaggcaacagagggaggccccatctctaccaaaaaaaatattaacaattagccgggcatggtggcatgcacctgtggtcccagctactcgggaggctgaggcgagaggatcgctggagtcggaggtggggaggctgcagtgaaccgtgatcgctccactgcactccagcctgggcgacagagcgggaccctgtctcaaaaaatagatgaataaataaataaaaacaattataatggaagtttggataggaatttaaaacatgtggcaactaaccctgaccctgcggcttcagtctccccgccgctagctgagggccgtggccgctgcacagaggcttgtgaggattcgggggttcaggcagcgcccgccgcgcatctgccagacgtgcggccacagggtaggagcagtaagaaggatccagggaaaaaagtccacgaatgagaaaggaaacccagcgtttgtagggctaggagaacaaagaaagaaaatgctggcggcggagggcgaggctctgcggtgcgtggcagatgggaatttgctcggtggcggctcctctttctggagagcttcccagcgtcccctcccccgccagcccgcggtgacgcgcccggcacccaccacagccggctctcggcgccgtcgcgccttcgctcgcccgcttaggccgtgctcgcggtggcgtgggagacagagagcccagggaggaccctggaacatgcagtggtatggaagacgcctaagaaagggcttctctttccactcacgaaaatcagtgtgtgagctcgaagccatttcccagcgtgtccgcctcaactccctcattcaacagatgaggaattcctccagggaaatgcagtgatgcgctcacggctgccggcggcccagcgccaaggggcgctccacagccccgcggcccgaagccctcgactcggctgccacgcaggccccgcggccccgctcggactcccaggatcggcttccgagcgggacagcgctgcagtccacgagtccgggcaggggcgcctccaggccggagcggtttcctgcctcgggcactctgctgtctccacaaacggtttttggaggcacacacacggatactttaaacacgtcggtgatgaatcggtacccagctgccagtggcggagcttcctgggcggggccgcgggcgcgcggcggcttcatttcctcgcgcgcgccggaagtggcctctcaggcgcggcggcgcgcccgggggtgggtggctgaggcggcggcgggcccaaggcgtgaggcgccgcccgggtgtccccgcggcgcaggaggcggtggagcgcagagcgggcgagcgcggtgagtacctggcccggcctcgcccgccggtccgcgactcccgccggctccggcccgggcggtgcgggcgccggggctgcgggctcctgtgtggtcgggtggggtcgcctagcggaccggtcctgcggggggccctgtctctcagggatgagcctgccggagtcggcaccggttttagggaaagcgcggccagagacgattggttcgcttgtcagtgttgggttttgttttgtttcgttttgtttttacctattcatcaccatctctgctcctctcagtggataaactttttaatcagtggtgacctcgtcatcgcgttaaaatagttctgccctcagcccctctttatctgtagatggcagagcgagcgccggtaaagatgctctgtcgtggagggctcagtggggcggaggagatggggagcctctggcgttgtcggagaatgcaccttaaaaatgactctacccttgagcaacgcaggaagcacgacagtgatacttctgtttgtgatgatggtattggcggtatgatagtttgattatacatctgaagcttctcttcctgagtccttggcttgttaaacttggaggtattttctagcgtgcttttgagatagatatgggatgtcgtgacgtttcaccgtcattcaaggctcgcgggagcagggccttcatgtctggtaattaatgttgttttttgaatgttgtattaaaatagtagcttcgatcttggaagtaagaagccaagtattttaggactgagtgttagcgttcattttgtattattgttcttgtaccatttgtttaaagttgtcatgtaactaaaagaatgaaaaaagatggatttccagtatttgtggctcagaggattttggcctaaataaacacagttccaaccagtttagaagctgcatttttctctttgtttttgtcgaggcataaaatacatatgaaatcaataagagcacgaatcttaattgtacagctcaatgaatttttacatacttattaccctgtggaaccaccagatatatcaaattataaccatagaacatttccatcatcctattttcctgtgcttcttccaagtcagttatatccttgttttcccatctgtattctaacttctcttatctgcttttagttttctctgttttgagcttcatgttaatggaatcacgtagtattctcagcatattgtttgtgggacacacccatgctatttcatggtattgtattattactgtgtaatagtctattgaataatatgtgactactcttcagttgatggacatttatgttcccaatttttgtatatgatgtgttttggatattaagaatactgtgggcctggcgtggtggctcaggccttttatcccagcgcttggggaggccgaggcaggtggatcacttggtcaggagttcgagaccagcctggcaaacatggtgaaaccgcatctctactaaaaatacaaaaattagccaggcgtggtggcgggcgcctgtaagcccagctacttgggaggctgaggcgggaggtggaggttgcagtgagccgagatcgtgccactgcactccagcctggacgacagagcctgactcggtctcaaaaagaaaagaaaaaaaaaagagtactgtggacattcttgtaaattaaatgtcttggtgagcatctgtatgcatttctgtcagctatagaatgactgagtcatggcataagcagaaaattaccaacatggagtcattaccaaccataccattaccaaccaaaggcagaaaatttaaccaacatggagtcatcttttttttaatgtaatagaatttgttattttaactaatataacattcaaggttggttttaaaaaagcataactattatgagttcaagacgtaagtgattcattcattaccatgttattatttaccctttgaattgcacatttatgactgtcttctgtcggactgtcattgtttgtttaactgttagacaagtctgttagagctggtgaggatctgactctgaagtttagcataacatttacttaagaactgtattactcaagttagtggttttttagaggaaatgaaataccaaaaggatatgactgaaagtggattgaagaatcacgggactgcaagtcaaagaacttacattgttattgtcatgctacacaagcactaggtataagtgtaaaattgaattatagggctagttacaaatgtgaattcacagcaggagtacagtgattttcatatggactgagatactactagcacatttataatgtgaacacacaacaaaaatcactaaacatttgtgggaaatcggtagcatctaagagaagcttcagaccaaacaaatacagaactaggcactgaagcagtggagctaatgtaagacaaaagaaagctttaaagtaagtattagtatcttcaaatttgttaaggtattatgcctactgaacacatacaggctgccatgaaaaaaagcaattgattcttgaatatttaaacatggaaagtaggaaagggccaggtgtggtggctcatgcctgtaattccaacactttggaaggccgaggcaggaggatctctggattccaggagtttgagagcagcctaggcaacataatgagaccctgtctctacaaataattttttttttttttgagacggagtctggctctgttgcccaggctggagtgcagtggcgccatctcggcttactgcgagctccacctcccaggttcacgccattctcctgcctcagcctcccgagtagctgggactacaggcgcccgccaccatgcccggctaatttttgtatttttagtagagacgggtttcaccatgttagccaggatagtcttgatctcctgacctcatgatccacctgcctcagcctcccaaagtgttgggattacaggcgtgagccaccgcacctggccacaaatcatttttaaaattagcagtatggtagtgcacacctgtcgtcccagctgttcaggcagtggaggctgccactgcacttcagcctggctgacagtgaaactgtctcaaaaaaaaaaaaaaaaaaaaaaaaaaagaaagtgggaaagactacccatgacatgcaaagtagatctagaagagtcaatatacatctaataggagttccaggaggcattagaaataggaaaagaagaaataaccacagagataacagagatcgcgaaggtaggagtgtccaggcacagtcttgggcatcctgagccagggagaaataagtatcagaggacaaaggactggcaaatatagatcaacccttccctctctggtctgtttctttgtctgtacagtggggacgaacaagaagtatgccttttctgagagcttatggaaagatgtgttaggtttgctgactgttccccactcttcttccctaccagctcacagaagggattggggttgtgtgcccttatatgttgtttaacctttttatcacatgtatttattttgtgaaatttttaaagtgtaaaaattttttagaagttaaagcaggggttgccagtatggctggctgcctgttttagtatagcctgtgatctaagactggcttttacactttttattttttttattttgtatttatttatttgtttatttatttatttatttatttttgagacagagtctcactctgttgcccaggctggagtgcagtggcgtgatcttggctcactgcaacctctgtttcctgggttcaagtgattctcctgcctcggcttcctgagtagctgggattacaggtgcatgccaccatgcccggctaatttttagtagagacggggtttcaccgtgttcctcaggctggtcttgaactcctgacctcgtgatctgcctgcctcagcctcccaaagtgctgggattacacgcatgagccaccgtgcccagccctatactttctaatgctttggggagaaaaagaaaataatgcttcatgacccatgaaaattatatgaagttcaaatttcagtgtcccttggaacacaactatactcattcacttacatatcatctgtgactgcttttgtgctgcaaaggcagaatcaactggttgtgacatttactgtctgacctaaaatatttgctgattcctggtttagaggtcagaaatggacttatgcatatataggaattttgctaatgataaagatggcatttcaaactagtgacaagagcatggattgcatggtaaatggcaagaattagctatctatttgagggaaaaattacttttattaggattacttcaggtagggaagctaaaatcaagaaataggaaaagattgatagatttgagtctattaccaccaccaccaccaccaacaaaactttgcttaataggaaataatatctaacagttactgagcacttatgcttgtcatgttttacttgaataagtgttataattatactctaaggtaggttctgtaattattcccacttaacagaggaggaaactgaagtttacatatattatggaatttgtctgtaatgaagagtagaaaaccatgatgcagatctttgaattcaggccatctggctcccaagcctattgtggacaagacaaactgagaaaaaatatttgcaacatggtaacaccattttgtaggtactatctacatcagcacataaagatgtacctaattcctttaaaatattctgttgtataaatgtcttcagttaatttaacctttcctctattgatgaacattaagttgcttataattttattttgctgttacgtgtaacactgataaacatcctatgtatgtgactttatatagtagtatggatacttctgtagtatagaatcaggaaagtggaattgtgaattgctggattaaacggcctgtgcatttaaatcaagtttgctctccaaaaatgtgtgtgtgtgtgtgtgtgtgtgtgtgtgtgtgtgtgtgtgtggaatcataataaaggaatcataatatcttggaaggaacattgactgttcaggcaaaactgcctcatttttgagaggaggccctgagaggtgaagtgttatgcccaagattacatagctattaagtagctgttacacttgactctttaactggtttttgctgtgccacagtttggcacatttttctcctttgtcttgctgaaatccaggtaccatgattatagttttctccagaaacacgctgttaaaaggatccatttgatattacttgtccttggtactcagcacagtgcctgacacacagtaggtaatcaagtatttgttgaaaaagtgctgctttcagatgatcagtacttacagaccacttattcaataacatgttgacaacccatgcatcactgtaatacttatcaagtaatcaagaacttatcaagaaatgaaacattctgatctcctccttcctagatatttacacttcataatgctttagttttctgactggttatgttttccaaataattgtgtggctttgtttttgctttgtaaaaaatgaactcaaaattataaatttagtttttgaaaaccttaatgagaaattgttctgtgcagaaaatttaggaagattatacagaatatgttttataatacactcaaatggattatatctttcagagggcagtagattagtcttccaagttagcttgacatactgcatgcaatgtacatgtcctggaaatgatgcataacatttgtgttcatagtaccaaaaattgtgtataatcaagattgagtaaaaactccttaagggtcttattattatgtaagggaccagtgctgtagcattaactatctttaacacttctgttgtctccaagtcacaaggcaaggagaaaagatatggtaagacctttaaaggaatatgtaaatatgtagtactctatttttggggagatgaggggcttagttttgttttttaaatgcaaattcataatcaacaaatctttatacttcagtaaacaaactggaggggtttttttttgttgttgttttacaaatgcctttttggcactgctactgaatctgacttggctttattttttaaacagcttcattgaggtataattgacataaaataaaccacatatttaaagtgtgcaatttgataagttttaacatatgtatacacctgtgaaatcatcactgcaaccaaagtaatgagcaaatccattactcccaaaagttttttcacccctttttataattccttcctggtaccacctcccacaggcaatcattgactgatttactttcagttaactacaaattaccttgcattttctaaaattttatataaatagaatcatatagtaagtacttctgttgcctggctcctattactcagagtaattgttgatatttatccatggtgaagcatgtgtcagagtttattcctttttattgctaagcagtgttccattgtgtatctgttttactacagtttgtccattcacctgttggtggaccctgggttgtttctggttttgggctctacacctagaagctgctatgaacatttgtgtacaagttttggtattgttaaagtataaactgaggcagaataaaattttaaagagttttgtctgagcaaacagcaattcatgaatcagacagcaacaaatcaaaagtgatttgggactccaccaaaggaatgcaagtggaagacttctataggatgaacaaggaaacaaggcaaagaaaatatttgattaattatatttatatagttgccttgtttagtccatcctattggaaagtccctagttatgtaagttagttgatggcttctaattggcgtagcctaagtttgtttgtttcttttttttttttttttttttttttaagagacagggctagagtgctttggtgcgatcgtagctcactgcagctttgaactcctgggctcaagtgatcctcccacctcagcctctcaagtaaccagggcaacatgaactacagacatgcatcgccacgcctggctaattttttaatttcttatagaggcaaggtctcgctagctatattgcccaggctgatctcaaattctggcctcaagtgatcctcctgcttcaacctcccaaggtgcttacaggcatgagccaccatgcccagcctgatttttctttaatataggcacagacaaaaaataaccaaagtttacatttgcaaacagcccaaattaagttttgcttctattgcttatatttgcaaggtcaaggttgttttaatggcttaactggctttgtccaggggatttacagacctggtctccatcttattttaatagtatgaatatgtgctttcatttcttttaggtaaatatctaggaatggaatggctggatcatatgagtaggcttactcacttattaagaaacttggcctggactacatagcaagactctctctctaaaaaaagatttttttttaattagccaagtgtattagtctgggttctctagagggacagaactaagaggatatatgtatatatgaaagggagtttattaaggagaattgactcacaccatcacaaggtgaagtcccatgataggtcatcagcaagttgaggagcaaggaagccagtggtggatcagtacgagtcccaaaagtagggaagctaacagtgcagccttcagtctgtgcagccaaaggcccaagagcccctggaaaaccactggtgtaagtccaagagtccaaaagctaaagaacttggagtctgatgttctaggtcaggaagcatccagcatgggagaaagatgaagtccataagactcagcaagtcagcccttccatcttctcctgcctgctttattctacccccgctggcagctgagtagatggtgcccaaccagattgagtgtgggtctacccctcccagtccactgactcaaatgttaatttcctttggcaacaccctcacagacacacccatgaacaatactttgtatccttcagttcagtcaagttgacactcaatattagccatcccaccaggtgtagtggctcccacttgtagccccagatactcgggaagctgaggcaggaggatcacttgagcccaggagttaggctacattgagctataatatgatagaggcactgcgctacagctctggtaacagagcaagatgctgtcttttttttttttttaataagaaaataatctaacttgttaagttcataacttattaacaaaactattttatattcccatcagcagtgtatgaaagttctagtccttccacgttaacaacacttggtatggtcattctttttaatgttagccattctatttttagcccttctgtgtagtggtgtcttattatggtttgatttgcatttccctaatgactaacaatgttgagcatcttttttttttttttttttttttttttgtggagacgggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagcatctttttcaagtgtttatttgaagggttcaggccttttcccacattttaattgagttgtgtttgttattatttcattttgatcattttaaaatatattcttggtacaagtcctttataagacgcatgctttgcccatattttctccaggtccatcacttgtcttctcattctcttaacaatgtctttgaaagagcacagattgctaattttgatgaaattcaatttatcatttatgctattgaatatcatatctaagaaatctttgcctaactcagagtgacaaagattttatcctatgcttgcttttggtttttttccatttaggtctatgattcaccttgaattacatgctagtggatgtggagtggtatctaattgtgcttttgatttgcatttcctttttggctaatggtgttgagcatcttttcatgtatttatataggccatttatatatcttctttagagaaatgtctgttcagatcttttgcttgtcgagttatctttttttttttttttttttgctttttaaagtaagacagacaaatgatttacaaatgttctctaattgtatgggttatttcttcactttcttgttgatgtcctttgcaacacaagtttttttattttgatgaggtccagttaatatttgttttgtctttggtgtcatatctaagaagctgttgcctgatccaaggtcacaaatatttacacataggttttgttctaagagttttctagttttgactcttatattcagatatttgacccattttgagataatttttgaatgtggtgtgaagtaggagtctagtttcattcttttgcctgtaaatatccagttgtcccagtactatttattgaaaaaactattctttctcccattgaactgccttgctattcttgttgaaaatcaactaaccataaatgtgatgatttatttttgggctttaagttccattccattgactatatgtctatttctatgccataccacattgtcttaattacctggggctctgtagtaatttttggaattgggaagtgttttccttcaatttcatttttcttgttcaatattatttgggttattctgggtttcttgaatttgtataaattttaagatcagcttgccaatttctgcaagaagtccactgggattcttgaagaggattgtgtttaatctgtacattaattggggaatattaccattttagcaatattaagccttccaatcatgagtgtggtgtctttctgtttatttaaatcttaactttcttccaacaatgttttgtagtttctatgaatacaagtcttgcagttcttttgttaacattattcctattttattctttttgatgccatattgtatacaggattgtttttttaatttcattttcagattgcttgttgctaatgtagagaaatacaattgatttttgtatatcgatattgtatcctacaactggctgaactcatttattagttataatagatttttagtgaattccttaggattttctgcatacagatcatatcatctgcaaataaggatagttttacttcttccttttcaatctggatgccttttatttcattttcttgcctaattgccttggctacaacctcctctagtacaatataaatagaagtgacaagaacagacatccttgtcttattcctgatcttgggggaaggcatacagtctttcatcattaaatacaatgttagctatgggttttttgtaggtcccttttcttagattaggaaggtgtcttctagtttattgaatggtgtttggtttggtttggtttggttttttgagatggagtctcgctttgtcgcccaggctgcagtgcagtggcgtgatctcggctcactgcaacctccgcctcccaggtccatgtgattctcctaactcagcctcctgagtagctgggactgcaggtgcatgccaccaccacacccggctaattttttgtatttttagtagaggcggggtttcattgtgctagccaggatggtctctatctcctgacctcgtgggatctgcccacctcggccttccaaagtgctggaattacaggtgtgagccaccgcacccagcccctattgaatggtttttattaggaaatggtgttggattttgtcaaatgctttttccatgtctgttgagatgatcaagtgaattttgtcttctattgatatggtatattgcattaattgattttcagatgttaaaccaaccttgcagtcctgggataaatcttatttggccatgatgtatgattcctcttatatattgctgggttcgttttgctagtattttgttgaggatttttgtatttatattcatataggatattggcctatggttttcttttaatgtctggatttggtagcaggatgatactgaccttatagaatgcttcctcttctattttttggaagagtctgtgaagataattcttatttaataataataattcttatttaaatgtttgctaggctgggtgtggtggctcacgcctgtgatcccagcacttttcgaggctgaggcgggtggatcacctgaggtcgagagttcaagaccagcctgaccaacatggagaaaccccatctctactaaaaatacagaattagccaggcgtggtggtgcatgcctgtaatcctagctactcggcaggctgaggcaggagaatcccttgaacgtgggaggcggaggttgcggtgagctgagatcgcgccattgcactccagcctgggcaacaagagcgaaactctgtctcaaaaaaaataatagtaataataaataaatgtttggtacattccaccagtgaagcctcttggcctggacttttcattgtgagtagtttttttattattattaattcaatcttttgtcatataagtctattcatatctggtatttcttcttaaatcagttttgttagtttctatctttctaggattttgtccattttattcagttatcttttgaagagatttagataataatgagcaaaaatcttagttaccaatgtcgttaacattaatgatgtttttcattgctttgtataaatccatattcctttctggtattatgttcctctgcctaaaagacttacagtacaggtatgatggtgatgaattcctttagctttttatgtagagaaagtattttgcctttttcaaagataatttctctgggtatagaattgtaggctggcatatttttctttttagttctttaaagatcattgttccactgtctaattactttcagttttcaaagagtaatctgtcattattatcttttgttccttgtatgtgatgtgcatttttcatgtggccagtttaaagattttctctttacattggatttgagcaatttgattatcatgtaccttgctataattttctttatggctatttgggattggttgagcttcttatgtgtgtttatagtttccatcaaatttgggaaattttcagccttatttgtttaagtatttctcctgactccttcccccttctttggggactccagttacatgtatattaggctgtttgaagttgtcacagagcttatcaatgctttgtttatatttttgattcttttttctttctgtatgttgcatagtttcttttgctacatctctagtttactaatattttcttctaaaatatctaatctgccattaatcccattcagtgtatttttcatctcagacactgaaattttcatctcctgaagtttaacttggatctcttttatgtcattcatacctctacttaaatttttgaacataaacatcattttaaaaatacagttatgatagctgttttggtgtcctttttctgcagattcccacatctgtcagttctaatcattggtcagttttaattgttgatttttttcattatggatcatatttttttatacctggtaatttttgttgagatgccagatattgtgaattttattttgttgagtactggatatttctgtattcttataaatattcttaaggcttgttgtgctattacttggaaataatgtgatcctttcaagtcttgcttttaagatgtattggcaggattagtgccatgtttagtctagagctaattatttcccactactgagacaagatttttttgagtgctctaccgagtgccctgggaattctgaggttttccagtctgtctgttgggaacatgcactaatcctggccctgtatgaatgctgggttctgtgtcctctaattttgtgtgtggtcctttccttagcccgttagttgcctcataagcctttacttatcagtgctctgccaaatacccatgggatatcctattcagatttctggagttctctctgtgtgcagctgtatccactctggtactatatgctttaatcctagataccttggtctcttcagactatgagctgcatcccatgaactcagggaatctgctgggctctgcttaggttcccctccttgtgtggctcagaaactaaggcagtaagctggcaaccacttgtttcttgtttctctggggatcactgtcctttgttacctgatgttaaatatcttgaaaatcattgtttcatattttgggtttgttggcaggaaaagttgtttgtttgtttttggttgtttcaagacaaccaaagagagcaaatctgagagtaaatctggcccgttacttcatcttggtcgtaaaaggaagtcagttttttaagcagttttagagagttagaattgatggcttgtaaggtttctttcaatcctgagatctttggcttcatattacatacctttaacagcttattttcccatcttcacattatccttttctctcctcaaaacacttaactatctgcatttgtgcttagaaggcttgttgggattaactctgggctgtgaatgaaccgtattcatgatacaaacacatttcatagaatgatgacaatcaagatgtaacaacagaaaaatgttttctataatattcttaatatatttatatgatagaacagctataatgtaatcttctagattatggccaaagagtttctttcgggaactaggcaaataagattttaattgaaatctttcatttttaataaccacagaattatgcaacttttacattctgaagtaattacagtatcctttcattttattggaaaatattcaactgtaatattaagtaggatatctcaaaacctgtatttcccttaaagggaagaggaagaaaaatgaccttagctttttaacactgccactgataatttccattctattttattgaaaagtaaaccttcagtagtgacctattgtctgagttatagctcatagtctaaaatacattgtgtatataaagaaaacatatgaggtaccatattaataaaagatagtggtagttctgttacccagtttcacttcagttttgagtataacatgcttaagtatgtatatctttattaattaaagtatgtatatctttattatacaagattatgtctccacattttcagttctttttcctaataaatgggctagtaatagttaaaacagataccgctaggtttatcttttaaataatgaaattcaagtgttttcttatgctagggattatggttttgaggtatggttaagtcctggaaataatactagttattttttgattagatggtatttcttaaagccaactattttttttctgtttttttctacatcactcaaacaagatttataatcagtaagagagatgctgtaatagtaaaagactcccttggccaggcgcggtggctaatcccagcactttgggaggccgaggcgggcggatcacgaggtcaggagatgagaccacgatgaaaccccgtctctactaaaaatacaaaaattagccgggcgtggtggccggcgcttgtagtcccagctactcgggaggctgaggcaggagaatagcgcgaacccaggaggcggagcttgcagcgagccaagatcgcgccactgcactgcagcctgggcgacagagcaagactctgtctcaaaaaaaaaaggactcccttgtagtgagttaaatttttcaagatacttggttatcatttcgtttactaaaataataaatgactaaggagagttaagaccattatttgtggtatattggccataagaagttttcttctgtcctatgttttatacagacatgttaccaaaaaaaaaaaaatacgcattgcagcatttgccacagaaagcatccaggtttttctactcattaaaaaagtggctaggactgataacctgtagtgatcttccaggttttgctgcagtgagaaaaccattactgttaaaaacctgctgtcatatcacattatccttctcaacaagcactttgttacaatggaagttctctttgcagtggagtcctccttgcctcccttgtcctaagttaaacctctatttttagagttaagaatcattaaagacatggaagagttcgcacaactggttgtggcatgaacgatagcatgtaattttataaatgtataaatggtttttgaatttttttctctgctgataaggatgattaaattcttcatgttttttctttatatagactccaaacctttctagacttgtaggaaatctgttgatgcataatacagtggaaagaattatgtgatctaatgtgcaaataatctactggaggacattggatataaaaatgttttcttaatgtgtttttcagatgtctgtgagcttttgaagttgttctttcccccacttaattttaagtctcctagattggctgagctgagcagtagaaattaatgaggtagaatgcttgagttgaataaactgggagaaaatctctctctccagtaaaccgttattactgtaacagaaacagtttctataaactcagttcccaaatggtcataagctttagttgggaaatggtgcggtaattgaaatactatgttaataaagagttataggcaatataattttcaaataattagagaacagtagaatatatgtaatacagactatgctgacgtaattttaatgtttctttgattcaagttatagctgtgtagacataatagttaaaagtattatacatagtttattgttttttaaggtattttaaaaaattctcccaggccaggctcagtggctcacacctgtaatcccagcactttgggaggccaagacaggcagatcacctgaggtcaggaccagcctggctaacatggtgaaaccttgtctctactaaaaatacaaaaattagctgggagtggtaggcagatgcctgtagtcccagctactcaggaagctgagatggaaggatcacttgaacccaggaggcagaggttgcagtaagccaagattgtgccactgcattccagcctgggtgacggagtgagactccatctcaaaaaaaaaaaaaaattctcctagtatttactgaatattctaaattatattagtacctctcatagttctctgcatgtagtagtcacgtagctaagtttactgaagccacaaacaaatttgatatccttaagggaacaaaattctgattgattctgatctgtgtctttcagaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagaccagggcaaccagtctgaaacgccaaattgcccaactaaaacaagaattacaagaaatgagtgagaagatgcggtcactgcaagaaagaaggaatgtaggggctaatggcataggctatcagagcaacaaagagcaagcacctagtgatcttttagagtttcttcattcccaaattgacaaagctgaagttagcataggggccaaactacccagtgagtatggggtcattccctttgaaagttttaccttaatgaaagtatttcaattggaaatgggtctcactcgccatcctgaagaaaagccagttagaaaagacaaacgagatgaattggtggaagttattgaagcgggcttggaggtcattaataatcctgatgaagatgatgaacaagaagatgaggagggtccccttggagagaaactgatatttaatgaaaatgacttcgtagaaggtaatgtgaaaaatatgttggtcaatattatgttagtaagacaaatgctagtattgtatgctggtattgtattgtagtattgtactgtagacaaatgctagtattgtattgtagacaaatgttagtaatataagtcagtcattatccacagtattaaaacactgaaagtttttgcacttcattgcaccaagaattttaagtggccttctggaaaaaggtatgagatcataataaaaatggagaataaggactagggaaatagaataaaacagctcttgttgcatgtgtatgatttatattcctcacttacctgatcttggtgttcttttttatgtttttaaaaaatgtgtaaactaaaactcaaaacttgaaaaccatttgataaaggaaagaaaaaattagtagactcttagctatttttcgtattggaggaaggagaagctcatgtctgaacaaggggttatacatagtttaaaaagcacatttggcatttggaaaagtaaggaaatacctgttttcctaatacatatttcagaaagggtatggaatttttatgtatcaagatgggatgtgactcagaggttgaagaacactgctataaaatttaagatattgattgatattaacagtaataattctagatccctacccatctcctttacactcactgctagacatttaattgctgacttaaaccattttaaaaataaatgtttcttgaaagttctctttgcttgattctataaactgtgttatcacagtggtccccagcctttttggcaccagggactggtttcatgggtgacaatttttccatgggatggtgaggatggttttgggatgaaactgttccacctcagatcatctggcattagttagattctcataaagagcgtgcagtgtagattccttgcatgtgcagttcacaacagagtttgctctactttgagaatccagtgcagccactgatccgacaggaggcggagctcagacggtaatgcttgccaggctcccatcactcacctcttgctgtgccgcctagttcccaacaaacaggccacggaccagtagcggtctgtggcctgggggttagggacccctcgtatagcacatgtagactttttgactccaaatcatcatggccatcacttgctgcactgtagcattattataatacactgaggcccttggaggccatcagggagggcattatgctttgcagtggcattgcagctgcctttccttgtggcctcctcttttttctgctgtcacttcctgccatttttgatggattatttttctcaaaactcttctgatttttctgcaagctcagctttttgtcttctcactgtatgtttgtagcttatggcagaattggaagctgcggaggaaataagataactaagtaacatgtgtaaaatgtcctcacatcagctctacctaaaaagaaagggagctgtgccagttttatattctgcagctcctgcttttgtcttataactctccttggattctgatacttcaggatttttctctaaatggaacatattctgttcctcacttttcctctactgtgccactgtctgcccactgcagggagaataattactaataattagtaatgacaactaattcctatccctcttctaaactttagctcagatatcacttcttctgagaagtcatctgcaacctcaggtctaagacagcagtacttctgtgtgctcttgtcacctgtacattcatactgcttgtcacagtatgtggcattgcccatttcctggtttgtgcttcctactaaagtgtaagcctcaggagggttgggaccaagtctattttattcaccattttatacccagatatttactgagtgactcacacatctgtaggtctaaccttcttctctctcctgagcgccatacttaaaaatcagattgccactgggcgcagtggctcactcctgtaatcccagcactttgggaggccgaggtgggcagattatgaggtcaagagatcaagaccatcctggccaacatagtgaaaccccgtctctactaaaaatacaaaaattagctgggcgtggtgacacacgcctgtagtcccagctacttgggaggctgaggcagaagaattgcttgaacccgggagatggaggttgcagtgagccaagattgcaccactgcactccagcctggtgacagagtgagactccgtctaaaaaaaaaaaaaaaaaaaaaaatcagattgcctcgtagatgcgcatgcttttctctcaaaggcatctcaaatcactgtgtttaaatctgtaccaatttttctttgacttcactctagtcagtgattttatatgtatgtatgtatacacacatatatatatacagatatatatatatatcacatagcactatattgttattatttgtctatttttctgtctccttcactagactggccctgtcctcaaaattgagaccatgtggcactctttgtatcacataactgacacgaaggcactcgatttcttttagttgacctaaaccaatagaaattttggctcttgggtctagattttaatattgctagaagtaatttctttatttatcatgattaccatattgataggctctagtatttttaaaaagtcgtatgtaaaaaggaacaattgtcatttgtagtatattttatagattgaataaaataacagaacagtgaactttttttttaaccttttcttttaagcgagtaattgttactgtgcagtggggataagtattttcacaaataggtaaaaatcctgcaggtctagtttaataccctttatgtttaagtgagtaaaatctgtcttcccattgaatttgtaaactttgacatggagacgtctttgttcctaactctttcctttaggttattatcgcactgagagagataagggcacacagtatgaactcttttttaagaaagcagaccttacggaatatagacatgtgaccctcttccgcccttttggacctctcatgaaagtgaagagtgagatgattgacatcactagatcaattattaatatcattgtgccacttgctgaaagaactgaagcatttgtacaatttatgcagaacttcaggtaactgtcagggcttaatgattaagctacattctcctaaaaaaaatcacgttttactcagatttccttaatttatcttcaccgattataattacttagaataattttacaggctttaggggaactttatttttttatattctctctttttttaaagcatgtgtagtatattgtgttatagacaatttgaactatgaaataaattaagagtgacacctattagaaactaaatttgatggccttgataattgttttgaattcattttaagacaagttgaatttttaaaaaatcaactttactaaggaataatttacatgcagtaaaatccacatattttaaggatataggtatcatgactctttttttatttttatttttttttttgagacagggtctcactctatcacccaggctagaatgcagtggagtgagcacagttcactgcagcctcaacctcctgggctcaagtgatcctcctgcctcaacctcccaagtagctgggaccacaggtgcatgccatcttttttattctttgtagagagaaggtcttgccatgttgtccaggctggaatttaatgtcttttgacaaacgtatacactcacgaaccaccaccccaattaagatacagaatacttgtgtctcacaagaaaatccccttgagaatgatttgagttttttaattgaaatacatttagacatacaaacattaaactaaaaattggagaaagttatttcagcttgcaaagcagagaatttgtaaagtttttttatgttatcaaatttgtatattttaaaatgctgaagtgttaaataattatctacacattatgaaaactatttgtggaaaatgctttttgatttaacagtttccatgtttctaatactttaatatttttaatgttttagatactttgatatactggtttaatgctttgtgatcctagtctttattctcatattgaaattgttggatttaaaaggttaattaaaactggtctgcagctgaatgtctggcagtcatacttccaagtgagatttactgttccaaatagctcacttgagatccgatttcctaaagcatttttttattgcctttcttggaattactttcaaaggccacattattatttacagtaagtaatctcagtcatggcaaatatttattccttaatgatagttacaatttttggaattagccagtctgaagacaaaataactcttaatccaaaaggtcagtatttatttatgtggttctgaaccagttgagtttatttccttgaatagcttgtgatttgcttctgaaagcaatccaaaagcaaaagttcaaaaaatgttttgaaataatggcagcaatgtcagactgcttccatggccctccaaggggtgcactcattcaggcatagaccttgtgccttccataattcatcagtattgccacatttatgtttactactgtgtcagtaatgcctcattttcttgttaaagcttcatgtggttgctttcttaatgaatagtgcctcatgttttcttgaataaacttttatttttcacttctgttagggatgtttgtattcatcaagacaagaagattcatctcacagtggtgtattttggtaaagaaggactgtctaaagtcaagtctatcctagaatctgtcaccaggttggtgaaccacatctgcagtgaaggccttgatatataacattgctaaaagagaatttcagatatgtaatgagttaataatttttagtaactattatttaaaaattggctgagcatgtgggcggtggtggtgatgataagttcctcatttcacatgcaaccctacatgactcaacttcccttcactgcttagcaagcagcctggcatgatgctttctctgtggcccactcaccttctgtgtatttgctgctgctttcctttttttaaaatctaattccttcactttgacataatcatcttctgaatttgtctcttttttgtcacctttctttccttccatttcctcaggctccttcttctccccctgctaacaatgttgaggtctcccatatccttaagaaactcccactcaactctgaagtgcccagccactactgttatgtttctgtcctttcacagctcaacatcacgagacagtagttcatagctaagcaagtcatatagtacctggcacatagtagatgctcagaggtttgaatggatgaattagtaatcccttagtacttaattattaattctttagcctctcagcctttttctttctaaatcatgggcccaaagataacgacttaactgccaaattcttttctgttattctttttcattgcttttttacctttgacaacctaaccagtatttctgtcttaaaatgttcttcttgtgtttgtaaaatgtaactattttgtaaatgtaagtatgatgtaatgtaaactattaggttgattatcatctctaaccacaccagctctatatcctttacttgcttctttacctttctgccagttgtggccatttgccaagagcccagatttgatcagccattcttctcaaatcattcaactcacattcattgagtcctgcctactgtgttccaggtacactgcttgggagtttgactggggtagttggaagaagagtgggcgtagatgagtgaatctgagtccctgacctgcagggattctcagagccttgatgtatatagacacaattcactgtcttccccttccctacaccagctcctcctcctgatggccctctttcagttcagagtaaaaccattttcaccatctgggcatgacttctgagagccacagtcttttacttattctttgcctccagttacctctaattagttagttcctacttaattcacaggacctcttctctatctcttccttgctactgccaccaccctaaccctggttccccctccctccatttcttcccttcctgtccctccttagtgtttttagatcacctactaagtgccacaagctcacactggtaatactgaagtattgtcaagacacttctgtggcaaatggtgtaaacctaccttgagcttgcttgaggaaaataggagcagtattgaagaatctcggatacctcccagaaataaagggattgttacaaccaaatttggggaagaaaatcaaaacaactcttgtttctcagggattggaaccagagacttgaataccatcaaaattctcgtctccttgtctgtttttctctgcatgttgacttcattctcctgttgcagattggcttcttccacatggtgagggatatgactgttggcggctctgggctcacatcttctcagctttgccatcagagaggaaagagctttctcccagctccagttgagaaaatcccagggaaggacattttgcccactcttgagccaatcactatggccaggttgggtgggggtattgggactggcccagcttaagcctggtctccacccctaggaaattactgtggttggggtgggcagagagtgaggggtattctgtgatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtgcgtaaaatgttggtagatgagctgactatagaatttagaacgttgtcagcatgtcctatagtttgaatcaagtgattttgagggagaagttttagttaaaccccagtatttttttaagttatattaggcataatttaactggaatactaaataggaaattgaaaatttgaccctttgaaattcatatcctttgttctcttgggtccaacttccagtgactacatttgaagccaaatatggaaatgcagaggaacagggtatctacaaattgatgaggtgggagcagtgcaggtcagaaaaagagctaagcagatggtatggagatgtgtgtgagagtctgaagcactcagctttgggcatatagcgtccacacatgcaaaaatacccccatgcatgtgtgcacacacactcacatggaagtctagatgcagatagtgcttggtctccagactgtgcattttgggatgatttactatactttgctttaagttgtagatattttttgaaaattaatgagatagccaggtgcaggggctcacgcctataatctcagtacttcgggaggcttaggcgggtggatcatgaggtcaagagattgagaccatcctggccaacatggtgaaatcccgtctctactaaaaatacaaaaattagctgggcatggtggcgtacgcctgtagtcctagctactcgggtggctgaggcagaagaattgcttgaacctgggaggcaaaggttgcagtaagccaagatcatgccactgcactccagcctggtgacagagtgagactccatctcaaaaaaaaaaaaaaaaattaatgagaagatgacattttttgaaatcaaattttaaatgctttttagttcatttaaaagaattaaaagtattaaagaggctgggggtggtggctcatgcctgtaatcccagcactttgggaggccgaggcgggcggatcacgaggtcaagagatggagaccatcctggctaacacagtgaaaccccgtctctactaaaaatacaaaaaaaattatccggtcgtggtggtgggtgcctgtagtcctagctcctcaggagactgaggcaggagaatggcgtgagcccaggaggcggagcttgcagtgagctgagattgcgccactgcactgcagcctgggcgacagggcgacattctgtctcaaaaaaaaaaagtattaaagaatctcaacaggatgagtaagttgaggaaatctgttatacaaacatggtgactatagttaataacaatgtattgtatacttacaaattgctaagccagtagtagcattaaaaaatgttcttaccaccaaaaaaaaaaaaggttaattatgtgaggtgatgatatatgtttattagcttgatttagtcatttcgtagtgtatgaatgtagcaaaacataatgttgtacaccatttttattagtcaattagaaaaacattggggtgggggggtgctgctgagcacagtagctcacaccttaatcccagcaccttgggagtctgagacaggaggagcacttgagtgcaggagttcaagaccagcctgggcaacatagtgagtcctagtctttaaaaataaaatttttggccaggcatggtggctgaatgctttttagctcatttaaaagaattaaaagtattaaagaggctgggcgtggtggttcatgcctgtaatcccagcactttgggaggccgaggcaggcggatcacctcagtcgggagttcgataccagcctggccaacatggtgaaaccccatctctactaaaaattagccaggcgtggtggcttgttcctgtaatcccagctacttgcgaggctgaggcagaagaattgcttgaacctgggagacggaggttgcaatgagctgagatcgccagcctgggtgacagagcaagactccgtcttaaaaaataaaaataaaaatgttttaaagaatctaatagcaaatggggtttttttaatgtagaactattcatatgcaaatgattgccttcttattaattaggttagagatagttttcaggaactctttgagaacctaatgaataaatgaaggttaggtttattttacagcatgaaatgcaaaatgtgaaagttgaaggagacgtatttgcttagtttaaaagaaatattttatatccagaaatagatttgcctctggaaaattgaactccccatccctaaatgtatttgaacaaaggtagaatgagcatctgctagggatcttgtaataaaaaggttgccatgttactcccacacttcctgacaatcactgaacacttcatgtgatcatatctgattgaagccagccatagcaagggttgcgtctcctgagggaagatgggctagttagcctttatggtccttttagatcagtcagtttgaatgctgatgacaaggtcttctccaagggctattatatcaagtaattttaacccttgtcttcccgacttttccagattttggttcagatttattctatattttcattattctctgcatatctattcattgtacagtattctttgaatttactctttctaatgattcatttttgacaggtggatttaacagacgtttctaagtttcatagtgattatcagaggttaatctacgtttattactactgattagatgaaacaatgagtaataaatgactcacgtaatgaatacacatctccccaaagtcaaagggaataaacgtgaagcaccctttagtttgttttttcctctgttcttttgcaaggttatagttaacctactgatatgttacaaaatcatcatattcatcaaattaacatgatgttctgtagcctgaatattaaaaaatagataaaatcatgtataataagactttgataaaacttaatagatattgcaataaagaacagttcttcataacttctttttatgttacaaacctatattttaatttgtaggtaagaaggtgttttaccctgtggtgttcagtctttacaatcctgccattgtttatgccaaccaggaagtgccaccacctgtggagcagcagctggtgagactttcacattttcagttatgaaagactctaaagatcttttctagatgtttgttgtgtaagtagaaaacaaagtttcaataaaaaactgtatttccatgagcaaagtgttaaagaaaaactatagttattgtaagcacatttccatagttcctctttatacccccaataagatgcttttcacatttattgcttcagaattaagtgtagggggagcagagtttaggtcataaaggaaaacctcatgtcccagaatgtggaaattgtacagtcatttctaccagcttatttttactaatactaaaaatttgattttaaaaaccctactaactagaaattaaatctactctgctaaataagagggaatagtatactctggtaaattacctggaaagtcatagaatataaatgccatatatcaaaacttacagttattgccaaagctaattttatgtaagttttttaaaatttttaaataaacattattttataataatttagatttagagaagttgcaaagatagtacaaagagttccatacttcacccagtttcctctaatgctaacatcttatgtaaccatggtacatttgtcaaagtgaagaaattaatattggtaagttactgctaagtacactaggattacaccagtttttctactaatgtcctttttctgtttcagaatcgagtcgagaataccaaattgcttttaacataatcttttattattaatactaagaaaaagtagaaatgattaagaagtcactttaagatgtttaaaaaaatgaaaaataacttcaaggaaagtaataaaggcagaagttaataaaacaaaaatagattgagaaatatagaagcttatgtttatgtacaaaaaatttaatcataaagtagacagatttcaggtaaaaaggaaaacattggaaattagaatatgaaaacattgagataaatcaattttatagggtaagttttctaaattataaataaatgaaagatttgagaatttataaaatatgaacacaggctaagttcatgttagtattttatgaataaaagaggtgcaagtgggccgggcatggtggctcacgcctgtaatcccagcactttgggaggtcaagacgggtggatcacaaggtcaggagttcgagaccagcatggccaatatggtgaaaccccgtctgtattaaaaataaaaaaattagccaggcgtggtggcacgagcctgtagtcccacctactcaggaggctgaggcaaaagaatcacttgaacctgggaggcggaggttgcaatgagccaatatcacgccactgcactccagcctgggtgacagagtgagactccatctcaaaaaaacaaaacaaaaaaaaggtggaagctctgaagaaattaagagccatttaaaaaacagttatcaaaaagttaccctgtaggtatataaatacaatgttttaatttataagcttttccagactctcaaagagcaggtaatattagcaccatatgatgtacttaacatattttatgaggccaccattatcttcatatcaacacttggcatagtacacacagacacacacacacacacacacacacacacacacacacgcctctaccttatctataggccagtattatgaatataaatacaaataggttcaaaatggcaaactgagcacccacgtctgccatatctgacggtgaattattctgaagaaaagggtacattagtactggaaaatgagagaaggtgttagcagccgtaagtcttgagaactttctgtaagacgatagcagttagcgtaagatttctggaggagagaacagactagaatgtgttcaagagaacagtgagtgaagatggggctgctttgcatcctctgagctcatagcagacagaatggagggagcctggaataaacatgcttctctaggtgtgctgagaagcaggcatcacagggattgaccctcagtctaaggcagtgcatgtggtccctggagctggagaggctggtcggggtggctagggagcccctagactacaaaagtgaactactgttagcgcattccccctgagaccctgttctaatctccttgactgtgactggagataggccattgtaatcaaagctaacagccatggacttctgaacaatacttgaaacaaaagtgagtagcaattaaccaagactaaccaaacatttgaggaaaaacaatactatgaaagaggcaccaagtgttaatacacagaaaaattaacacatgagtatatgaatacagatagaaagtaattttaaaatatatctttgaggagattagagaaaatgttaaattcataaaacaggatttgttgctttaaaaaatcagaacttggaaattgtgaaaatatttttaaaatcagtaaatggtctgaatagcagaatggttacagttgaatcaaatttgtaaactggaagacaacccaactggacacgtaaagttcacgagataacatgagagaaaaattaagacaaggaagatcaagccagaagctcccaaattattaataggagttcagaaaagagagaatattgagtggaggaaatggaagaaagtttccagagctaagcagaaacaaatcttctggtgtttggagaacaacagtaaaaggacaattctaatagcttccagagacactaaaaatagcaaaacccagtttgttcacaaaggagtgacaatcagattggcattcgtcttctttttgaaaacactggtgttagaaaacaataaagcaatactatgaaaattctgaagaaaagtaactttgattctagaattcatattcaacctactattttaggacaaaatagacatttttgagctttcaaggactcagaatttatttctcaacagacctttgtaatcgagtccagcaaaatgataaatgtatacattgagagaggaggacctgagagtaaatagtggtgaacaaccaaaaaaattaagtctaaacatttgttgatgtaatagtgtaaatagttatgttgacataataaaaaggcaattaataccaatttgggattaagatgtcagcgggttatgtacatggtatacttatgtgtattacctagctgtcagctgagagggcctagaaccagtgacaccctaacagtaacaagtacactcagcttccaaatcttagtttctaatactattctccaatcaaacgagccagaggtccacggagaaatggttgattccagggcaggggcaaaaaatatacaagaagaccctggagcatcttacagtgccagaaagtaagaaagcactcaataaaaagatagggggaatatgtcgaaggggcacaggagccaacagaaagagctcccagtgcccaagctggaacaacctgagcaatgaaataaataacttaaacctggattataacccaaagcatcaagtaaatagccatgagtctatactgatacaaatgagtgagtgaatgagcagataaatattgagtgactagactagataggaaagaaaagttaagtcttccttacagaattccaaataacttatgtagatactccctcttccagtaggtggaactaggggactcactttcaaagaacatagtatggaaagaaaaaacaaacttttcacgggagaaacccagcagacaccttaaccaagggataccatgtacccatgacatgacataatgagaaggacactttagctcacagtcctcttccaaaaacgtagataacttccccaggaaagtcacagggaaagctgcagcaagcccacattgaggagcattgtacaaaatacctgaccattcttcctcaaaactgtcagggtcaccaaaaacaagactgagaaaccatcatagccaagaggagactaaggagacatgacaaccaaatgcaatgtggtgccctggactaggtcctagaatagaaaaaaaagacagtaaagggaaagctggtgaaatccaaatgaaatctggagttgagttaaatagtaatatagcaatgatggttccttagttttgacaaatgtaccacaacaatgtaagatgataacattaggggaagctaaaactggatgaggggtatacaggaactctctttactgttttgcaacttctttgtaaatctaaaattattccaaaataaaaggttgtatattaaaattaattaaaacaaaaagaggcaaataaagtcaacatagaagcgtgaagggaatgtaaaagcatgctaatactctttttttttttttttgagatggagtttcgctcttgttgcccagcctggagtgcagtggcatgatcttggctcactggaaactccaccttcccgtttcaagcgattctcctgcctcagcctcccaagtagctgggattacaggcacacaccaccacgcccagctaatttttgtatttttagtagagatggggtttcaccatgttggccagactggtctcgaactcctgaccttgtgatctgctggcctcagcctcccaaagtgttgggattataggcatgagccaccgcacccggccaaagcatgctaatattcttgcctggtttggagggttgtaggggaagaatgatttgaatgctgattcattctaggtgttgcatagcaacttaagtttaagcacttcaagttctagtttcaccacttgtaacctttgcaagttgcttaacttttctaagcttcagtctcctcacttaaaagacaaaaacttgttttccttgatgtttaaagctatattagaagtaaataagaaggaaaaaaatgggtaagacagttgataattcacatatttaaatagtcagccttactaggaataatttagaacagcagtataatgctttgtttctgctgttaggtcactgcttttaaaaagcaaagccatgtgagcaagactgggggatgggagctcctccgtcgcttctgttggggattcaggccagttctctgagtcgagttctaaacagattcatccctctgatccagtaatttccacccccaacagtctttcctggggaagtaatcgagctacatgatggtaatatgcataaattgataacattaaaagcaagcaaaactctaataataaaaggataaattgaattatggtacattctctggtgaatattgcatatcaaggaaaatgtgaaaaatgtaaatacagccgtgtaaatgaagaggaaaatgtaaagctaaaaagcgggaaatagcgtatctatattttaggtaacatttaaatgatgataatagctaatatttttatgaaccccttactatgtgcagggtacttgttctgttttgcctacacattaattcatttaatcctcctaacaacctctgaggtatgtagtattactgccccatttttcacagctgtgctgcagtcgagtgcctgtccaagtacacactggcctgagtaggcccaggaggctgggtgatgtggctccgcagcctccactcctgtccactgtgcacactgcctctgttatattaattcatcaaatattgagggtccctttgatgccacgcactatccaccactggcaccctgacacttagaccctaacagatatggctgttgctcgtgaggatctttatttattaggaggtgacagaaagtaaaatcagataatgcatgccacgtggatcattaaaacagactgagttgcaaagagtgactccgtggtttctgtggcttgtttggtcagaaaggtgtttctgagatgaagctgagcagagctgtccaaagaacaggaaagaaccagctaggctgtgattgggggatagtggtttcaggcagaaagaacagctactgggtttcctagggtgtttggagcacagccggtgaggggcacatagctgggccagggcatgtagagcttgttcagcctctggaaggcattgggattttatgctaagtatgttggaaagcctttggagggagaatggattgtgtgtggctctggctggcagcagccagttaggctttcacagtagacaaggggagatgattgtggcttgggtgacagtgtattataattacggagaaaggtttggatatgattcagagatagggctgacagagcttgctgttggattagatgtaggaaattagcaaaggaaaggaatgggagagcagagattgggattcaactggagccatagtagccatgtgttgtttatcagacatccaaggggaggtgccaaattgctagttggctacagggatctggcattctgtgagaggccaaggcttgggtatataggttatgtgtggataactgcatctcccacatgcttaggaggccagataaaacagtgcaagaaaatattaacaataaggattatggacaatttgagtttccttctactttcctttgtgaaaatgtgttgctttaaaaatcaaaccaatgattcctttttccaagtctgataatatttgaagaatttttagagaaactaagttacaaagttatagtacttatataatcagaattggcatggtgtagagatgtcaaagtgggtgttttgctttttaatactttgtatcagggttatattttaacaaagagataagaatattagagacaggagtggtggctcacacgtgtaatccgagcactttgggatgccgaggtgggtggatcaccagaggtcaagagttcgataccagcctggccaacatggtgaaaccctgtctctactataaataccaaaattagccaggtgtggtggcgcacacctgtaatcccagctgttcagcggactgaggcacggaaatcgcttgaacctgggagctggaggttgcagtgagccaagattgtgccactgccgtccagtctgggcaacacagtgagactctgtctcaaaataataataataatagagtctagtcttcattttgccactaaaattatgtctctctatatatttatttattcaacacgtatttattgaaagcttgtcatgtgcctggcattgttctaggtgctaggaatatagcagtgaacagaatccacaagtcctcccctcagggagctttacattctagaaggggaagaagttctccccctcagctcaaaaaaaaaaaaattgaaaagaaaaatgccaaactcatccatcagctccaatctgagctgagccctcagggctgcctggttcattatgtgttttcctgttgattctcctattctgtacagcagcaatttcagactgtgcccactcttctcaaaatttgtcacctctgcagaccttgatattcctgctatctgcaggaatttctgtgtaggtgccttacagatcactcagattcattatggccagaaccaactccatgttgttcctctctgggctggcccttcccctgggcttcatcttagggatagcaccattacatacccactgttcaggacggaagcctgctgtcatcttggttgatccttctccttcactccccactcctgcccattcaatcacttgctgacttctgtgaagtctctgacctaaatcttttccacattccacatccatacactcttttgcttttggtacataccacagtagcacacactagactagcagcttcccatccctagttatagctgttgcctcttttctttgtagcatgtatcaccacctaaaatgtatatttatttatttactattttcccacccaaacaaaggcgctttgatggcagggactttgtcacctctgtttattgctaagcctcagttactagaaccatatccaaaagattaaacacttgttgaaagtatgaataaaataaaaggtttatcaggcttcaacttgtaagcagaagtgattccaaggactcagtgtcatcaatgccctggttttatatttctttctctacttagacttaagtggtgacagcctcatattaaagctggtttctcgcatggtagaaaaggactttggcagttccaagcttcatagctgcatcgtgcactagaggtcaacaaatgttttctgtagagagccagataagaaatgttttaatctttataggccatacagttctgctgcaactactcaactctgccactgcactgtgaaagcacccatagacaatttgtaaacagatcaacacaactacgttccactaaaattatttactaaagcaggcagcaggccagatttagccagaggccatcgtttgctgaccctgccctacgaccaaatgtcctttctagtgagtctcttagaagaacgaaggagctttgttttccaaagttcccaacaaccaccctggtttacctacttggcctgatttttttttaaatacctattagtgagccagtaagtaagtgagccactatggtaagtggggtgagactgtctcactagtatagagactcatggcccactccgaatctactggtgacagcagcttccctgaattcatgggctgcccagggccaggtaattaccagaacaaaactgtaccaatcaggaagggggttgggggaatggatactgggtaggcaccagataaagtctactgtgtaaggttgatcctgtgtgttacaatttgtttatgcaactgttgtcctagaatgtaagccccttgaagtcaggcaccacaatgataattagtaacctcagcttgcaccttgtacaggctttgagttctatttttatttgttttgtaaggatttaataacataagtgcatgtgatccttaatcagtcacataaatgacaggaaaaaagtatacattagaaaataatttgtttcatcgttgattaaaacttctgcttcttatggaattaaattgttttctgtttttttttttttaactaaggttcacaaaaaggattctggcttttggcgagattttggctttggaatgacttgtcagtatcgttcagatttcctgaccattggtaagtatactttacatttaaggataggactttatttactccagacttaatggtattttgctaaaaggtctcagatttgagtgttttcctactaaagtatgagtgtctaaggttagctaaaaagagaaactggatatacaaaaggcaaaataagtttataattaatgttttgaataggaaaaaaatggtcataaaaataaagtataatatttacttgttcctttaaaatcaaaacacctgtttttaaaaatatctgtttaacttgttacccatagttgcaggtgtttagagtagtcttacaaaagctttctctataactttactgttgtgcccatgggttgttacagctgggagtaatcttggttatctagaccaaggactttcacatttttttgagatgaaacctcctttacttgtctagtgaactgttacacaaaatcccagtatttaatacaaatgaaagaagacctgctctttctagcgcgtcttggaatcacaccttagtcatgcattcccctaagcctaaagatggcccatgaataatttgttctaactatcctgcatgctctgttgtccaggctgaagagcagtggcacaatcttggctcactgcagcctctgcctcccaggctcaagcgatcctcctacctcaatccccaagtagctgtgaccacaggcgtgcaccaccacacccagttaatttttttgtttgttttgtagaggcggagcttcattatattgcctaggctggtcttgaactcctgggttcaagcaatctgcccaccttggcctcccaaagtgctgggattgcaggcgtgagccaccatgcccagcccctagcttcagtcttacccagcaaaatataaagtgtcaaagaatagtttaataaagcaggctgaaacctgattccatgtcttctgattcatttagggctagctacctttctacagcatagaagtcatagaatatattttatatacattctaggtccatatcacattcgtttttataaccagccttttgttttggaaatccccccaccttgtctccttatcattgtaacacttgaataatggaaaatcaggaaataacaataaaaggggcgttaaattaaactgatgctcttttccttgatttcttgcttagttaagcaagcagcatttcactattcctcaaaaatagatttgtgtacattttttcagtatcttgaatgctttgagttccttatctcttttttatgacaattttattgagatatagtttacatatcataaaatttattaatttaaagtgtacggttaaccaggtcatgtagctatcaccaccatcaaatttagagcatttcaccccaaaaagaaatcccatacccattaacaatcactcctcacatcctaccaaccctctttccccccaaacttaggcatctactggtctacttcctatagatttgcctcttctgggaatttaatagaaagcaaattgtacaatatgtggccttttatgactggcttctttcactcacataatgttttcaaagttcatccatgttgtgacatgttaggtacttcattcctttttatagccaaaaaatgttctattgtgtggttataccacattttgtttctccatttgtcagtttatatgcatttgagttgtttctactttttggctattataaatactgctgctgtgaacatttgtgtttaactttttgggtggacatagattttcaattctcttggacatatgcccaggactctggctgggtcatatggtaatcctgtgtttgaccttttgagaaattgccacaccgttttccaaagtggctgcatcattttacattcccaccagcagtgtttaggagttccagtttccccacatcctcattaatacatgttattatctttttgtttctagtatcacccatgatagtggatgtggtattgattgtgactctgattataatttttcttatgattaatgttgttgagcatctcttgatgtgtttattggccatttgtatatctttagtgaaatgtctgttcagatcctttgcccattttaattgggttatggagtttcttgggcttcttgaatatgtacattaatgtttttcatcaaatttgggaagtttcagccattatagtcatctctcagtacctgcatgggattggatccaggataccatgtggaaccaaaatccatggtcgatcaagtcccttatgtaaatatacatattttcatattacctgtgcatatctgcccatatactttaaaccatctctagattgcttataatacctaatacaggccaggcacggtggctcacgcctgtaatcccagcactttgggaggccgaggcgggcagatcacgaggtcaggagatcaagatcatcctggctaacaaggtaaaaccctgtctctactaaaaatacaaaaattagccaggcgtggtggcaggcgcctgtagtcccagctacttgggaggctgaggcaggagaatggcatgaacctgggaggcggagtttgcagtgagccgagattgcaccactgcactccagcctgggcaacagagtgagactccatcaaaaaaaaaaaaaaaaaaccctaatacaatgtaaatactatgtaaatagttgttatattgtatttaaatttttatatttattgttattttttatcgtttttttccctaatatttttgaaccatgttggttgattctatgggatgtggaactcatgcatatggagggctgactgtatttctttgaatactttttctgctccattctcatagttttctcctttgacactcactgtatgtatgttggtacatttaatggtatcccacatttttcttaggctctgtttatttctcttcattcttttctccctctgttcttcagattgcataatttctattgatctatccaagttctctgattgttttttctgttagatctactgttgagctactctaatgaatttttatttcagttactatagtttttaacttcagaatttctatgtggttcttttgatatatatataatttctttattaatactctatgtgatgaaacattgtcatcttctgttacttccttaagtgtgacttcttttaattctttgaacatacttacaatggctgctttggaatttttgtgtattaaagctaatgtctgggccctaacacaggcagtttttgttgcttgccggttttttttttttttttaagcgtatgtcacatcttcttgtttctttgcattcctcattatttctttttcgaaaactagacattttaggtaatacactgtggcaactctggatactgatttccctctaccaccacggcttggtttttttttttccttgtttatttatttattgacatggctggactattttaacaaattatttcttcctccttccccgaccttttggcaatatgaagcctctgctgttgctcctcagggcctgtgcagttatcctaggatggcattggatttagcagggctctctttatctctttccatgcctccattggtatcactcctattagactccactgactgttcactaattgctgtcttgtttttgacaatgctctggggcataaattgctccataatctgtccctactaaattgggcccttttgcagggatagtttttgcagcaagtctttgagatttgttcagaccccaggaggtatattcttactatctctctctgtggttctctctagtaaattagctggcctacagtttagctgttgccctcctggagttaccagcctcctcttaattgcttactaccaaaatctccattattttcaagaggctggaacttctctaaactctgaacttctctacattctattttaaataaagtcagttccttagggaagaactttggagcactttgttcttatggacttcctctcccccgggggaaaaaatccatgaggttttgccctgaggatggggacagtgacacacttattaagcagagtgaccacctctgccctatgagcaggacactgggtaggggcaggaggacccccagtattctcagctggccacacctggaagtggagcctccaccctgttgctgtgggctgggtgaaaaagagctgcacctgtttagaacttagactctttatttggagcttctgttcccttgtttcctttcttcctggtattcccattatacatatgttacatcttttgtagttgtcccaccgttcttagatattttgttcattttattttcagtctttttttttctttgattttctgttttggaaatttttattgtcatatcctcaagctcagagattgtttcttaagctaagtccggtctactaatgaacccatctaaggcattcatttatttcgcagtgtttttgatctctagcatttttttaaattccttagatccatctcactgcttatgttccgcatcttgtgtgttatctgctctttccattagagcccttagagtattatacatagttgttttaaattcccagcctgataattccaacatccctgctgtatctgaatctggatctggtacatgctctgtctgttcatactgtgtttttcttaacttttagtataccttgtcatgttttctgttgaaagttggacttgatatactgcgtaaaaggaactgcaataaataggcctttgatgatgtggtggtgaagtgtggagggagcggaagtgttctgtagtcccataagtaagtctcaatctcttagtgatcctgtatcccagactctgaatttcacacatgcttctcagtctcccctcctctcctggacaggatgactagaaggggctctagttgggtagatttcttcctccaagtcagttaggcactgataaaaccccagcaggttaggctctggttaaataacttctcctaaggacaggctttgttaataatgacaacatgctgtggcatactttaaaatgattaccttttccccttccccactgctggacgcattaagagatttttctctgatcttcaccactgaggacctaatagagctcctagaggtaaaactcacatgagtatgggggtcccaatatgaccaggtccccctggagtttttaacactcagacttacctcccctgagcctccagcaatttgtcgattacagttagggttttcctacctgggtactggtccccacagagatttctgctccagtaagttggaattctttgtatctgcctatctgtctcaccagttttgagggcagtggtttaccctgtgacctcacttctctgtgagagacctaagaggagttgttgctttttcagtgttcagcttttgacttgttaggatggagtgatgacttctagctccaggcatgccagaccagaaactgagaatgccccatttgttttaagtatatgtaccatctctaatattctaagagcttatatctacaaggaagaaaagctgatatgtatcagacatagcatttagtaaagctctgattgtttaatacttttcagagatccccagattattgtccatcctgttaatgtgaaattaagtgggatagaattatttgacaggagccgggcatggtggctcgaacttgtggtcccacttactaaggaggctaaggcagaaggatcacttgagcccaggagatggaggctgcagtgagctatgattgcacctctgcactccagcctgggcaacagagtgagaacacatctctgaaaaataaaaattatttgacaggccaggcacggtggctcacgcctgtaatcccagcactttgggaggccgaagtgagtggatcatctgaggtcaggagttcaagcttacgaagatgacgggattaagagattaaagtaaagacaggcaatcacaagggtattgattggggaagtgataaatgtccatgaaatcttcacaatttatgttcagagattgcagtaaagacaggagtaagaaattataaaagtattaatttggggaactaataaatgtccatgaaatcttcacaatttatgttcttctgccatggcttcagccagtccctccattcggggtccctgacttcctgcagcagcccactccagttagccttctgccccatcactctatcagaattgttctggggaagtttataagtaacatttatgctgccaggtccagtcagttcttcttaaattcttcactgaatagcacacacttgacaacttcttcctcaagacactttcttcacgtggctactacaatggcaccttttccagaattttctccctcacctggggccacttctcaatctcatttcctgacttaactttctttacctctatttaacctctagaaattggcatttcttagtgtttagacctaggccctgttttccttccaaattccttcagtaatttcattcattcctgtagctttaaataatctatggacccattctcaaatttatatctccagcttggccctttcttctttttccactctggggagtttttctatagcccagaaaagcgtgtgtctcaaaggacagaaaatgtggctggtcgcagtggctaatgcctgcaatccagcactttgggaagccaagtgggcggaacacttgaacccaaagttcgagaccagcctgggcaacatggtgataccccatctccaccaaaaaaaaaaaaaaagctgagtatggtgacatgcgcctgtggtcccagctactcggggctgagatgggaggatcgcctgagccacggaggtcgatgctgcagtgagccatgatcacaccactgcactccagcctgggtgacagagtgagaccctgtctcaaaaaaaaaaacaaaaaaaaaaagaaaacataaaaagttaatggtggtgagattataggtgacttgtattttcttctcctttatttgactttttgtagattttctacaggactttgaaatttacaaagtgttcttaaatatttaaccccattttgatactgtcaacaaccaaccttgagctccttgagtccaagtgtcagctcaaaactggacttccggtgactgggagtcactcctccatgccaggtgtctcgtgctacctttttgctgaaccatcccatcccttttgaagcagaacatttaaaattttatatatatccctgtgctctggctaataataggcagttatttatagtgtcaattttgatcttacaggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaagttaaatgaaaatgtgataaatttatttctattgtaaagtatcataaagacagaacattacgtataacatgtaattgtgtactttaaaaatgaaacacgagtgccgcagctgttcacgttaaaatatggggcattaccaggggacaggccccttgtgccccttcttgatcacctgtgctcaccctctccataacagtcacactctgatttttatgatcgtttttacttgtttttcttcttagttttcccagttacgtatctcccaatagactgttttgcctggttttgaatttatatacattattatttcattatatattctctttcattcagtgtttttgaggttcactcatattattctcaaaattagttcatttttattattgagtagtatttcattgtactgtagggaggggaaaaactccctcccatcttctcagggtcccagctggccttgaagattaaattggcataggatagattaacaagagaaaagcatataaattgatgtaatacaaattttatgtggtgcaggagccctcataaagaaataaaaccaaaagaagtagagtcagttacttacatactgaattggacaaagactagtaaactgtgaaaatgtgactgtattttgcgggagccttaaaaaatagttattctaacaaggtctgtacaatattctcctggtctcaaacttctcgtcattgaagataaagatgtttgttgccttttcttccagtatagagagtgtctttcacactggaatccatctcctgctcttaagaaacagcacaaaggtcaatcacctttttgcacctgctgtttttcatgtgtctttaatttaaatagtatgccggaatggcatattttaaccccttcagtatgaatgtactactatacttcttctactgttactagatacttgggttgtttccaagttgtttttatattctcttgttggtaactatttgggttgtgtagatttttgtggtttgcttttgctgttgcatgcgtgttgtcgtgaacatctcctgtaagtgtgccagaatttctccaggagtaaaaatgctgagccatcggttgtgcacatgtttaactttccaaagtggaccaccttccaccactgggtgagttcattttgcatccttgacagtacttaattttgtcaggcttattaattcttgccaatttagtgggctttaggcatgaactgtagttatgatttatctccagtctttttgttcatttttaccagttcacagggattcttcacatattccggataccagttcttgttggtttaatgtttgcagatatcttctcccatcaagaccaatgtggtttgtcttttcccatttttggtggtactttttgataaataaaaaactaactttattgtgactatcttttttctttatgatttctacttttttcaatagaatttattttttagagcaattttaggttcacagaaaaattgaacagaaggtacgtggagtttccttagatccccctgcccacacacatgcacagttttttctgttacctacatctgtcaccacagtggtacatttgttacaaccagtgaacccacattgacacaaaataatcacctaaagtccatagtttatgttagggttcattcttgttgtacattctatgggtttagacaaatgtataatgacatccagtgttacagtatgatacagaacagtctcactgccccaaaaatcctctaggctgactattcatctctccctaccctctaacctctagcaaccactgatgttttcactgtctccatagttttgctttttccagaatgtcatatagttggaatcgtacagtatgtagccttttcagattgccttcttatcttagtagtatgcatttaagtttcttccatgcctttttatggcttgagagctcatttctttttagtaatgaataatatttcattgtctggatgtaaccacagtttacccattcacctactgaagggtatcttggttgcttccaaatgttggcaattattaataaaactgcaataaacatctacgtgcaggtttttgtgtggacatgttttcaacctttgaacaaataacaaggaacacagttgctggatcatatgataagagtatgtttagcttattagctttgtaggagcgtgccaaactgtcttccaatgtggctgtaccattttgcattcccaccagcagtgaatgagagttcctgttgctccacatccttgcaaccatttggtgttgtcagtgtttcaattctggccattctgtaggtgcatagtagtatctcgttgttttactttacatttacctaatgacatatgatgtggagcatctcttcatgtgcttattttccatctgtatatcttctttttttttttttgagacaaggtctcacactgttgcccaggaggctagaggctggaatgcagtggcgctatcatggctcactgcagcctcgacctcctgggctcaggtgatcctcctgcctcacctcctgagtagctgagaccacaggcatgcaccacctgccctggctagtttttttttgttttttttaatagaaacagaggtccccctatttacccaggctgatctcaaactcctaggctcaagcaatgtgtatcttcttctcaagtgatgtgtattttctttaatgaggaattggtttctactttttattgatttatgacctcataatagggaaggatttctttaaaaatactgttgtatattctcaatatctcccatgtaatttcacttttctcaggtctttaacctaagtggaagagatttttgtgtatgatgtaggtaaggattgcatttcacttacttccagcactacatccatactttacctactgatctgcaaaaccattcttatatccatcagatgtccctgtgtgcatgagtctgattctatgctctcttctgttccgttaggctaccactctatcactgcaccattagcattgcatggtatcagttactgtaattttatgctagtgaatatctgggacacattttccactcaccttgttcttaaagatcgttatggctatcataggctttgtactttcatataaattttagaatacgcttattaggtttcataaaaatgtatgaatttgattagaatatcattgaatctgtaagatcactttggggagtctttatgatatgaagtctcccaatctattctatttggctttattgtttttcaattacattttataatttttcacactgtggacttacacatgctgtttttcagattcttcatagttactctgcatttttgataccattgtaccttatcttttattgtgttactggtgtttagaaatcattgattttgcatgttaatttttgtgttcagaaactttgccaaaaactgttaattctagtaattagaattcttttgcatttttcttgttttacatcatatcatacatatgaatagtgagttttgtttcctttccatttttaggtctttagttctttttcttgtcctcctatgcttggtaggatttgttgtgcaatgctgatggaagtggtaatagtgggctccctgccctgtttctgatttcaagcagtgctttcagggtttcatcagtaagtgtgatgtttgctggaggtgttttcgtagacaaccctgtcaacttaagaaacttcccttctgttattacttagtgagtttttatcctacctaagagcatttatcagatacttttactacatctgttgagatgttcatatactttttcccctcttttaaagtattaaattgatgaattaatagattttctcaagtagctttgcattcttgggacaaatgccagtcagtcatgatgtgttatttttattttacattgtttgatttggtttgctttcatatacatacatgtaagtattcacatttacacatctcatatgtattcatgtcgggggtgtgggtatgtatatacttcaggtgtttttaatctatgttcatgaatgagattgcctatgacttcccgttctcttccttgttgggcatttttgtttatttatttgttgttttaattgacgggatcttgctctgtctccaaggctggagtgcagtgggggcgatcatggctcactgcagcctcaacctcctgggcttaagtgatccccctacctcagcctcccaagtagctgggaccacaggcacacacccctgcacctgactcatttttgttgttgttgtttttgtttgtttgtgtgtagagacggggtcttggtttgttgtccaggctggtctcaagctcctggtttcaagtgatcttcccaccttggcctcccaaagtgcagagattacaggtgtgagccaccatgcctggccctcattaggcttttctgttgaggttatactagcttataaacttaagttacaagtgttccttcttactctgtttctagaaaagttttgtaaaattagaattaatttcttccttgaatattgaactgcctggaagaacggcctgaaagccacttgggcatgaacttttctatctaggaagatttttgatcagttgttcaatttatttaataattatagaactattcagactttctattgtttgtagaataagctttcattgagttattttgggtaaatcataattttctaggaatttatactgataaatttgaaaattcagatgaaatcaatatcctcctattatctgtgtgatatgtatacgatttatagtgatatcctttttttctcattcctgatatacttatgccttctattttttcttgatcagctttgccaggagcaggcagatttttttcaatccttttaaataacccttaccagccatgtatgagagatcagttgctttacctcctccccgacacagtatttccagtgtttttaatttaaactctttaattataatttctagtgggtgtgtacagttcttattttcatcttagtttataatcagggaatgatgtcaagtaccttatcatatgcttattggccatttagatatcttcttttgtgaaatgcctgttgaagtttttctgccttttttaaaaaaaattagtttgattttttttttagttgatttgtgggggttacttctgtattctgaatttgagtcctttgtcagatttacatattacacataccttctcctagcaacagcctctctttcactatgttaatggtatctgtcagtaaacaaaagttcttaatttcaataaaaaccaattttcttttatggttagtgattttggtgtccaatttaagaacctttcctactccagaattttttttaattctttttttgacacctcattgcattgcctttcatatttaggtctgtgatccatctggaaatcgttttgtatatgggttacaggaagagtcaagatccatcctttagtttttcttttagggaaggtctgtggatagcaaacgccatttagtttgtctgtaaatatctttattatctctcatttaataaatagttttaaaaagtagagaattctaaattggctatcattcttctttttagcacaatgaagttactattccactgtctcttggcttcagttatttctgctgtgaatcatcagcgtaacagccatcatccattgaaagcagtccactctcttcttttctgttctgtgtcactatgatacatctgcatgtgggtttgttttttttctggtcctgcttgagattcttcgggttccttggattgttactctgaaaaattctcagctgttttattttcaaaaatgattcctgcctcattgtctctttgcttctctaactctgataacatgttaaaaccgttgtgtcctccatgcctcaacctgtttcttgttttccaatgctttattctgtgttagattctgttaatttcttcagaattatgatcagatttggaaaataaccaaatagagcatctagaaatgaaaactacaataattgaattttttaaatccagcagatgggttgaacaaaattagacacagctaaggaggttttttttttttttttttgaggaggagtctcgctctgtcgcccaggctggagtgcagtggcgccatctctgctcactgcaagctccgcctcccgagttcacgccattctcctgcctcagcctcccgaatagctgggactacaggcacccgccaccacgtccggctaattttttgtatttttagtagagacggggtttcaccatgttagccaggatggtcttgatctcctgaactcatgatccgcccgcctcggcctcccaaatcctcccaaaggattacaggcgtgagccaccgcgccaggccctaaggaggtatttttttaaaaactggaatataagtcagaatgtttgtttctactggatgtttaggggcagtaccagttcagggccagttcaaagaattcttagcttgaagtttgttggaccagtgttgatttgtgctgcaaaattttgtgaagctcactgactcatcattatcaattatgaaggtaaaatttccctgcctccattcagtgctgagattcaaatcagggagcttttcctaggtccctcggtggggtttgggtggagcgccttatttcaagctcactgctgcaccgaggggtggctctttgggatgccagctttatgggctggggtctcctatttgattcttcatcttgaggtgggccctggacttttttctctacccctgtggacttgaaaacagcagctcatggtccttaccctcagggcaaagcaggctgcagagcttccctgacttctctggctccctgccttcacttggatttttaaattttgtacaactttatctgttgttttcagtgggcacgcacttcatctctcacactgccagaaatgcacaagtggcgcagtttactttcttacactcttccctgcactgttgctgaaccactcagccctgctgagcgcgcctgagcatctgcacctgagcatcctggtgctgtgggtagatacttgtggggtgttcagcagcccctcaccttcctcacagtatcctgacttccttgttgggaataaagattgaaattgtgttaacgtggtctaaactggcctgcagatggattgtaagttttgcttcttgaagttttgaatgcaaatttgtgggaattctttcccatttatatttttatgctggttggattgaacagtgactgttaggtgaacagtgacatgttaggtgaatgctaacatgcttcgtattgaccaggaccccaggtgttcctttgagaagggggcctttgcttcacttttcccaaaaggtgctgtggccttttgcagaagtgctgcttggcgtccgcagcaccagggccagtccatagcaagcaccgactgtgctgacaatgaaccaggtgcctgctctgtctgcctttgcttcttagaagcctttgcttcacttttcccaaaaggtgctgtggccttttgcagaagtgctgcttggcgtcctcggcaccaaggccagtctacagcgagcactgactgtgctgacaatgaaccaggtgcctgctctgtctgctaccacggccctgcaagagagccgtgatcagatgaaaaacatggaggctataaggtaaacagcttgtccaagcttctccagctgggggctgaaaccagctctcactccagtttccccggctccttgctccctccctgctgccttgtgcctccctgaggagcagggtctatgttctcgtatgggcgtggtcggtgtgtgtcacaagcagtgtgtgtcacagaagtctccatggcttactacagatccttagcttatcattctgctacatctgacactctgacatccatttgttcctgcaacgtttgtgaagggtgacactcagccatcacacagggatgtactggtcacaaggcacacagactatcacccaccgagtgcttctcacacgtactgtgtggcccagggattggactaggcccccaccgtattgccaattcaggaggtgtgtggagaggcctaagaatggacattcaaacaggttcccaaggacccacacttgaaagccactgccctggaggaactgcccatggcaggggatggccctcccagctcgaggttgtatccaaggccagagcaaattatgcactcccccttcttcagctgaggcagatgaacacttccaaaaataacttcttcaccaggaaattagggatgccattggatttaaagacctaaaaaatgtcattcactaaaagctcaagcatcatctccatgtccccatttgctccacagacacccgagcacctgtcctgcactgcccactgcatggggtggcaaggccccgaggcccagcttctgtccaacacgggcccctggctgtccaaattcacatcccaaattcagcccctgggtcacactagccacatcccagcagacaggacccacatatggttggcagctgctgtactggacagcacagatacaggacattcccttaccccagaaaggtttctgttgggtggcgctcacctcgtgggaatgatgacactgagcacatagtgaaagatgagctgagttatccctggggtgcagtccccaccctgtccaggcctgagaaccgtgggaatgggcaggttggaggagcagaggggagtaccatgtcctgttctggagccttagtttttttccttcaattcccgagctctcatgtgctcccccagtgaacccctcttctctgttgcgcttgagtataaaactcatgacaccaggagtggcccctccagacctgcattctgcaggctgccctgcaggatcgcgtccaggggctctccaacctcccctgcccccagagaggccatctgactcctctgcagtaacacagtccatacagcctggcttaactaggtatcctgaacttacttacttatgtgaccatgcaatacagcagccagtgacatctttttggagctcacaatgaggaaagcaggactgaacgtgcctcctatagcttctttcgagtctcaccttattcagtggaaagccctttgtcacacaaagtgttgccagctggagacaaaagtctcttgcccagtccctcctgggaaggccacagcaggcctggcagcctcaccctcctccctgccccaggggacccatgtctccggccagcagcaaggccaccccctcactgtacacacacagcaggcaagggaggggagtgatgtattcttttattgaagcaagtatgtccagtcacaccaaaactgacgtcctgcattatggtacagcttcatactcagagttcatctcaaataccaaaacatcaaatcagggtatgtatcaaattgggaaaataaagtagcagacagacactgtttcaagtaggtactagaactgatcacccgtgaagtgcacgtgggtgtgtacagaaaccgttctaaggctgtattccaaatatatattctcaagttttaagcctttctcatctcaaagacataaacaaagcaatatgtactatcaatatacaatctgtactagctagaacctcagaaagtgcaaacacactgtgacaatacagtggaactattcctgctccacccaggaccagaggcatgggcagcgggcccagggctgcctcctccccaggcccagcctttcccaatgtcttcaggctcttccaggagctttgggaattgggacctggcccatcctcacccaggcttccccattgatcaaggctcctgcggaaactgggaatgcagagggacaaggatgcggagttcctgcgagggagacggtccacgtggattgaccgtgtgctttctgaaggacagctgtcctgcgccatggtcagtagggcccagggctcacaccacgaagtcagacatgggaaaatggagtgtgctcctctagctgggtgtagaaaacacctctcagtattgggcagttttatctgaatgggctccagcagtatggcctggcgaattttctgtttccaattccaattagggcgctgcctacccaggtgggaagagggctgttggctgccctcccctctgtagatgataggtttcaagactagctctaaatgtcaccaccctggagtcggccatgtatttttcttcatcacagctcagtgtgtctttcagtcacagcccagaaaactgacaactccatgcttccctcccttaccttattttagatttcctcctttctaaaatgtagttgaagaatgatttgctggacacattgtcacagaaaatatgctgccaggtgccccctgcccctccctgaccccacaaatccctgaaaggaaaatgaaaatgtaaactttggacagcccgtactcaaaggctcacttccagaagtgtgcggacgcgacctcccagccaccagccctcctatggagcctcgcagcccaggctcctgagggcaggcgcccaggtggagtgggactcaccgcagcccaaaccacagagcaggaagaccagaccccagtaccctctaaggcactaaccccgacgtcagagacactggctggaaaggcgtccgagcaggcagggctcacgttggttttggctgggttttttaaaatatttttttcataagatgttaataatcaaaagtagaaaataaaaatctacatttcattagaataagatgttatcatggataccatctcccatgatactctcccctccccctccccaaagcagggccctgccctgttatttaaaataaacaaaaaaaactttgtaagtgccaaaggttgatgcgtgaaataattaccatttttttctcataaaagttatatacaaaatggaccccaaccagtgaggcctcctcatctcaacccacatcagtcaaaatttaaacccagttagtgcacgtgcttcctctggcgtcgcgggctgcatccgcctcaggctctgttcagaagggtggtcctagagggggacaggacaagcagtgctcaggcccgagcagggcggcttgggtccaagccatcctcagcctcccaccaaacatgcaccagggaccctggaccagggacgcggcagtgcccaggctccctttccaggagggtaaccctcgtgcccaccctgagtcctccctcttccttacagactcccatgttcctgacgccctcctacctgagggtcttccagctgtctttttccatgtggttctcgggaccctcactttcaaaggaggcgacgaagagagctgagagatgggaaagtccctcagagcctgtgtccccatgcagtgtctgcctgaacccagctgtcccttcaggagtacagcccagcacaaggggacagtgacctctggctgggctgaacacagttctctgctgtgcggggctctcaggctgcctgttggggactctaggaaggttcctcgtgttgcagcacctgacctaagcccatgtgaccctctccagtggctgctggaaactgagtctcttgtccttctcttccatccatcccatgacccaccctcatgcacactcgcccctgcgagcagagccagccctgtgtggcatggagcagccagcaggccatctcccagggcaaccccaaagagcaccgggcctggacaaggagtcaggtggggtgggaggcatgctgcgttgggaggcagccctcaccttcctcgctgtagatgggcgccgtgagcaggtaactctgaatcttcttgtccttctcgaaaggacactctacctgtgtccatgtcatgaactcatggatctgtctggagatctcccagaatttctgaagggagcaaaaccaactgatgttcatctgtcaccttaagcaccaaaccctcggtcagggcaggggacgtaggttttggcctcagcctcctgctcacttcactggtcccagcaagatgggacagtggccctgcacgctgaccccgtggccatggtggcacgccatgcagcctcagagccagcaggtgtcccccaaggccactctgtctggccctccacctgggccatcaggccggcagcagggtctctgcctgtctgtgcagggacccaaagaaggccccactgataactccagcctgaggcaggcaccccatccaaacccagcccagcggcgccaaccagaacgtgtcatgatgtcccttctctgggaccttcggaaggatcccagctcctgcccacacctcacctgtgtgaggtaggcatccggcagcccacagccacctacacctgccctgccacctatgtcccaccctcccatcctcaccaggtgccctcaggcccacgaggcaggctcttcacttccatctagaattctctgccgcctcctccctgctcaagtcccttcctatctaaacccctcctgacctccaatcccacaggggtggacagggctctctccctggtagggccaggctggaaccacggtcctggataaatacaattccctgtgactccaagctctgcaactaggccatccacccagaagtaccggcaggcgcacctcataccttgcagtcaaacagcaccccgtgacccactatgaggctttcagtcttgaaggcccttgtgaacctcaggcagggctcaggaaacccacagatcccgacccagggctaatgcctggcggctccagtagctcagacagtttccgcctggcctgccctgtgctgggatgagctcaccttaaagttaatgtgcccgttgggcaggtggttggtatggattttgtgcaggaagtagatgtccttaacgaagaggttgaacacagggatgacgatcttttcacggctgctgttggccatctgggacctctgcgtggccccctgcagggctgtacggtagttgcagaagttgctggacgggtccatgtgatgctgtgggcacagggaggacctggtgagcatcacagccccatgcccctccgacctgctccagatgcccctctgcagagcaggaggcagcagacagagaaggcacctggcccctgggcagcctgggagttagcacgggggaggggacgcccaagggtgcctggctgagccctggggccagggcttctgagttcaggtcctggcatcctctggaaagccacagaagtgtcactgccctgcctgccaggcctgaccctcgccctccttccttcaagacttccctttgctcctctacttagatcaacacctcccagacctgaccagctccacaagacacatgctttgcaaaaatggactctgtggtcaaacacatctgaggaaggctgcaggtgaccctgtctgccagcctctgggccatctagaccagccaggacctggagacactgaccaaggaaaaggcagtgtcttccaacacaaccccactcttgtcaaactcttgcttaaccgcattccactctggaactcgccttaggtgatgccgggtctgcctgaagtaaccgaggacaacttaagtccccactgctggaggacgaacatgccaggccagctcagccagcactgtaggtgctagccccagggagaggagggcagccccccacccccactgtcagggcccccttcgggccattgcgggacgaaatgggtgcagctcgcagctgtgacggggctcaggtgcctacctccaagacatcaaacttggctgtcttgaccttggaccaagttttcttcagccttgccacaggactgaggttcatgccagctgcagaggacagcaggtagggtcagggccgggggggtgggccatgcagcagccccaccctgggtgcccagtcactcacagatgatggccatcatggagttgaagttcccgatgttgaagcactcccgggccacatcaatgaagaactccaacatgcgggtccggtgtttcttcttcaccacctggaaggtggcaggtgacctcagcatggcgctgccgggggacagcaggagctggggccgccgggcagaggaacagaggggcagggaggacctcgggacttagcttctggccacagcgggctgatccaggtccatggctgcgtctgggaggtccagacatgtgcacggcctatgctcaggctcctcagtcatcaaagggaaggcaccatctgccccagagggctgtgagggctggcaaagcctcacacaggcaagaaaaatggtgctgggcacaaggggagcactccacggatggggtgtctgttgtcattgaaggaatcgctgtatgtcggggttgggggaccaccaaggccctgacaatgcaacagggactttgtgcattcactcttaaagttccatcatctaattcctggggcaagatcagggtctcactgggtgtgggcatggcagccaccccaccatgtctgccatgggcacttacccggcacacctcagtggccaccagcatgctcaggcagttgaaccagttgtcataggcctccaggctgtaggtcttggtcaggtcccctcggcactggaaaggacacagcaggtcatagggggcctggaggaccatggctggacaacttagtccccacagctggccctggtccccagctatggctcagcctgcaccgcagcagcctcaatcatgcctgcgtgctccttgctgcccagtgcagggctggcaggccaggctggctccctggcccaaatctgtgacctctcccagcattcatcatccatgaccagcacagccatcttggagcaggtgctgcctcttgaagcaggtgctaggaggtccagtgccacatccatcggggctcatggcccagcactccggagacgctcggggcgtgctgagtgaggcccacacccaccctgcatggagcgcaagtgctgggcagacagggctggcaggggtgccacaggccttggcccacttaccctgtggttgtccaaggagtccatgtggctgacgatctgcatcaagtcctcagggtaaatgctgctgaccctgtcctggggtggaagatagcaaagggaaggtgacaagcttcccctggagaagggacagcactgcataggcatgcggacagggagaggaggagctgcccagggcacaggaccttcacctcctcccaggccagtcctccatcctagggccactgcagtccccactgcaggacgacactgctccagctcctcccactgacacagcactgctgtgttcctgaggacgtgagtgccaggcacagaggtgcccgccactcagacggacacacatctggcatgaagtgtggcagtcagggctggcaagcgcacttccctgatggctcagtgtgactagcaggggcctgaagtgctgtgctgaaagaggcactgtggtcccacagcccccacccccagtcagggcataaggcagcactgaccagctcaatgtgagtcagctgctgggccagcaccagggggtcgcagcacacgcccaggatgtccttctgggcggctggtggcttggtcttgaggatgggccccttgtctacagccggtggccggagcttctctcgcagttcctggagctggctccgggcagccaaggacagcaacaggctctgtgtcatctgggcaatggccttcttcactgtgccattctcctgtggggtcaagggcaataagggtgccagcatgggctggcagcaaggccaccaccactgtgggtaggatccatctcacctccagggatgtgcctaaccaacgtgagcccacagcccctatctaaaccgcagccttcaggccttcaaggacaaagtggggcacagcatgggctcctctgaggactgctgaggaggggtctcagtgggctgtcctgctgcaggacgaggctaagggcagagacaggctcaagactgagcttctgggtctgaaaagcatggctttttcagaggcggcccactgagctgcttcctgaagcaggagcagcccatagaacagtttaaggcatgggaaaggcttctgccaaagccaggagtctctgccccctagttgggagcagcctggggtccctggctcctcctggagtactcggggtgaacaggagctgctaagcacagggaatgcttccactgtggaggcccagttggcccaggcatctccagttctctctccaccaaaggcaaaggtgaagacatttgaaaaatgggagaccggtttaaagccttacccccacctcctctcactaatccaagacaggcagagccttacaaactctcaataggctcccactccagggacaaggacagcaagggccaggagagggttgagacaatgattgccaggcccgcaaccgggctgcaaggtccctgcttgcagtatcatgggtgaccctggcccactgctggccagctgagctgtcatctgggggaagggaggttgaatggggccagccagcaaccctcctgggggagtaacatggaaggggaccacatacagagttgtccccgaagcccccaccctcccgagggcagaccctggcacacacccaaagaccctggccagagcccagggagcactcacctcatcacactgggtgacacggtgtgtgatggctttcagctcggccatggccttctcatcctggaagtcataggggaaggcctcggtccactccttcaggagctgcacgatcttggctgagaaagacttcagcttggcctggggcagcaggggatacagagtaaggccccacagggcagagtagggtactagatggcaaatggtgcaagcttcccacatccccaagccacaccccaggccctgtgctgggcacagcccccaactgcgtgccacctgcggtttggccaaacctgaaccgccacatgactcctgtttggttccttcttccttccccttaagttgactttctttttcacttaaataaacttatattaaaaaaacccaccccatctctaaggtgacaaaaaactaattccatttgctataattagaagttacccataaaagcaatacagtaaaataacccaagccaagccatccagttagaggagagctcccgtctgccccctgtggttgaaagggcgacagcgctgaaaggggtgtgaccccgaggggaggcgacgcgctcccgcgccctagtccacaggcatgcacgaccccacccagcacagggcctagggcatggggactggccctcttggctgaaacgactccgaccctctcggaagatgcccgcgcggcctctgcccccggggagaggggactgtgcccgatgctcaggcgccgcgcccccatcctccaatcccccagaacgcaccacaggccaagcccctcctgcgccagccaagactccgcgccagcccacaccagccccactcagaccgctggaccccgcccccggcccccgcaccacccagcccgcaactctgcagctttcttcgcccacgccgcacagcctccaaaccagcggattccgcccacgttgccagcctaggccccccaccacccgctcccaccacgcccctaacccggacccaacccacagctccagcccagacctcaccccagcctggtgtggcgtcacgccccaactcagacccgccccacagccccagccaggccacgccccaaccctagccctgaccccgcccccaggccccaccagcccagccaggccatgcctaaccctagcactgaccctgccccgagaccccacagccccagccaggccacgccccaaccctagccatgaccccgccccctggtcccaccctggaccccaccctgcagccccagctaggccacgcccaaccctagccttgaccccgaccctgccccagccaggccacgcctcaaccctagccctgaccccaccccctggccccaccctggaccccatcccacagtcccagccaggccaagccccaactctagccctgaccccatcccccagctctaccgtgaaccccgccccatgcctccagcccctagccttgacctcgcctcctgccccctgcccccgcccgtgccccagccaggccccgcctcaccttttcaggcccggcttccagctgctgcttctgctccacgcagatctgccccacgcgggccagcaggtcatgagggggcataaagacccgggagctcaggagaaaggtgaagatgtacgtcctctgaaggcaggagacggagagagggcggagggagggtgaggcaggcccccgggggctcaccgcgctgcttcacctggcccggctgcctcccaggcccagcaccgccggtcccgaggccatgccttcacctgcccggttcccttcgccttgcaggcccttcctcctcttactgctaccccggccctgcctacctaggaggcacggctcgagccccgcctcccagcagctctcccaggcctcctagcagtcttcctccgctgggattctccccctctctgccccacgccaccatagggctaaccccagcctgggacgttggtagggctccatggtgctcgctgcgccaggatgcaagccagctgctgtttcagatcctcgtgggccgagctggaggtcagcggtggggagggtgggggatgcagggaggttggcacaggagcggggcctgtcgggagcagggctgatccatggggcggggcctcatcagcaggggcggggccccatcagcaggggcggggccccatcagcaggggcggggcctcaggggcaatgctggtgggggcccctgcactctctgaccagctctgggcctagaccctgactgccagagcagggcccctccataccacatccacgtgccttccatcgagatcctcgtgggctgggttcttgggccttttgtctaatgagggtcaatgtctgtgggaacttcactctagctcctgcttgtggacagggtagacttgcaggttgaggagactgcctagggcttcctagagggactctgccccacgtggctgctgcaggctgggctgcccagaagcctctgcctccactcccagcccatataacccggtttttcttgccccagccagaagcaagccaggttgtgcttgctgggagtacaggcctcctggagcaggactcaggggcctgggctgacactgcccaccgcagccctccctggagcatcagggactcctctaacatcctgcaaacttcccacaccctgccccaggctatgcagcatggcgaattgaggggtcagaaccagcacatctctcagggtcccccttctaaggagacaactaagacgtggaggaaaggcccaccatggagctcttggccaagggcagggcacccaaggggagagcctgtgcatctccaaggaggagcatggagaccatgtgtgcatgtttgtgtgcatgtgtgagtgtgttcagctaccggtgcacatggggaagggtggggtggcgggggaggggtaggtgctcggcagaggagccaatgcccaactggagtctcgtgggaagctggtcagatctcagggcacagggaccacactgggtgaccgccaaggtggctcctctggggtaggcctctgagaagggtggcttctccagctgtggcatgaggcctctgccccacagacggccctgccctggactacctcagggccttgggcccctcccctggctctgccctgtgggcactcaccagcctgtctgcactgccatctccagccccagccaaaccctgacagggcttacgggacagacagaaggacagatggaggaggaggaggagtgggcaacagaaaggcaaggccccctcacccaaagcccaggaaggcagtggaggtctggcaggtggtgaagccaggctgactgcagccccgttcagtggaagctagagggcagcatccctcccgcccacctccctgcaagctgtctgactcccaggctgacaagcagggcagggagggagaggggatagcatgatgcgggcaggactggccctcccagagggtagatgctcagctcacaagagggagctggcaggcccagtgccactgctgctaagagacatcaccctccagggggagggaaggcacacttgacaagggaacactttctctgttccaagactgtatcatgccaccttgaggtgaaaagggaggattagggttgttgcctaagaacagtccccgagtcagcctgaacagtgctctgctgacagggcagggcaggccgggccatctcctcttcattctggaccaccagggtttatgtacaaaccagcttcccagctcagccctgggctccaggacctcggctgggcgtgccctcgccaggaccccaagtgctggctttgccctttaaaactcctcttcctccttggaggccctgctcagaactcagggccctgctcggcccttgtgtgtttctgcttcccgtgtccctaggatcatctcctcctacctggggcagcagcagggaagtcacagcaggttcccccaggccacctgctagctggtggtgtatgcagagcagaaggcagagaaggccctagaggtgggcctgggccccccactgccctgcccctcctgcagccctgtccagctctaccactctgtgggggcctccctcccacacccgacatctcctggagcccaggtcaccccattagtctcactccacaaggccccacgtactcacatcggggtaatagtccaccgtgggaacaaggtgctccatcagggcctccagggacccagagatgaggtgtccatcttggaagatgaggtccccggagccgccaccggccccgcctccacgctcccccatgccaggctgcacctgtccgctacagctgggcccaaggatgctggagaagacaacggacgtctggggcatagtttcctgggagaaaagagcaaggacatgaggcatcaaaggcgcctccacagctccacagaccctcctcccaggcagcctgcagcgtgcatgcatgtgtgcaggggtgcgtggcaggggcgcagcggcactggcagagggcacccccattccagggcagggcaggcgggctccttggtggtcccccagccgctgcacatctgatcactgtgtcttcagctccctgtgggccagacctcattccagggccctggacactcaaagccggcagagaagagaaactctgggaaaaatgtccaagaagggacagggagcctgcggtgggcagtcagggctgcctggggtgagagggctgtgaacaactgatggggctggccgcgcagctcccaggataagaaaggaacaccctaggcatgaggtacagtgagtgccaaggtcctgacccagagatgtgtgcagcggggagctgggaggacagtctgaggactcagggccggacacacaggctgcatgtgctgcttcactgaggtgggagcctggggctctgagcacagtggtctgacttacggtggctgccacgtggatggtgggtcttgccacagcccaaggagagcttgctcaggcaggcggtagcaggagtggcgagcagggccactccacatggtgaaggtcttgggccaagtggctgaccagtatgaggcagggctgtgggcagggctagagagagatctggaactggctttggggcctgtgagtctgagtgcccctgagctgcagatgtctgagcagctgggcctcctggaggcctcggtgcccacactgggactgtcctccacagcatggcccgctgtgatggggctcagggtctcaccacaccctgcagctgggagttcttgtgaagcctaggggagtctgaagccctctgggcctgtttccccagtgccccagacagccagccatgcctgggaggagccaagtggggactggacgatgcagcaactgccagcctgagggccagaggtggcctgcctgtggccttgcctgcacacagagccagcctcaacctcctggccctcaagggaaggcagcacaggtgccagcggctgaggtcaggtggagaagcgagaccctcctgccattttggccttagtttccccactgcacagagcaaattgttgccatgattacttcagtgccatgacaggaccgtgggcctctgccctgtaggggccttacaaggagagagcggaccacctgcccacaccccccacgtcaacacacacacacacacacacacacacacacacacacacacacacacacacacagcacgtccctgtccctcccaccagggaaaaaagagcatctggcccagacgtcactggttttcccaccaaacacctaaaggtttccttggaattcttagaaagtctttggcaaggagagcaagaacgcaaccaaaggccccacgatgacgctgggtggaatgtccaggcccccaggctcagtgctgcccccactccaggacagggaggtcatggctcagactcatacaatgctcccttcaaactcaggccagcagcggtgcctcacacaagttagaatgcacattctcaggcctagccccagacctgctggtcagaaactctggggtggactgcttctgtaccccaacgcgctctccactccagcccaggaaccactgatgtgagccaatccttcatttttcagatggtgaaactgaggcccagtgggaaggaactcaactaaggaaaccccaggagttccaagtccagcctaggtgtcaccacctccaggaagcctccctgggtttaacctagactgttgacccacaaagccagaagtggctgtatcattcacctgtgtatcctatcgctggcccagggtggcactcagtgaccatttgtgcaatgaagtcacgaaggcgggctcacaaaccccttgttgcccacagctgctcagcactgtctcaggcatctgaggccaatgcactgtgggacaacctccccaagatcacacagttctgggttcaaaaggcgaccagcaggtggtaaccttggtcagttgggcctcctcaccccaagctcttggggtcatcagagagggcatttgccgagccactggcctctcccactgcaggctgctctggtcaggaggtagtatgtgggggatgcactctgacaccccacaaactcagccccagccgatcccccacagggcaaggccactccatgtccagcctgcagagagacctgcctcagtgctaggaggcctgcctaggagttgaggagccatcctggggacccagcccactggtcagcagccagagaggggctgggaaggccacgccttcgagggtgggggcctggaggaggagcatgcaggggtgtcccaggcaagcagaggttctgcacatgctcagaatccctttggggagtcagcagagcctgagggggaccgtgtggagccgcactgacctgagaggtggggtgctctgggttccttctgtcctgcctacctggagacccacctggggacacggcccagggctaggtctcctgcatccaacaaaccaagaccctgcaggtctgggggatgccccatgagcccctacccccgaaagctcaaacctagcagggcccaccctgcccagccacggagcacttcgaggagggtctccagggctcagtgccaagtggagaggcaggttccctacatggcttttcccgggcaggaatgccggccctgcagcaggcccactccttgttcctgggtgcatctggccagccctccaccttcccagctgtgaaatggtgatgatgacagcacttccactgcggggtcccctgccggccacccccacccagccctgaggtcgcttgttcttgcacctgcttcctccttgccccaacagcaggggcaggcacttcgacaggcagctgcaaacctgtgtatctgaacagctgtgtccaccaccaggcagccccttcccaaggaagaattgcacactgggctcttggctccagtcacagcaatagccatcatgatacaccgatggccagggtgctgaacactgaaaaccgcaaggctacagttgaagaatcccagttactcttcccagtcaccccctatgctcccagagaacccgttattcccttacgcagacgaggggtgagtacctgccccaggtcacagccagagggcaacagtgccaggattcatgccgagcaagcagcaggggtaggcagggagcccaagtccgagcctggctccaccacctgtcttggctatgtcaagatcctcaaacccttggagccttaacttctttgtctgtaaaatgggcacagggagcactacttcagaggtttgcagggaagatcagaggagcccctgtgtaaggtgctgggcaccaggtgcctcctcacccccaggagctgattcccaccagcatgattgctcagcacccctacagaccacacaggaggcactgcttattctagacacactggccctttgtgtttgggcactgtggagagctcaggaagcccccccaccagggctaggcagagatagggctgtggcgggccagcttgctcaaccagcatttgtgggaaccatcacctccaccccaagtccagctggggctggcctggacagagcaggccaccctgaccccagagagccagaccctgcatggatgctctaaggccaggtgtggtccccagagcaggagcagtaccttctcctgagccagaaactggtgggagtgggcccagtgctcccctttcaggtagctcagctgcacactggcgttctagacccttcccctacagcctctcagttccaagtgtggccgctggacctgcagctaaagcatgacctgtcgattgtcaaagagcagatctcaagttccaggccaggcctgctgggtcacatctgctgctgagcaagacaccaggtgaatcatgtgcaggtgaatggaaggcccgggaagcccacctgtgtgagaacctcagcctccaggtaagctgcaccggctaactcagagcaggggcctggtacggaggctcatgcctgtaatcccagcactttgagaggccgaggtggatggatcgcttgaactcaggagttggagacaagcctgggtaacatagagacccctgtctctactaacattcaaaaaaaaattagccaggtgtggtggcacaggcctgtggttccagctacttggggagctgaggcaggaggatcacttgagcccaggaggttgaggctgcagtgagccctgatcacaccactgcactccagcctgggcaatggagccagaccctgcctcaatcaatcaataaacaaaccagggcaggccctcagctgtagtatgtgcacaccagcaccatgtggggatttttcaaagacaccgtgcctgacccctgcctggacaactgatttaactggtctcaggggcaggagaggcactggcatcttccacagacttccaggaagcacggggagcctctctcctgcctcagctgctcctggctgcaccagacccatctcgaggcagcagaccctgtgaagggctcaggaagcaccctcctcccacccaggatgtaggcacagacggggccggggccagccagtgtgccagaccagtctctgtgggaaccctcacctccaccccaggtccagctggggctggcctggaagagcagcagccccttgcagggagtgggggacaggcttgcacccagtagcccctctgactccttggagcagcagccccttgcagggagttggggacaggcttgcacgcagtagcccctctgactccttggagcagcagctccttgcagggagtgggggacaggcttgcacgcagcagcccctctggttccttgcagcccctcctctgttcaggcaggaaggaaagcacctcctaattatagagctaatcaatgcagaagaaacgtgcttatagcaaagcagagaagagtgactcactgtctcctggaggacgcgcctcactcccttctcacctcccacgcagggccggtggacacaagggcagtcccaggggcccagcctgctggtgagaggggtgccctcttccatcttggaagagagcagatttccatacctggctttacttggctctctgggggcaccattcgagaagggggtcctccctgtatctgagcctaagtcttcctggctgggcctccagggtcacacccctgacctgcacagcctcagcagcactgtaggaggcctggagtggaggctgcctgggagaggctgaacctagaggccccttgccacctgcctgccaggatgcgctgcagcaggacagagggcaggcggcagacaaccaggcacagggctctccccaggcctccactactctgcctcattgtggctatcccagccttttcaggcttggcccaaggtgccccacctggcacatatgctgctgtcccccagaggatgaagtgactcgtggggtcctgctgctgtccctccttggtctgccacaggtgataccatcctgagaggccccccacagctgcacccccagtctctcatgcccttgtccacacccccgcacacctgagtcctttcctgcagttgcagatcctgggcctgggactgcatgccagagaacaggctctgtccccacacccacgggaagcctctgggtggccctaagcctgcttcctcggctggacactgggtgtggaatgtcttgtcccacctccctgcagggttgcagtgaggttgaagggagagacggaagctagtgcggttgtgtgcctggagcagaaccaggtatgtggttctgtgccacccacatctaggccttgcctcaatggtgcccagtggcccagtgctgggtgccactgcttctgacctgtggcctctgacctaggcccttagggccatgggcacacaccacaccgccagccctgggagaggttggggctggggcaggttaacaccctgtaggaatcctcaccccagaggcactgttttgagacacagaagtttcacagagcctccccagagatgcctgggatgccagctgttgttggaacacatcccggcatctctccactcgctcccagcctcctgctgcccgggactgtgcttcccaataaagcgagcacagccaacatttccgtgagctctgatctcaggtttaagatgggctctgagaccttgcaccccgccccatggagtgagtagggtagaggaggggctgtcatctggtttctcaaccccctctgactctagaacagccacgtgctgatggcgccaaagtgccaggaggggagaggccaggagcctgcatccacatgtgggccaggcctcccattggtggtcggcctggggcagttcctctgtctgtgtgagccttagtggcactggcacctgaacctcatggtggctgtggggagtgcggggtggcagggagacacatggagtgtggcttccagcccagcacaagtgctcacacgcagggcgtgcttcagtgcaagtgaacactgctcctggggctctgctcagcctgggtgagggactgtgggaacacagccctggatctccaggaccttttccagtgggtacgttctggagctcagcctcaatacacctcaggggagaggcacttttaggggacacagcctaaaactttagcttctgaatattcacagctccccccacaacactcacacacacaggttcacacaggtgcacacatgcacacacaggtgcacagaccccttcgcaccaaggaatacactgtgccaatcacacagcactgagagtggaggtcactatgttaagtggagcaagccaggcacagcaagaccaacgctgcatgttcccactcaggtgggagctgaaaaccttgctctcatggaggtagacagtagaataatggctaccagagggcaggagcgggaaacaaagatagcttgggcaaccggtacagactcacatttagatagaagaaataacttctaatgttccataacagactcaggtggctatagtttgcagcaatgtattgtatacttcaaaagagatagaagaaatgtttccgacacatagaaattacaaatgctcaagatgatggataccccaaataccctgccttgatcagcacataacccatgcatgtaaaaaatacatgtaccccataaatatgtaaaatactacatatgaataaaagaaaagaatagcttgaggagaggaaaaaagcatagagagcaagaatggaagtggctagactgagggtccagggtgagaagaggggagggggcagccaggatctgagaaactttccagccttttaagaaagtaagaggagggaccctatgtagccccagtgctatgagagatcctgggagagagaggaaaagggaagtttttgtgaaagagtacgaatgacattcctttttgcagcctcttcaaggacgttggagagttttttattgttttttgttttgagacagagtcttgctctgtggcccaggctggagtgcagtggcacgatcttggctcactgcaacctctgcctcacaggttcaagcgattctcctgcctcaggctcccgagtagctgggattgcaggtgtacaccaccatgcccagctaatgtttgtattttttagtagagacggagtttcatgatgttggccaggctggtctcgaactcctggccagcctcaagtgatctgcccgcctcaacctcccaaagtgctgggattacagggtttagccactgcacccacctgctacccagctatctaatgtgacccatgcccgtcccccaggcagcacacagagagaggccatctgcctctggcctcatgtgtgcaaaagctggatgcgctcctcgggaggggcagccacacagtgtgtacacctttcctgagctggtgcacagtccttccctccattcaaactgcagccatggactctgagaccttgcaccctgccctatcacccatgagctcctgagagctgcagctacgatggaggcccagcagctctgagcccaagcctgtggcctcactgcagccagagcctgctgtgcgtgtcgtcttcccgtgcacccactcatgtgtccaggcctgggcagcagctgggtcactttccactcccgaatgttctttctgtgtcctgcactgaggatgcccagtgatgaggagacccaacagagccacaggaggcttgacaccaccgtggcctcataaaagatccccagggaagggggacgcaggggtcagtgagcattcacccaccccgccccccttcgtaggtgtgtgcacagagcacaactgtccagctccccaaaaggggctatgggaggagcatcagaaggtggccctatggggtaactggccatcctccaacaccaccagccccaccacagcagagagtaggaacaacaggccaggaggggacagagtctcctgcacagctggtcaggaacagggtcaggcctccgttcaactccaaagggaagagcagtataaggcaggctcctagcacactgtcggaattctaggaccccttctggatcctggagtctgcagttctggaaacttccaaagcagggattaaccttcacttgactaaccttgctttgctttaagtgtgcatcgttaggagttagagtgagctgtgtgctggccattccatgactcatctcaatgcaattctccctcacccagggagacagcccggagaggcccgtttctcagatggggacactgaggctcagctcacaggacccaagaggccgtaatgtgcaggactgcccaggtctgccctgctgttcctcggacctcagcattgcccctgagagcacctggcaggggcatggccccctgagcatcaagtgcaggctgaagccctggcctggacatgtggacaagcacacattcccacgacctgcagatgattcgggggaccgatgagctcccagaagctcatctgtggacttcaaattaagaaacccagcttcctggaaaactgggacaaaaacagccctcagggcccatcatgcatgagtcccagggatctgccaggaggtggaggaggggttcgagccagccccctgcctctgccagccttggcagggggcttctttctgaggcagcacgtgggcttctattttttaacctactcaacaaaaacggagactatttttagctcagcaagctgcagggcatcacaattagcaactgaaaattacacatctcgcctgtctcccctctcttggctggcagggagagcgtgctcctggagggagctgggggcagccctgtgccatgatcctggtgggcctcaggaggggagagacctgcgcacctacctgtgctgggctggatgcatgccacggacccgacagaatgggctcttcgcccttcaagggataaccggccagttctctgaaattaccggcactggggtggggaaggaggtgggtgttcccggagccctattctttgcccattcattcattcacaagtggtaatgatccctgcctagatactggagatacaccaggggaaaaaaacagggttctctggccccagagagcaccccacagagcctgtgtggtgccacgcacaacggccacagatggcgacatgatattctgggttaggagagaatcagtgctccgacagaggagatggaaggtcaggaatgtgagtgggaaagcggtaacctctgcctgggcggtgaggttggcctccctgtggaggtgaggcctcagccgactggaaggagcttctgggaaaggacgagcagagtgagtggacagaagcgctggcgccaaagcctgggagcttttggcccattagatctctggcaaaccctccctggggcacctcctggctgcctcacttactccaaaacatgcactgactgatgatgtgtgtgtcggccttgctaaacctggacctgtgatgtgccaggatcagggtccccagcagtgccaggctgccccccaacctggcctggtccccaccctgccaggagcgggggcgctggagccaccagcaccccgggcacatcccaccaccaccgccattgccatcggtactcagggtctatgcctacagtgggtgggccgcctgccccactctgtgagggtctgggctcctcccaccaggacatcgggaatgaggctcccctccccaggaggctcccccaggatgcagcaggtgattcctggtttccttgggggaccatcttgtgggggtcctcaccttaccctgcggggagggctcagcagggagtcaggcgcaatttgtaagtgaagtgcttgtttgagtgtatgggaggcaggcaccatgattacaagattccccatgcaaatgcacatcttttgctaaaccttcagtgggccctttgccttagtgaggattttgcccccctcctggatagtagacagtgctaggtagcccgcccaggggctgccccacccagagaaggccgttgggatgtggcagtgggccacgtcacagggaagaaactgcccgccttggggagggtagagggctgagtgtgcccacttggcttgaagactcagccaccctcagggaggaaagaaggaggggcactgctcctgatgggataagaacctgcatggggtggcagaggagggggaaggaggttaggggcctcctcccttccacccagcatgcagcaaggacagacttcaccccatctccctcctgagctccatcaggaccggtcagatagtggaggcagctgcgcctcctttgccgctcacccttcccatcttacacacccttccccatcttctgaccctgccagtccagagctgcattctcagaccagtaaaaagagccctccgggatcccacctgcactgagaggcatcgtggagggggagaaatgaggtaggggccacccccacctactggatgtcactcactggcaggggagcacaagcgaggggagccgatggcctgcagaagacaatggggccactgcaccctcagctggtggagcgtgctgggacccgaccctgagggcaccaccccagcatggggctgggggacctgtatggagctgagaggaggagtgcctgccccaggcagcccccagtccttccatccccctttggctcccatttctctaacacccctgtcctggtgacatgtgtccctcgctcatgctccctcttcccacgccagggctacagtgctctctccaagctggtgctgcagtcccaggcgctggacgacccgcctcagcgcctccatccccactgcacctaggccctcccagctctgtggaagaaggctgggtgaccagccactgcccagcccctctaccacacctaggtcctcccagctctgtggaagaaggccgggtgaccggccattgcccaacccctctggacgtcatctatccacaatgtgcaggcaagtgacacctgcctgggagagtctggggcttagtctccaccatttctgagattctagtgcctgctagagggactagagccaggactctgactctgcccaggttggccccaggcctgccctcaacagcaggtgcgccacatcagagccccttcccacaaccgggctgcatccacctcctactccctgacccagggcaggaagggttctcccccaaccacccagccaacactcagatgtcctccccatccccaaatcccagctctcagactgtcctgactgagctgaaacgtgtctcccttaactccagggagcccttgtcccatctgctgaggccatgcacagcagatgggcagggggcagctgcaggcccaggctggatctaggcatgggctgggcgtccaatgggaagggagtgggccccaccccagctgggagccggcaccctcctctgtgagatgccacctccagcacctgcttcccaggcgaccgtgagcactaagtgaagccacaaagctcaggacaggctcaatgcctggtgggttctgatggcatcggcactgcagagcactagcggtcctataggtttcccagctgcctccctagacacacagctcttgggagctggtgctgccccctccctcatcccacttctgggtccttctcacctcccatgcaagggacagccagtgcacctgctgcagacagcaacaagtgaggagaagctgcctcctgcttctaggcaggtggacccgttgacctggttgcactgtcctgtcccaggcatgggggactcagagctggctctggtctagggatggggggcgttgggggtgacactcccctgcaggtcaggctctccagtcctcaccctcctctctctcaacccttgttccctctgcagcagcacagtccttgggagcacatgctggccccattcctgcagcagggcagggaactccctgcagcccctgcctctccatcctccaggccaggcaggcatcagagggcaggggccacgctgtttcacataagccaaacttcaagtactgcgaagaagggccggatttacctttgtgaaccttccgggctggccagggcagtctcagggcctggccaagggcctcaggccggactccaacaaggaggcggctgccatgggaaccagcacgacagcgcctcacagggcgcccgctccagaggcctggccacaggcgcgacgcggataattaaagctttgttacagacacatgattcattttttccttctgaattcccttctattacccaatacaatttgaattgactgaaggaatctggtcgtctcctcttcacgctcctcagattctgcccagtctgggtttctgcctctcccttttccctttctgtccagtcagcttcttctgggcctgctcagggcatagaacatcattgtccaccaagaaccattccattcttgagactcaagaggcccaaggatgcagcaggtgggacttcagagaatccctgccctttcccggcaggcgctggcagcctggcctcccactccagccgcctggggagccctgctcccccctccccttggcctcgctccctcttcggccaacgccatcagattctgcaggggtaacgagagcctcctgtagatgggtgggcagccctgtgcctcccagggacagagctgggcacaggcttggatggggtcatgtgcaaactcacgcaaccttggtagccagttctgtcctttccagggagacccctagggtgccacggaggagggggctgggaagcagtgtgcagattccaccccaagtgaaatcacccctctggggtccctgtcctagatgggttgtccactgatgatgacaggacagagcagggtgtcctgctgctcatcagttctgggcagtggccagggcgcctgctggctccagtaggaaggcaccagcaatctgtcctgcccaggcccacccgggcacactgcccacatccagccagccctggagtcagccccgaagcagcagcccatgaccaagagagagggacagtgagcgggcagggtcagggctgagggcctccagaggcaggaagggatggccagccgcgtaggccacacacagacctgtcccgggtgagctgcacctccgccctctacagccacctagggtgctgggatatggaataaaagacatatggttcttttacttttaaatgataactaattacgctgagcaaagatttttcctttgtgttccaaaacaaataaaaatccatttccctcacttgaattgtcctcctggcagatggctgtgggagcagggagctctctctgggccagtcatgggggtaggggaagggggcacccagccccctgctgggtcacagagccatgggcatgctcagtctggcagcctctgggaaacagcacccagacacacgtcctgactgccacccccatgccgtggacacaggcagctcttctgtcacatgctgtgcgtctgtcccctggccctgggggctggtaaccggtggttagacactgaccagccccaagagtaccagtgcacaggaatgtgtaataatgtgttgtggtccttagggtctcaaaataaacggccaggcacaatggctcacacctgtaatcctggcactttaggaagccgaggtggaggatcgcttgagcccaggagttcaagaccagcctgggcaacatagggagatccctgtctctacagaaaaattagccaggggcagtggcatacacctgtaatcccagctactcaggaggctgaggtagggggattgcttgagcccaggaggtaaaggatgcagtgtgccaagatcataccactgcatccctgggtgacagagcctgggcaacagagcaagaccctatctcaccgggtgtggtggctcactcctgtaatctcaacacgatgggaggccaaggcaggcagatcacttgaggtcaggagttcaagaccagcccgaccaacatggtgaaaccccatctctattaaaagtacaaaaaattagccaggcacggtggtgcacacctgtaatctcagctactccagaggctgaggcatgagaattgcttgaacctgggaggtggacgttgcagtgagctgagatcacgccactgcactccagcctgtgtgacagaacaagactctgtcttaaaaaaaaaaaaggggggggagtacttatgacaagtaactcagcttagagtgaagttgctgagccctcagagtgattagcataggtgtggtggactgcaatgatcagatgatatctgctgtggccaggcatccctgagacccaacaagaaagtgatgtcaaaaggcacctgaagatgatggccagggacactcctgcggagggccataaatacaaagaagctgctcatgaccaagacacctgcagaagcactgccctcgagaactccgaagcctcttttccattggaggccaccagacgccctgctgggagaagaggagtgatcccatccctccacccgggggtctgcggtccctctgctctgaaggaacttggaccctgggcaatcagcagctggtctccccatcccccgacactgtggttcgctcccgcctctcttatgactgcctgggtgtgtggaatatatttgcatgattgttggggtgtgaaaacgtcccaataaaccatgaatttgtaagcatttaattggctgctgagtcatcctgaaacctccccacatcagttagtgccaccaggctgattcgaacctaagccagacacagccgtctccatgcctccccagggtggccctcctgctgctccccccttctccagatgaaggaacagaggcccaaagggcctcagtcaccagcgccagtctgggaaactggtggagctgggattggaaccctgtctgatgtgctacccagggcaaccagcacagggctccggagaaggagaatggtgtgaggtgacagcagggggagccagccaggcctgtgggatggacagggcctgacccaggaggagctgcccctgctgcatttgcaggttaggctgcaagcgcagggcagcgaggtggggtgggggaaatcaggccagggtccaaggggcccgtgctgcattctagcccctgcaaaactgcccacaagcctcaccaccaatgagtggcgtaggcagagggcctcccacctgctgggccctgtgacaccatctgggggcctctgaggccctgctctccacttcccagatgagatacaggtgtggggctgaggacagggcacagctggaagccgcccaggcctcctgcctgcaagttggcccttcctgtccgtgtggcccgggcacatacagtcatgcgtccattcgcgacggggatacctcctgagaaatgcatcttaggcgatttcgtcgttgtgcaaaccccagagtgacttacacagaccaggatggcacagcccactacacacccaggctccgtggtacagcctattgctcccgggatcccaacctgcacagtgtgtgactgcactgaatatactggaggcaactgtaacacaacggtaaggatttctacagctaaacatagaaaaagcacagtgacaatatcatattatgaatctcaggggaccactatgtggtgcatgacgctgtcttttttcccagcacaccctcctaacactctcagaatctccaaagtggtaagtgtcttctgtgtgctgatggacttctggacagcctggctgggggctggttgtcaggggaaccaaccatgtgatgaaagggtggggactttcactcccacccccagctctagggacaagagagaggctgaaggttgggtccatcaccaatggccaatgattcagtcagtcacacccacataatgaagcctccacaaaatcccaaaaggagcggcttcagagcttctgcgtaggcaagcaggtggagggccctggagtgcagtgcctgggaggacagggaagctccacgccccttctcacatgccttgccctgagcatcccttcctcttactgttcatctgtgaccactgtaaaaacctgcatagtaagtgggtaaatggaagcaagtgcttccctgaattatgtgagctgctctagcaaattaattgaatctgagaaaggagtcccaggagtggtgatttgctgggtgggtcagaagcacaggccacaacctgagacttgcaaatggcatctgaagtcgagggagggggacagccttgtgggaccaagctctcaacctgtgagatctgacttcgcctccaatattgtccaaattgaattacagggcacccagctgctgtcttaatgttagagaatctggtattagaatgttgtgctaaatggctgagagtggagagtaagaaaaacactttattggttttttttttataaccctattagaggtaaactcccaagaacacaaagctatgcccaggaaacacagtgagcacctcttcatgctagattcacaaccagaaattgcccagcaagtggtagatgcccaagggatgaaaatattgcagtgcatgctctctggacaggggaccaagatatgtgaaaaactgtgtctagaaacagaaaggcacattctactgtccagagtctctgccacatggtcgtatgttataccaccaatgaaacccagtaaagtccccaaatagaagtgtgcaggtgagagaatgacataagcacaatgtactatagttggatattaatatataactgataaacaaaatacccacttcataaaaaaaatccctaaatcacacctgtgttaaagattcaaattccaattacagatgtcagaaaaataacctttataggaaaactctgtatcgaatttgatatggccaaagctgtactcacagaaaagttcatagacttcaataatgtattgaagtaaacactaagcacttgattcaaaaagcttaaaaaagagcttctcaacaaaacagtgaaacaaactggaagaagaaactactaaaaagcaaattagatgacttaatcaaagaatagagtagaactccttataaacttcaagagctgattctttgaaaacacagatttcaaggataaccctcttgcaattctaatcaacaaaaggaaagaagaaagggagggagggccaggcaccctggatcatgcctgtaatcccagcactttggggggctctagtgagaacctgtctctatttctttaaaaaaattataaaaatttattttaaaaaagaaagggagggagagaagaaggaagaaaggaaggacatgaaaaatacattgggcatgaaaaaagggaatctaactccagatatgtagaagaaagtttaaaacaaacaactacctaaatctgtggtaaatgatctgcaagaacttttaatggttacttatattatctagaaaatataagtaaccaaaaatagagtaaaactgtttagaacccaaaaagaccaataaccatagtacaaattaagttgagagccaactaagcctctggaaaaaataaaagaaagccctggctgaaatagtttctaaaatgaattatttcaagcctttgaggataagataattttatatgatatataaactatttcaactacacaattcatattgaaaagccttcctattcattttataaagctaaaatagcatgatttataaatgtgacaaatatgtctcctagtagaaaagtatgcataaattcttacctctgaaaatagtgaaaaataccctcagcaacatagcaacacatcagtaaaatgaactcagcagcatttttaagcacaatagagcctgacccagtgggctttattccaggaacaagaggatgatttagctcagaagagttaataagtcaacacattaataggtccaaggaggaaaggcatttgatgattttgctagatataggaaagcctttgatgaaactgaatatccattcctggtgtgcactcttggcaattaatgtaggattccagcacactgtccttgatgacgaatacctattggaaatatgggccagtttcagacttagtaaaacatgaaaagcctcctcattaaaatgaagatcaagccaaagacaactgctattatttaatgttactttgcaccttttagaaaacataataagataagaaaactaaagatacattagaaataaagaagttggctgttccttatgtgtaagtaatataattaatttcttggattttccaggaagccaaactaaaaatctgttcaaactagtaaggtatcaataatcaattacctaacataaacttttaaaaaatcaatagcttacttatctacctcccctgggcatatgtgtctgcccataagtctgtgtggagctgttacagagatgctcacaccagtggcagtaggggaggtgtgtctgtgtgtctctgtatgtgtctgtgtgtctctgcatatgtctgtgtgtctgtgtttctctgtgttagtgtgtctctgtttctgcgtgtgtgtgcctgcatgtgtctatgtgtgtctgtgtctctgtatgtgtctgtgtgtgtgtctttgtgtctctgtgtctgtgtgtgtctctgtgtctgtgtgtgtgcatgtgcctgcatgtgtctgtgtgtgtgtgcatgtctgtgtgtgggggtctgtggggggggggtctctgtgtctgtgtgtttctgtgtgtctgtgtctttgtgtgtgtctgtgtgtctgtgtctctgtgtctgtgtctctgcatgtgtctgtgtgtctctctacgtctgtgtctctgcatgtgtctgtgtctgtgtgtgtgcctgcatgtgtctctgtgtctgtgtctctgtatgtgtctgtgtttgtgtgtctctgtgtctgtgtgcctgcgtgtctctgtgtctgtgtctctgcatgtctctgtgtgtctgtgtgtctctgtgtctgtgtgcacctatgtgtgtctctgtgtgtgggtgtctgtgtatgggtgtgtgtgtgtgtgtgtgtgtgtgtccacggatctctcagctctctaagctccactaccatcccccaggaacacgatgtccacagtgggcctgctctgccaaccagctcagctaccctgaagccacttttcctggtcacccacccaaaacaccacaccactgccccctcaggctgggcactctaggaacatgccagtccctgttttaaggacatctgttgtatgtggccccagggaggtccccagagaagtcatactcaggttggggccagagttgaaggctgagcctcctcacccacggggagggggagagagaggagggcggcgctctgacgcatacttaccggcccaaggctgggcaggggtggctggcggcagtcacagtgacatttgggaaatgccaggggctgggtcccagcccggaaggcgggtgtgggcggtgacaggggtgggggctgggttattccccgaggctgagaccacaagacaccagctttgccaacaaaactccacttggccagtggtgccaggggccgcagggccagggcccagccagcagcaggggccagaagaagaaacagagggccaggttcagtggctaatgcctgtaatcccagcactttgggaagccaaagcgggcagatcatctgaggtcaggagttcgaaaccagcctgaccaacatagagaaaccccgtctctactaaaaatacaaaattagccaggcatggtggcacatgcctgtaatcccagctactcaggaggctgaggcaggagaattgcttgaaccccagaggtggaggttgcagtgagatcatgccattgcactccagtctgggcaacaggagcaaaactctgtctcaaaaaaagaaaagaaaagaaaaaaagaaacagagaagctgaggggatcttggctgccatcctcctccgagatccacgccatccatgggctcccacctgactgtccccgggttccctcaggagcccccacgcctcgtgtcccatctgcctctgaactcccattgtcctggaacccacagggacccaggcagcccagaacccacacagtggagccctcatgacccaggaaccagctctgacccctgacctcctggctgacctcaggcaagacacagcccctctggacctcaatttccccagatgtaaaacaagaagtagagagcctgtacaggccacttcccgccctcatctttgttccttcctttcttccttcctccttccttccagaacttgttcagtcaagtcagcatcccttgaggcctttgtggcctatgccacacactcagaacggaacagcccatggaccttagtgtctgtgggaagacagacacaactccatggcatggcatgatctcttcaggattgggggtctgtgccgggtgtcgtggaggcacggaggtggggaactaactctgtagggagtagtcagggagggcttcatgaaggaggtgattctgagatcagcttccaaggataaccaggggttttccagtgggttaagggggaaaagggaggttgacatgacagtttggtctccttcctctggtcactcaccagcagttccctggagggcgaggtccaagagcccaaaggtgtgggagatgcaggcagcttcccctgcactaagtcaatcctcatgcatcccaccaatgccagtgtgagactctctcccccaggcagcccttcctgactgcctgcccccccgacagatggcactgctgcagcccatgtgtctgtgagtatgtgaccctgggttgtgctgtccccagtgccccctgcatcctggccaggcctggacccccaatgcacagaggtggtgggctaacatgagaggccatggctctgctctccttcccctggcctgtgccccgctgagggctagagtcctcatcccacctctcctggggaagctgaaagaaggtggctcaagctagcaggcccagcaagatgggctttgggcctgggaaggctggggcccagggctgtactgtcctgagccagcaggtgcaggtgtgggtagggtggccaggaggcagggcagcaaggagcctgcagggtggagcaagccaggctctgcatgagcacatgcagcctagacctctccctggactctagactgcccacaccactgccaggcaacacctctggggtgggaagtgttgaactgtccctgctcccacctgctgtgcctgccatcttgcccacctctaagggcaacaccctccttcctgcgccagcctgaccttccccatctcaatgaaaacagcctacccaccagcacggcctccaggtgttgccttcagaatacccccagaatcagtccttccctcctcctccttctctgccatctcccaaggctgggattctcatctgtccccggaccactggggtggcactctgctagcttcacccctcccagcagcagccagcaatgccatggcagccccacggggagcacatcctgctccaccacctcccactgcagccccgtcacccccactggctcccccagccacgccacctcgctggcctcactgtcccacctcctcttgggctctgctcctgatgccccagtctccaatctggccccaacatgcaggcagcttccacttcaaagctctgccctggccttttcctggtatgccccccgcatagctccctccctcccctccttcagcaggtcctgtgcacacgtctcctctggccaccatacctaaggcacagacagccccctccttcactggtggtcagcacgctgggcaccaagtgtgtcagacccctggttgctgggggagcaggactgtcattggaggtccgaatgaaacggggtggggccgtggggtccacctgtctcacagcagtgactggagtactgggctggggcatttaaatgccagtgcagggccctccccactcccctactatgtgaccccgtcagcctgggtccctgaatgagggtggcctggaccagggctgacaccagtgagtggaaactgcaccatgttgtgagctgagggacttgggggctgctctatcgctgcagaatgacctgaactaccctcaccgatgaactcctcacaggccctgctagctctcctacattgcttcttctctagccctcagcaccaggtagcactccacccattttacctacacattgtgcttgttcctctgctgtgtgggcaccgtgaggacaacactctccgtgctgtggtgtttggttccctgctgaaccgcagtgcctgcacacagcaggggcccgataaatgcatgctgagtaagtgaaagaaggaagggacagatgagtcctgcatctttcacgtggccagggctggccggggctcagctccacgctgtgggcactcagaacccagggggctgccgcacccgaatcacaccgccttacgcctctggggatgggtctccataaacagcgtgggaaatgccagtgctccatgctcaggtcctctccaggaccagttctccgcctgcaccctacagcgccctcgccctggagcgcacactcctcgaagccccacggtgggctccactctccctaaacgcacaggcgcgcgtggggctcacaaggcacaggcacggctgcgctccctcccatgtgccgtgaataagcgcgcccgcgcttccgcagccctcccccgcctgcacctcacacagaccacacaccgcggaccacccctcgcccggcacatcctcctcagagcaacaggtggttctgcgcccctcaagtcgtccgggctcctacacgcccgtccccaccccttccaggctcgcaggagccactgtgctctcggcgtccgcgggccgcgccgcgaagggcagggcaggagcagaggcaggctgggcgccgcccaccgggcagtaggtgctccagcggggacgcacagagggcggcgcgcgggtcctcagggcgggcaccctcccgcacgggtcgggatgcaggggaccgtcgcacccctcccgagcccgacagcgcaagaaccctgccccgcggccttgcgcctgggcccgccgcagccctacctggggctccaggaacattctggccgccggctccccgcgccgtcctgcccggtccggcgtccagcgagcggcggctcctctgcccgcgagccaagcaagcacccactcctgcgccggcccctgccgctggacgcctccgctggaggggtgggaccccggaagcagggaaccgaggggctgggctggggaccgcggggtccgggcggggcagaggggccgcgaggccggccaggaacgcggggcggggccgaggctaggagcatggcgcggaggtggggcagggacccggggcggcctggagcgctgtcaggaggagctgcctgggccgggcgcgcgcctggcgctaggtgtgggggcgccgtaggtgccggggtgtgaggctggacggggcgtccgggatcggccgtgccgggggtcggtgctggcgcgcggggccggcgagggggcgcagcgtgggtcggggctcggcgcgggaaggggatgcctcttacccggccccggcctcacctgatcgtagacgtccactacggaactacagcaggtgttctgccagcattcgacttgaatgccttccctgacagggcgctcactccacacagctctggcctgagacaggcgtcgcacagaactccctgtccttccatttcattggaactcgggggacacggcagctgcttttgtgggagggctgatccgagccgcagcgaggggtgggctgggcacatggcacagtgaggctcctcccgcccccagagccccagcctcagaaggaatctgccaggtgatggggctacccctctgcgcattcctgtggtggaccccactccctcagatgatgcggacgggaaagatgcgcggagccgaagagcgccctctctgggggtctggattggagcacccagcacctgagctgggtgagagaccccttgggctctgggggagtccgagttggccggcggggcggccgctagggaggagcagggtatgctcagcttgaacctcacagagaggctctgacaactctggagagctctcaagccacgggctgatggacaatcgtgaccctgacaacatctggccgccccaggatgcccataccctcaccccacctccacccccacggctcttgcccaggccttgccagaggccctctgcctcccagcttgtttgcctgctcacttactagcagcaagagtacctactaggctggctcgatgggcagttgtctctgtcttgggaaagtaggggctgtgctgggttcattcactggcctccctcaagccagctcaagggcctggagacaggagtccttctcctggagtgctgccctctcaccagctcttctctaccagtgagtgttggcctggcctggaaccgcttcccactgctcagagcatgcactatacattactgcgtggtatgcagcgcctgtgggtgggcagtgcggggagtacgaggcaaccaggcagaaatggcacagtggccctccagctttcacaatgtcctcccccacttttgcttctgcatcttgtttcaggccagccagaagatgcgaagctcatggtgaccttggcaggcagacaggtggcatcaggatggtctgggcctgcagggccaccctgtcccttcaggtggcttcatggagagcaccaagaaggtgaaacctggtgtcttgcccctggggaagccttcgaggcacctgcccctgccttcctcagccctgtaccgtagccctgcagaacatctgggccctggggtggccccagtgttgtctcaggaagtccatgtgagcagttggccctgctgcctcctgaccccagagcaagcatcccctctgcctccctgaatgtgacactctagaggaggtggtggatgggtgggcagccccacaagccttcttatgcagtcacagggtcacttcctatcacgctcatcccagattgcaccagtgtcacccaaggaccttgataaggcagacgcttccccgggaggaatggggcccttgcccccatctctggctgacacagatggtgctgtctcctttacccaccagtgtgatctcagcattcatgtgtgacctgacccacatccttcctggtgcctgaggatgcgaggaggctgctatgctggggctgagccctgccaggcgtcctgcttgcatccctgcagctggggctgaggctgtcctgcagggagggctggtgggccctgaggcagaatcccactgccacttcagaaagtagagaagaagccaggtgtggtggggccagtggccatctgccgggacttcagggagaccagacacacaggaagaggcactttctccagacacctcctttaggggcagggcacaaggcctggaacaaggctgcctctgaccagagcaacagagcctgctctgaggatggcagagcctagagcaggcaagctgtcaagattctgggttgagggtcacaggacaggaggctggactcccgctgatatgatttgggtttgtgtccccacccaaatctcatgttcaattgtaatccccagtgttggaggttggaggcgattggatcatgggggcggagttctcatgaatgggttagcaccatcccctcggtgctattctcctgttagtgagtgagtgagttctggagggatctgactgtttgaaagtgtggggcacctcccccttctctctcttgctcctgccatgtgagacacctgctccaactctgccttccactatgagtgaaagctccctgaggccttcccagaagcaaatgctgccatgattcctgtaaagtttgcagagccatgatctaattaaacctcttttctttataaattacccagtctccggcttttttttttttttttttggagatggagtctccctctatcacccaggctggagtgcagtgacatgatctcagctcactgcaacctccaccttctgggtttaagcgattctcttgcctcagcctctcaagtagctgggattacaggtgcacgccaccatgcccagctaatttttgtatttttagtagagacagggtttcaccgtgttggccaggctgatctcaaacttcctgacccaagtgatctgcccacttcagcttcccaaagtgctgggattacaggcatgagccaccgtgcccggccaaggcccttctttatagcagtgtgagaacagactactacactcgcaaaggctccctctcagagtccacccttgctgtctccacacagcagccgggggggatctcttagaacctgagtcagaagctccgtgactcccacctcaatctcgatgaaggcagagtcctaacgaatagccccatcagggacctcaatgctccctgctcagcctcgacaggccctgcccaccctccccctgcgtgcaatgtgctctgcagtgtctgtggccccccaccccgacaggccaccttctcactaacacagctgcaatgccatcctctgccccagcattgtcctgccatggaatggttttccttaaggttactgggtccagcagagcctttccaccttctggttcattcgtctgctctcctgagaatgtgagctccatgagggcaggatctttgttttgttgactgctacatcccaatgactgtaacatgtctatgcacagaggcactcagaacctatgtgtgtgcacgtgtgtgtgtgcgtgtgtgtgtgtgtgtagacagatacagagacacaagtgtgaataaggatatggttgtatatatccagcacaggactcatatccaaaatatataaagaactcatgtaaataaaaaagtcagaagactcaattttttacaaatgggcaaaagacttgaagacatatttcactgaaagaaggctatccaaggggtgataggcctaagagagcacccagctccatgactcatctgggaaaggcactaaactgcggtgtggcaccctgcacacccagcagcaaggctaccatcaaaaggcagaaaatgccacgtgctgacgagatagcacaacccaaattctcagctgctggcggcgcggcagggtcagctggtgcagccaggcgggaaaacagcccgatcatgcctatgaacaccgaccacaccaggcccagaaattccatcctggatggaggctgtgcagaaacactagagactcacaccaaaggacacacgcaggagtgtctgcagcagccctactcacaagggcttcgaactgaaaatgaaccaagcatcccccacaggggactgggtttccaccgagctgtggcatgtgtcactcaatggaacgctccaggccgaggataacccacccagacaaccacaggcaagggcagggagtcaaggacaccaggcacaaagagcatctaaggttggccccacgtggagccagctcagggccggggagggcaccctcacccccagaggtctggggtgctgccctggggaaggggctggaaggggctggatctgggtgtccctgcggagtcaccccatgaaaaatcaccaagtgtacactgtggctctggctcaggcatgtttctgtgtgtgt

SEQ ID NO: 360 - DNA, 259 bp, Homo sapiens
aacagttaaatcttaggaaaaacttgccttttagtggccaaggggtaacctgatatgttactggtgtctttcaggcctggcgtttccttgaccatgcaggcattttccgaagaggaaaggaagcagtggttggaagctctgggtggaaaggaagctgtaagaataatcaatggttgagttttatttcaaagcctttagagttgacttgcattcatttttatgttatttttgtgtagtatttgagaaaagttcccttcta

SEQ ID NO: 361 - DNA, 773 bp, Homo sapiens
aggtgtgaagacagaaccaaatcaggcaaaatgctgattacttggtatagtttatgtcaaaacacccataaactgtgtggtgtactacaaccttgagagagtaaatctttcattctcaatttcttcattcagaaggtggagataagtaatacctactcctaaatttttatcctgatagtgagaaaatatataagcattttggaactacagaacaccatacaaaattagcattattagtactgcattatcttgtgctcttacaatgttttgtgtatatgtatactgattttctacttagaatgtaactgttgttttgtcaagtgcttttttccccccagcctttcctaggctaggatatatgctaacaagtactattaggagctggcttgtgatcataatgccaactatagataaggcaagtagtagcctagtagttaactgaagtttcaagttagtcatgtatagtcagtttttattatcatgtgaataaaataaaattgttttccttttcttttcattcagaaaagttctaggaactattttggtgcacaaccacattatagattatgcttgggtgatatgccatttgtagctgggaaggtgagttggtcaaactccggattctttttatacaacattgatccctgaattaagtccctgcatctgcaagtatgtctacaaatggaaggaacatttttctgtgcctttaccagtgtgtggatcacagtgatgtgaaaatgagatgtagggaggtttttggggattagggaagc

SEQ ID NO: 362 - DNA, 927 bp, Homo sapiens
gggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaattt

SEQ ID NO: 363 - DNA, 1044 bp, Homo sapiens
aaaatgaaatagtgacttgaagcaggtcacagagtcaactaaaagccaagcagagtctccgtgggtcttggcaagggctcctgcagactggtcctgcattcatttgaataatctgatactggaagctactctttattttctgtcctattaggtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaagggtaataagtatgacttgattctctgaactggttgctccattgtacacctttcgtaagtacattgagctcagggaggggagtcaattggtgtacaaagtcagaggtgcggcagatgccttaaaaggcatccctgtcctctccttgtcttaaaagcagtgggaaaggctgcacagaatgtgaagcttaggagttttgtagtaaaggatagtttttgaaggtaatttttgtacattctcatctgatccttaaaacaagcctgtaaaaaaggtagactgtgctttgctgcagaactttgctttgaaaacagggtttaaagaagagactgtcagtgccagctagctgggactagaacccaagggaggagtggctgccagttcacagttgcttccaggggcacacactccctccctccttcctctatttctcttcttgccttctgtgtcccaattctagtcctagcagatggattactctgtccacttaacacacctgctaagtcttgcttgaattactctaacatatgaatgttccttggactcttggttaattcaagtccaaagcacaggacacttgccaattaataccttccttcattgagatgacatatttgtcttcctttgatgatagcaatgacttcaattttaaaaattagtcctctggcatacaggctgtacttgaaggatcgggattaatattagtgcatttttaaaacacttaaaagttttacaaatgtat

SEQ ID NO: 364 - DNA, 1119 bp, Homo sapiens
atatgcaaaggcagcctcgccacttaaaaaacaaagaacactttattcccttgacagtttctgtacagcgacaccaggctgtgcaaagcccagtgtcgtcttcactgagcacattccccaggacgcctggtgcagccctcctctgccccaggccccaactagccacccctgtgcccactagcaggccctgtgccttcacagggatgaagccctggcactgagaatgcctgggaggcaccgtttgctggggagcagagggactgacctttggcttctttgtggctggaggtgttccaggcctggtgagggggtcccatactgttctctgctgagccctctgcacactttgggggatcctggctggcggtggtaggtgggccggagactcagttgtccgtcagctggccatgtccccattttatggacaggcagcctgaggcccagaggcggaaggatttctccttgccacagctgcatcacacttgaactgtccagacctccaccgctggcctgtttgctccccaccctagtcccgcaggctgatatggtgcctccagcagactccatggcttcccggagggtgcagggtccccagttcaccctccagcaggagtggcagcagctggggtacccctagcagtggcatgtggagaagctggggtatgcagaggatccagttctgtgacaccaggaggcacaccaagttttcctctgtccctaacacagaccagaggggtggcccaccacccccccgggtggaggatgtgtggagttagaggtccctgggtggccccttggttggccatcagagacccccgggagccagcctgcagggcaggagcacaatgacgtggccaggatcccagaaaggggctggagtgtctgcctcagtttccaggataacggtgcaatggcctcagccaggccaggtgctggctgctgctgggaataatctctgagcttcgtgactctacagtgtgggcatgagggtccttatttcatagatgagaacactgaggcaagtgcagttctcggccaaaactacccagctgatcagcaaaattcagcccacgtctgatagactccacagctcgcagcatcccagcaggaagcagggca

SEQ ID NO: 365 - DNA, 1125 bp, Homo sapiens
gaaaatgtgagtggggaggaagaagaaagattatgacattaaatgtaagtttataaatttttatgatactactttgagaaacattaatatagtttataaggaaaattatattttaagggattttctacaaaggtgaaaaaaaatcaccctatgagtttaaaggattttaagctttatatttaattctttccttcttttattaatttaatctatatttcttcttttttcctaggatatcctaaacctgaggaaggaatacttgacagtttgggttggtatagctatcatgacaaatataagtggtagtatgtgtagaaacgtgtaggtaattagtttttatgaggtgcccaaacataggatccttggtagggtaagataactttcttaaatgctgtgtttgtatgtaggttaaaatatataaaacacaattttctttccacattatattgttattttgtgatggtaatctgtcgataaattttctttctattcatatcttatatacatgaaccttaaagcaatctaagttgggtttattttttctgtaacacgctgatttaacacacttgatgtaggcttacgcagtttacacaatgcatgttaaaaaaaaagatgaagtgcagttgtgatataggccaatgaaaaataaagatttcttaataagtaaaaacaaaaatctattacctttcatttcttagactagtttggtaatggttaatcattttatataatgcaccttaggcttgttttttagtatttgccttacctccaaaatctgtggtccaagtaaatctgttgccatcttaaactgttaaacacttgataactgtttatgagatgagaagagcagagttgaacatagcactttatgctttgacttatagcaatttaataaaagtaatggcagtttagaagcaaaggtactagggacagaaacagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgg

SEQ ID NO: 366 - DNA, 1162 bp, Homo sapiens
aaaaggacaaagagttcttggaatgctagcgtcttaaagatagtccaaaggaattttcaggtgtgctagcttgtccccttcatttcatttttttcccctcaactcttattcactgcatgaatgttaagaaatagcacagcagtaggggtaaagattttcatgtactgttctttgttatatcaagtattattttgtataattctttcaaattcttgttgataagcacataatcaagattcaattttgtattctgtgtattttatcaagttgaggaaattaacccaaaagatttaagttcctcttgtttgtagaagaagctagtaatgacagtagtaccataagccagtctagtgctttctaccaaacagactgcctaagagaactatggttatgctgcattccctcgttgtagaagagtagcccagaaacacatggacaggccagatccttattctctgtaggcacattcttttatttatttatttattttacagtatctgagtgatcaatgtgtatattctgtctccatcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggtacggcagagggggaaactgatagatagtggccatcctacagcctgagtggcttagtcgagtgtcgcacattgttttgagtgtttgtctttggggatctcaggtgtcccagtgctttaattttgctctttgtagttgttttttttttttttttgagacagagtctccctctgtcacccaggctggagtgcagtggcgtgatcttggctcactgcaacctccgcctcctgggttgaagtgattctcctgcctcagcctcccgagtagctgggattacaggcatgcaccatcacacccagctaatttttgtatttttagtagagatggtgtttcactatgttggccaggctggtcttgaactcctggcctcaggggatccacctgcctcggcctcccaaagtgctgggattacaggtgtgagccaccgcgcctggcccctcttgtagactgagtacaac

SEQ ID NO: 367 - DNA, 1166 bp, Homo sapiens
ttgtttgcatgtgtctgtgtttggttgttttttttttgtcatatttttgtatccctacttatatatttatttttaattttattattatactttaagttctagggtacatgtgcacaacgtgcaggttagttacatatgtatacatgtgccatgctggtgtgctgcacccattaactcatcatttagcattaggtatatctcctaatgctatccctccccgctacccccacccaacaacagtccccggtgtgtgatgttccccttcctgtgtccatgtgttctcattgttcagttcccacctatgagtgagaacatgcggtgtttggttttttgtccttgcgatagtttgctgagaatgatggtttccagtttcatccatgtccctacaaaggggttggttatttttgagacaaggtctgactctatcgcccaggctggagtgtagtggtgccatctcggctcactgcaacctccacctcccacctaatcctgctgaattagtgtctgcaggcatgcacaaccacatctggctcacttttgtattttttatacacatgggtttacaccatgttgcaggcgctggtctcaaactccctcccaagctcaggtgatcctctgtctcagcctcctaaagtgctgggattagaggtgtgagccaccacaccccactggtatttgtgtgttcctgttcaaattttattgaggagtttttataaccaagcctgtggtccatcctggaggatgtttgtgtgcatgacaatgtatattcttcaacatcgtagactcgatgttggatgctcccatcgggactgtgtgtccctgtactggaactcgagtgaacacttggctctaagttcattgctgttttctagaaatccagcccaattctcttggttaaatataaggtgcacgtagtaggcattgctttttctttctggagacaaaactcaggaggattgccccttgatgaacaaagctaacctgctgagactttgaagcaaggaactggagatggtccttttaagggtttatattctggattccagaaaatgtgcaaacagggccaataaatgcatctttatttttgtgtccattttaacctagtcaaagaaaattacaacaaaaaatccacagtgctggagcaagaagatctcatgatgtgacca

SEQ ID NO: 368 - DNA, 1196 bp, Homo sapiens
gaatgaaacgtgttgtcactgtatgattatctacttccagaattatggtggtcatgactggctgtgggcacagacaaagtcagttccttccatgacacaagcactagtctatggttatttgtattgatagagcccaccaccagcaaatttatcacaataggaggtttctgcttttttatcttactgcctcttgaattatgaagagaaccaaagcttttgagaaaagatggaatttagggagcttatattttaacttgttttcagattttctcaagagcagtaacttgtccaaggtcatacaaaatagagtttataactttctaaatcccagttctgtgctttaccaatatatcacttttgggcacataaatggtctccagaccaccctttcactacaggcaaaacatccccatctgctgaatatggagaagagaaagaaggcccaactacccattctctaggggcaatttgggtgactctggagtggttgcatgaccccacttatctgtaaaatggagagaacgttcttgcttgtgtctaacaatgtgcttaagcttgaatgaagcaatagttgagcatacccacaggattaacagcaaaatcaggtttgatgcaattattcaccagcttttcagagaacaaaattgaatggataacatgaagggtaatagtttcttcaatacaatccattgtataaagtgcttgcttaggagtttgacaaaagtgcattcaaatccaacttttgtctttgtatagctaagtgagagtaccacataatcttttagaatattagttactttatttctaaaatggggataatacaatggggttcacattttgtgaacatcaaatgggatttagagtttaaattcagttcctatgatatttgctgtgacctttccaggctactttacttaccccacatacatagctcctcctccttttaaaaaaacacacactccaccccacacaaagtttcccccaccccaacttcaacccctgccaaaaacagcaaaaaactggtgcaaacagcagccattgttaatgaaaaaagggagaggaccgtgggacttttccaagggtaataaatttaaaaactgtaatctgttgggagtaatatcagagaaaacaagcaagaattctattagtgactcttctgcatttctgttcattaatttagcaaaatgtgtgacctc

SEQ ID NO: 369 - DNA, 1392 bp, Homo sapiens
agtgagacttgccaagttctaaagattcatttaagaggactgtagaattatccaaaggcatcttacaatgtgatagaatcagcttctgagctccagcagctttgcaggaacaagtaaaaattctgcaaagaaacagtacttactgaaataatgctaaccaatttaagtaacattattatcactagtatttttgtttcatcgacgtatagaacatttattgcgagcctcctctacgtgccaagaattgggaatgtgtcaataaatagatcagatctcatcaacccctctgggaactcaaccgtaaatgggacaaaaagtttgaaaaatcacgatggtgtgaagggaaagcataacagagatacaaaccagtttgctggaaattggttagaaaagttctcctgggacgggtgcggtggctcatgcctgtgatcccagcactttgggaggccgaggcaggcagatcacttgaagccaggagttcaagatcagcctggccaacatggtgaaacctcgtccctactaaaaatacaaaaattagccaggcatggtggcatgcacctataatcccagctactagggaggctgaggcaggagaatagctttaactcgggagatggaggttccagtgagccgagattgcgccactgcactccagcctgggcgacagaacaagactctgtctttttaaaaaaaaaaaaaaaaaaaaaaaaggtttccctaaaggaagagaatttaatgcaagaatgtgtatgatctagccaaataaagcaagagggaagaggtgagaaagaaaattttttgtccaaagggaacagtgtgttcaaatggctaggtgtaggtgaaaatatgacatttgtgtggaagtaaaagaagtccaatgtagatgttcagaatgaaacaggaaatgagaaagggcatttcctgagacaagatgggcaaagaaagaaagcaaaaggtgaagcaatttgccctgaatcacacagggctaaaggcagagcccattttaaacccttaccacttgactgcaatatactagccattctgaaattctaagcaggaaactaaaagttcctagagaggaatttcaggggacctttgcaagagcccaaggaatgactgccctgggccaatagctgaccttgccatggatggataaaagaatcaactgatcatcaagcgtccattgtgcagaatgagaaaaaagtctcatcacaattctcaactaataattaacaattactaagcactttactatgtgtaaagccctgttttaagcacttgacatatatttattcaatcctcacaacatcactatcaagcaagtgctttcattatcctatctatctaattttaatgacacagtccaatcatggctattaattttcttgtact

SEQ ID NO: 370 - DNA, 1393 bp, Homo sapiens
ggcccttccttactcttaaatggtaacttgcaagaagataagttcataattcataaaatgtattatatgactatgcctttaagtgtatttttaattcaattagaaacatattacttgctaattatcaagcagtgctgttcagtggtgtgagccacatacataattttaaattttctagtagccacgttgaaaaaagtaaaaagaaacgggtgaaatttgttttaataatatatttaacccaatacatgcaaaatattatttcagcatatattcaatataaaaaatactaagatatttcacatttattttttgcactgtctttgaaatctcatgtgttttttacatttaaagcacatctcagttgagtctggtcacatttgaagtgtcaatggccccatgtggctggagagtcctgtgttggacagcatctggaaaatacagaaaagtagatggaaaaacatgtctaaagtcatccctaccagagataaacactatcgatgttttaatctacttctgccagcctttttcccctctgtgcatactttttgggtgggcgttatacacggttgagattgtactctgggttcagatttgcactttgctatgtggttgattctgatccatagttggtttgagggccatggactaagggaagagtcagtagacctcactttaatcctggttatgctgtcatgtagtcacttattaagctatatcagcatttgttctttatgtgtaaaggggaggggttgatatacgtgatctttgattcttttaaagttattgttttgaatatgtaagtcagctttaaccagagtccaataaagagctctctgccttagcacttagagagtaggaagagactccagtattttctgacttaaactgtactcttggctttctttttcctctaacatttcatgatgaacattttcaaacatacagaaaagttgaaacaattttagcgaacacttgtatacccaccacctagatgtcactattacacttgtgttatacttgcttcatcatttttatctgtccatccattcatccaccttcctttttttgtatttcaaagtaagttgcagataatccctacactttcccctaagtatcctctttacttttgaaccagaggtctggcgtcttacgcacctgacgatgtttctatgtcctaatttgatgtgttattttttaatagctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaaggtaagctttatcttgttactgtaaacaagagtgatgtttttgtttgtcttctaaa

SEQ ID NO: 371 - DNA, 1394 bp, Homo sapiens
caaaagagacccgctggaaaataaggactaacgcccaaacctgttgcacaattcgggtccctttcacccagaaatgaacaagggcgctcaggaacggaaaagcgcgcggcccggtctctgcgggccgcggccgcacccggcagacggcgcggaggcaaaggcggcccgcagggctcccacctccggcgctttgtctgtggcggcaaggcggtgggggcggtcggggcgttgggagcagaggcggtggcggggcgggggcgcccctccttcactgcgtagcccctccgccccgcggcccgcgcaggggaagaaagccgggcccgctaccgccgccgccgccgactgcaccggcccaagccggccacccggccgcggggcctgcgcgcttctcccgcccgggccgagcggcggccacactcacctggctggcgctgacgctagcggccggcggctccggggcgttggggaagacaggggaacgctagcgaggtgcgggcggaggcggagggcgcggcgggaggaaggcgggctgggggcggagcgggcccgggcggcggcggcagcagcggcgacggctgcggctccagtcactcgcggcaaatcgcgtcccggcccctccgtgcgtcaggcggggagcgggggtgcgggtggcccggcgacctctcggcacccgcggcccgagccgcgtccgcgcgaccccgcgcgcgcccgggtgacggcggtacagcaacccgcccggcgcgggaaggaggaaggaggcggggcggggcggggcgtccaaccgggcctggggctgagggctgggcgcgagtgggactctggcgctccggacggaccctgccgtccccacccctagccgaggcccaggctccccaggcgggaggcagtcttggagagtggaagggtacctagatctggagtcagaagtctgggcttaagagagggtccgttacttgacaccctggcaggtcatttatttcctctggcctcatgctggagttcgaaggttcgagtacaaagtctccaagagctgctcccaagtactcactgccaagcggtggtgtggctgaaggatgaaggcagatgaaagggaaagggttgcggtgaggaagggctggattcagggcatttgttttgctttgaggatctttccactggacagtccaaaattaatccacaatggggctccctgataatggctacttccccatttttaccaacctagttatttttctccaagtatactgacttaagagtccttgttttcattttattgcgcaaatcatttgtatgtcatttcctgaattcagttcaaaagagtcatcagcaaattcacaccagatcagagcagctgtgtggtcccaatttcaagacttccatattattcactcagc

SEQ ID NO: 372 - DNA, 1396 bp, Homo sapiens
atcatctaagataaccaggtagaaagtcaccatccactgccctctttcactattctgccccccttttcccctagcccgtggcctcaccactgtcagatgcctgacaagctcagtgaaattggggctctcacggtagctggccaggacctcagactccacaccttgcccagccacctccagtacaacctggggctgctccacctcgagcagatgcacacgaccaagtcccctaagaccccagaacagcacctggggtcagaaaatgggagattcaggggcctgcaccagacaaatgggcacccggatgttggggaacaagggggctttgagtgcctggtgatacctcaacacggaactccctgagcactgggcacacgttgggtggaagggacaggcgtccagagtggggctcaaccaggggtgccagatcctggggctccacctcactgggcactgagggctgtaggagggaaacagtcagagggcgaagaggaatcaggccaaaggaggaaaagcctaggtgtggggaggggatatggagaggtactggtgaaatgtaaatgcacaggaaccaaccaaggctggattggtggaagggagggggtctcgggaagcagcttcgtgcaggaagggagcagggtgtctgaggcatgcaggatggcccaacaaggtgaacctagcacatgaatacttgcaatgttccttggggtcaagtggtccaatgaggtgacctcaggacaaacctgcagtctttattctctggggaaaagagacctggaggctggtcctgggacatatccatgttttatattccctagggctggatggcctgatggactaacaagttgggctcacagcctgtgctagccacgccagggcatgctgacctcaagtcggccactgtagtctagttcaatgagttgaaaggcggcaatgagctctccggctgcccagggtcccttcctcagggggaagaactgcaactctgggcgttggtatgggtcctccatcagctttacccttggggcggccagtgccctgcccaggaacacgggggggccctagggggagcagggcagtgaagacaaaggggaagaggctcaggagccagggaaggtgggcatcaagggggaaactcctggccaggaacccagggagggcccaggccacactcacaaacttattgtggtcaaatacattgatgatcactaatggaggctcctcctgcaggtgctccctcctcccatccacgatcaactgctcaaataccaggagttcatcccacagagggctcagcgtctgctccaggaccttgggggccatacagagaagcgggtagcagcagatatcaggagaaggctcccaacatgcatgccatgcgaacacccctgctctg

SEQ ID NO: 373 - DNA, 1404 bp, Homo sapiens
aatcgactcaggggccaatttatgtcccaggtttctgagaaggagccctggggaaggagggcggggtgagcgtcacaggctggagggctgcgccagggcaggccccgcaggggcggcgggcacagcctcgccctcgggcccggcctcctcgccgcgcgcgtaggtgagcaccaccgtgacggtggcgaaggtggcagcgttgacggggaaggcgcgcagcagcgtggacgccagcccccgtgtgaagacgcgccagccctcggcgcggtagctctggtgcacgcagtccaggatgccgcggtagcgcggggcgccccgcagtccgtccgcctgcagccgcgacttgaccacgtccacaggataggtagagagccaggacacgatgcctgacgtaccgcccgccaacagcagcttgggcaccagcaggcggtcgcccggctcgcagcccagcgcccgcgtgagagcgtcataggtgaggaagtagacgccgaagctgggcgtctcacgcagcaacgtggacaccatgccccggttgacgccacgcagaccctcgtgcccgtagatctgcgcgaggcagtccagcgagcccttgtaggtgcgcgctgggcccgcgtcctgcagctgcagccgcgtcttggccagctccatggggcagcagatgacgcactggatggcgcccgccgccgcacctgccaggaactggttgaggggcgagtcgtggcccagggcccggagggtgttgccctgcaccccgaacaccagcgcgttgatgaaggtgagccccatgagcggcgagcccaggcccttgtacaggcccagcacctgcggggacagagacgccatcagagccggcaacgcgcacctcccgggccctccacgcggaagggggtcgggggatggcagccccagcccaccccaggggctcctgaggaccaagcagaatttcgttagaacctaggtcctgactggcctcctggtcgtcctgacaccttccttcctggctctctggtctggggtggtggcagcccggaagctagttccccatcctgtgcctcccgagccccaccagcccaggccactcacgctctcttgcttgatgatggacttgaagcagtgcaacgtcccgcggtactgaggcttctccacgctctggacctgaagccgtacctggaaggagagggtccagtgagaggcaggcaggcaggaccagagcacccagctcccgggtctggtgcttaggctgcctaggagggtctcccaaggaggccgggcactcaggcacagtctaagacttttgtaattccagggcagggtgggccgggtatctatgccttctcaggatggggtgccagtaggcaaacagctaaagggacaggctgctggagacagggtagggggtcccca

SEQ ID NO: 374 - DNA, 1492 bp, Homo sapiens
aaacactcaggcgactactttactcttttaagacaccttcttaattacgcttacaatagtaatattaatgtacccaatgctgaagttcttctcaataatgaaattgattggcttaaaagaattagggtaagttttagttaatactccatttatatgtcattattagtaaatagaatgttttattgatgatttatattttttgagcattttggttaaatggaaaactccaaagattgataaaagggaccaaagaatgtactctgcatcagtggacgttagtaatctgtgattcacaaaatgcatatctagtttagtaaaatgaattgcttacttgacacttgaaatactgatgttcagcttcttttattttagcattttgggcctttttgcaaattctaatttttaaaaaaagtattcttgaattgtttatgtcaaaaatgagtctgatagagcagaactttctaccataacatctgatactttttacttaggcaaaatgatacaagaatttatttctgaagagatttgtagtttttaaccttcaaattagcatttcttctagtagttcataaagccaatttctagaaagttctgaagaaaacaaagttgtttgaatggaaagacttaaggaaattatctcatatccctccagctctgtctcgttctggctcctctctccctctttacctccctttcataagctagacatttgatttcttcccccccccaccccaccccccgcctttggcaggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagtaagttctgtgttcttggttgtaagctacatatcataaccttctaaatgtttataatcaaatttaattaatttatagtagtatcatgtctttgtactttcttgatcttttctcttttttaagaatctttatcaaatttacagtaatttaagaaatacagttatgccttactttattcaagagacatttctaaatttgtatttaaataagatttcatggctggacttgctggcctcatgcctgtaatcccagtactttgggaggccgagtccagtggatggcttgagcccaagagttgaagaccagcctgggcaacatggtgaaaccccttctctacaaaagaaaaaaaaaaaattgccaggtgtggtggcgcacacccatggtccccagctacttgagaggctgagatggaaggatcacctgagcccaggaggtggaggttgcagtgagctgagatcgcaccactgcactccagcctgaaggaacagagcaaggccctgtctcaaaataaatagataaataaataagatactttataaagtaattgttgtttagtttttctctttggaaaatctgaattgttaatttcattta

SEQ ID NO: 375 - DNA, 1522 bp, Homo sapiens
ggtagcagatttctcgaatacttgtatgacatggaagaaattactaaccatacagtaggttctcgtttttcagttagttttctgcctaaacttgaaatgcttttaacttttattaataccacagaagatatctcaccattttctcctatagaccacttcctcttttagttcaggcatatattctctggcggaaactctgaatttccagcatcttctccaaagtaggatagctatttgggaaacagaacaagaaaaagaagggattttattacgaaagttacagaaaggggccctatgtcttttatcctcctctctaaatgcattgtattgtctagataataccttaaaaattctgaaagctatttgctttcctgtatgctttataatattaacattaaactgaggtaaaacatgaattatgcagaggacttctgaactaaaaaatatatatttaagaaacagaaataactctgttaaaataattcaaggtaatgacataaaagaaaaaaatctaattttaaaatgaggtgttcagaaatttactatcgaatacaacatagcaaacatagattttatctcctatttcttctaaaattccactaaaattgaattaagtgaataaaaatttgttagtctaaaacaataacacaaaggctcagggtcctattagttgatgaaaaatttcaactaattcctggaaaatggagagtagatggagatgtgatcattgatgaagaagtaaaatcagagaaaaatgcagccaacaccatacagagggaaataatggaggagagcctagctacctgtgaaaccgtcataggacatagaaatgtcagatatgaaaaatggcaggatccattagcttatgactagtagattaactggaaatctgcatatggaaaaactggttttttcaatacccactcaagtgcattctgcagaattaatctaaactgcagtcaccccatccctacccctcatccaagaaatttaacttaggttaattaaataactagagaacagatcctggctttgtggcatttagggatccctcctataaagaccaacttctgaccctggatgaggcttgagcaccgacctctgtctcttaagactgcatgacactctctcccttttctgggctgttccaactgtttgtatgtgactagacaatacctactacatacatgaaaaactgacttttagaggttttattatctgcaggtggttgcataaccaataatttttttttttttgagacggagtctcactctgtcacccaggctggagtgcagtggcgcgatctcggctcactgcaagctctgcctcccgggttcatgccattctcctgcctcagcctcccgagtagctgggactacaggcgcccgccaccacgcccggctaatattttgtatttttagtagagacgagtttcacggtggtctcgatctcctgacctcgtgatctgcccgcctcagcctcccaaaggcataaccagtacattttaagagtgataactgag

SEQ ID NO: 376 - DNA, 1661 bp, Homo sapiens
actgcccaatttaaaaagcactacaactttcaactttatgcacttgattttatattctgctatttactctaaggaaaagaaaatagcttaattctatatagcttaataacaaaggacaatctaaggaaaactgagaatattagcaacttttgctgccatgtcatctgtaaatatttactaattcgatacgatttattgcttgaaagtccctaaaccgtcaatctgattgttcataatataagtttccaaattccctcctgttttcatacagcagcagttgtaagatacataaatgacctcatctgcaagagacataaatcatgaaaccctgcctcagagtactgtgatggagtcgtcttttagagtgcttttaaaaaaaaaaaaaagtaggtcattgtaggctccacttgagaggacaataacaaagaaacacagctgtgtgctacattaacctgtgcacacattaacatccctcctatagtttgatgaaaacttgccattggtgtaaaactcacaataacaacaacattcctgaatactgcaggatgttcacttgggaaaagtcaaatagtaaaaactgacaccaagtgacaaaaggcgattataactcctgtacctccacggacctcttctcctgttcttggctacgcaggagcagcagtctcagtccctgcaccacctcagacctgcaagcaaatagtaaggaaaagggggcaagaggagtagaagggaggacaggagatggatggggagaaaagacaacaaacctacacaaggcacaagcatttttcaaactcagtcacttcccttaaccacccaagcccttccagctaatctcagacttactggcacacacctacctttctgttcctcaccaggagccccatattctgaaatcaaagaggattacagatgccatgcagcacagcatggtaaacagtcagggccctttcttggggcacaccagctccacacttggtttcattacctctcatcgagctcttctagcctgctcttcactgtgtgggcattgttatccttggtgattttctgcaggaggtagaaagtctgctggaacatacgcagtaaatactcctcaaattccataggcacacagttcttggacatgagttcattgatgcaggacatggccaggacccccagccggccgcgctcctgacccgagacacagttctggctgctgccgttaactgacgccatctttctggcccggatgtcacagccaaatcgtgcaaagtggaagatggtggtaaggagggatggggtgatgctggcagacagaggaatccaactgaagagatgggccaggcactccaaagccagggaacagatatactcactctccacatcaaggatgggaattggctgattcaacagtttggctgaactgggactctgcaacaggttactcagtaagtcacctgaaaataagaaaggcttttaagctatccagcatcaaatctcttacaaatgactttaagtaattctccttcaaaaaaatatatatatatatgtatacatatatgtatcagtttagttacctatgaaataaaaaaataaaatctatatgctcaaagttaaacactaattaggaaattttaacagtacagcaaaaataagataattgattatgattctta

SEQ ID NO: 377 - DNA, 1698 bp, Homo sapiens
ttctaaagaactgagtgatacaatgactaaaaccgagaggcaccatcttttctccaatattacagatgtctgtgaggcaagcaaaaagtaagtgcactgcagtctgcctttggtcgtgccaagaagttgcgtactaataaacactttgttatctctaaaggaaggcatttctggttatcaagtctcattcagttggcttttgtcttgattccttgaaatacattttgagatatgtttcaagtttggtgaatagacagatgctcagtgtgtaatgagttgtcacagcagacggctgtcctaagttatgttattcctctttccccactttgcttgctctttacttctgattacatcaaggaaagtgtcttcgtttggtgctagtctgtgatattcatccatttcagtaaagaaagagtaagccttaggcttaggtcttctgcaggcaatatctggctacgatttaataatatatattttcattatatttaaggatttttgctttactttttgtcatgaagagtagataaaatcatataataaacttttatacattcaaaacttatatttagcaattgttaaaattttccatatttacttatctattatttttgcttaatttttttccaagtatatacattggatgttttacttataaatgctccagtattcagctcttaagaataaggttattttcttacataactacactgttgtggttatacttatgatgatgcttttatgattttattccatttaagttttgtacgtgtaagtagtagagtcacatgttgcaaaattccaaaaatatgaaagatcctacagtaaaatgccattcatatactgttccctggccacctgaaacacaaccagagtcaacatttgtttcttgtgtatctttttagtaatactttatgattatgtaagaaaatacatgtatatatatatttttcttgtttttacttaaatgttaccatactataaacactgttctgctccttacttttttttacctctatcctggagattatagcatgtctgcacattaaaactttccttattcatttttatgttttttccttgcaattatttgttgaagaaatccggtcatttgttctgtagaatttcccatgaggcacataatttatgggtggtgatcaataccagatccattaattcattaaggattgtaaaacagtgttactctaatttatcgttctttattcatttattagctgaaatatttctataaagggaaaggtacatccatctattcatatattcagtggtaaagttcacgttattctatttattagtgctcaaattgttccatctttgatcttaacaatttttgattattttcttgctatatgacattttaagatgttaaaggatcatgttttacaattcctgctccaggcctggaatcaaccatttccccaaagagctctggtgtcttttgaaatgaggtggtatttaaaacctcagtgagtaccagcgtgctcattgctaagtggttttaggctgtttcagtagatacccagaaaaaaaatccaaatttttctctataaaactagatatattaaaagcccatagacactccaaatttatcaaagtatatatattaaataggtacttttttatgtatcaattatacctcaataaagcttaaaacataaagaagaaagtctagtttctatt

SEQ ID NO: 378 - DNA, 1768 bp, Homo sapiens
aaaaactgaagaaaggagtttttcccaaaacattggaagaaaaagacaaggccatatgtagtaccttccatgtggcctgcagagctcagagattttctcccagatcccctgaagggatgacatgtcctcactgtgcctcagctgaaacaaggacttctgccctgtgcaaatttgtgtagttgctttaggaataattttgacagagtgaatggatgataacataggatttctgtcttatcttgtgtctaagtgtattcctaatgtttgttttttaggtgggagagataaacgtggaggtcccattttaacgtttccggcccgcagcaatcatgacagaatacgacaggaggatctcaggagactcatttcctatctagcctgtattcccaggtaagttctgtgtggcttgtgcttgtcactgatgtcacatttacaagagatgtggcgctatactcgttagaaatcagctaaattgtagcctgcattccaggcaaagtagtataaaatgaaagtcattatctttcaccttattaccattttgtgaccattattgtctagtgtaaagccctttggggagcagggacatgaaggtaggtaagagctttgtgtgttgacagtggatctgggatactcagctgggatttcaggatgtggcgcctgagttagaaagccattgttgatgattctaataccgtgacacagaggcctgggtgatcagaattgggtgctgcttttgacaatgcatttctgcctacttggcaaacgttagttctttaaaaatagtctgttgatatgtagcacgaagtttgtggggcattaaaaatccttattagctatatattgggcgtagatttgggaatctctatcaaaattgagactccattggtaatgggaatttttagcatagatgccaaagaacaccaagagcaagcaatgttgtgttttctggagagtccgcaagtggggagtcatgagttactaggagctggcctgtgtgtatacttgaggaatttagaatctgtttctgctctggaaatgtattactcgagtttaatttgtagatctagctgacaactggtggaggaaatttcctccctatattaatgtattagttctttctcacacttctattaagaaacgtttgggactgggtaatttataaagaaaagaggtttaattgatttaatggctagggagccctcaggaaacttatgatcatggcagaaggcaagggggaagcaggcacatcctcacatggttggagcaggaggaagagggtggaggtagggggtcaggtgccacacacttttaaacaaccagatctcatgagaactccatcaggggacagcactagggagatggtgctaagccgttagaaccccccccccccgccccgtgatccaattaccacccaccaggcctacctccaacattgggggttacagttcaacatgagatttgggtggggacacagagccagatcacaccaattaatatctccatttaattgttgcagttatattctggaaaacataataccatgctgatataatctaaggatacagtcatgcctggaataggagatttggtgtgtgttgcaggttggaggggtgcctatctatgaggaaagggtgagtcctcaggtgtctcttttattccagaaaggcacatactgaagggcatcagtggcagccatggtagagtgagaggaggtgtttcctaagagactaaatgaggatgtgtgagagaaaactcggccataatatgg

SEQ ID NO: 379 - DNA, 1790 bp, Homo sapiens
aaatgcacttactttgttcatagaccacagatcaaacatgagacttatggcttatttgcatataactgatcctcatccattcccttttctgggaggcctgtctcacctgacttgggtaaaaaaatcccatagggtacaataaaggaaactcatgaattaatagaaacactagttgtgaaaattaaaaccatatagttactcattcgcaggtgagctaaagcaattggaaaactatctaattgacagccactgtattatctatttgcataattctaagtgtaataatacatgtaggctagcaggaatattaagtattagatataaactttaaataaaaccaaatcagtcaaacatgaaatctctttcttctgaagctctctcatgtttttgctgtttttaaagtgaaggaactaatgaactaactacacaacacgtgaaagttgaacttgttaagtgtaattattatactgagataattcatgcaaatttaaaaaaggattgatttttgctcacctgggaaattgatgttgaagggcgagttgcatgaaacctaacttgtgatgccagctaataagctacctgctttataatatttaactgcaccttgattttattttaatccttacaaagttgaattaggaagtgacaattttataaaaacatagaataaacattaatcataagtttattttcttatagtgagactccattaattggtctgtaattaattatacccccaaagttgtgtgtagccatgaattatttagtggactaagtgatatcttgtttgatgaagggaacaagtcagtctctgaatgtgcattttgagatcaatttatacatatattcatttcatattttggtatgtttgcagcatttttgttgtatgtgcatgtagttaacatgcttatcttcctcctgagtcattattgcttaatcttttatatggaatttcactttataaaacaaagcataatctgttgctgaaaactctggttatttgtcttgatttgactaaattataaataattccttttgtgcttttgccatttcagaataaaactataatttacaattgtgtcatttatgtctcctgcagtttcaaaaaaatcagcaaagcaaagattctatcttcttccgagatgggattaggcaaattgattttgtgctttcctacgttgatgatgtaaagaaagacgcagagttaaaggcggtaagtgcattataacagaagtgggaataataaaaagaagcacattttataatttcacatggatatctggattgaattatgttgtaaaagtgagaggccctgaagtgttactgaaaactgaaactgaatgagataactgtaaagtaggcagcctaagaatagacatgtaaagtcaatgttatctttttggatattttgcatactaacttatttttcttcttcttccaagtaactgattctttttatagctcactttagatattaaatgtaacatccaaaatttgaggtatgtgtctgaatataataattaccttttgtatgatattttcattttggaaatgtatgactaatccattgctccaggtatagcttttatattgtactctattcctgattctattttatttgtattacacatcactttatgagcttatttattcatgtttttacttgtttgctgtctccaacactataaattaagtttatgaggccaagcactttgtcttgttcaccgttatgtacccaaatcctagaacaatggttggactataatggatactcaataaatactcaatat

SEQ ID NO: 380 - DNA, 1890 bp, Homo sapiens
ctctgcttttgaattggattgatttgggttggtttctcctcagattcctagtaagtttccttggaaaaacacagggcttgtctcagcggaactcagagccaaagcatgtccatggaaggctcttaacacctctgggcctcagtgccttgtctgcaccctggagagctgggcagcagcattgaaggtgccttccgatcctgggatccccagcccacgtttccacacgctgctgacggctgggggaggggtgccctcttagctggacaacggtcaccagggaggtgggcagggggagagcagggggtcctgtgggggcgagtgccccggggtgccatctcttcccagtccccagcctgcctgtgtgtgtttcctccttgcctggcttcctgaggtttggcctagggcgatgtgcaggcccctcctctctgcacagagccttccctgcatggctcctggagagggactggagggaggggctgtccccactcagcctcccctccatccaaggaggtgtgccaggcaccaggagccaccgaggggggaaggtgttggggagctctggatgagtgtcagcagacacaggagacacggagacaggagacaccaccctcagcactagcatggacccggggagaaggcagcgggaggctggcagctttctgggttgccccagtgtgggctgcaggggcctctgtgagcaacctgtgccctgggttggtgctctgataggggcatgtctgccaggaggggcagaggcaggggcatgaggatcccacgtggagcttgttgaggaggtaacagaggccaggggccagtgtggcaggaggcctgggatggaggaccactcaagtcttcagcatggccatagagcctggcttgctggtcctgattctcttttctggttttctgctcggggtggggttgagagcaactccgcccagggggcctgatgactgctttgctgcgtgtgcctggggagggaggcgctgccctgcagcctcagcttggggtgagatgacacttccatggggactgcaggagtagggaggggtggcaaacagcaagcatggattgcacaagccacagcaggggctgggggcccccggtgtcctgggaagcagtggccaagctggtgatgatgtggagaagcgggaagggtcggagagagcctggaagcagaaggcagtcaggacaggggccagctgaccccagaggccaggagtcagggctcctgaagagaaaggatggaaggaatggagcggggacgagcaagagccagtgtcccagagaggaaggagttgtgggttccggcggcaggcaggagacaggtctctggggtccctaggcccaagctggctgggacctcctctccccactgctttgtctacactaaaccctcaggacgggggagggcggagacactagcggccagcacaggcctccctaccccctgctgggttccctccccagctagccaggaagtcccttccccccttcccagggccattctcatcatctccttccgtacctgcttccagcccggctcccgacttcatttccgaacctgtttggaaataaagcaagcgtctacagccagggcctggctggccagggtggggtgggactgggaattagctgcttgagcggggctgggtgaggggctcctttcccagtcatgtctctgggaccccccaacagatccaggctagcccagctgaacttggagttcattcaggctgacttagagactctggaggggctagggaccggagagagatcacgtctcggaggggtctgggagggttggggtgagaacactcgggggagggcatggggatgggggcaccaaggggaagacacggagggtaggcaacaggggaccaggaaggt

SEQ ID NO: 381 - DNA, 1977 bp, Homo sapiens
agcatataagtgattgaaaatagcccagttatttttaaataaattattctcatcaattcttataatttttgtttgggctggttttgcggggactgatgaaaattatgagggtcttctctcacggcttccttcagggtcctacccctgtcgaaccttcgccattaattctgtcatccttttgcctgagataagctatgcgtttccactttcaagtacatatatacggattcaatacactcactgcctttcttttaaaaagctgattcacttcaaagccaatttaattttgcttagtttttgatctccccgcgccccctttcctcagcccctatacacaggtaggtgagggttctaaagccattttacaggcgtgattgaagcggaggccacagagcggcagcgctgggtcccgagtgagactcccatcatgtggctctggggggctgcgcagctttgactgcctggacagacgcccagagctgcaattcctgggcagtgtgggaggcgttcggctaaagctctttgtttctgctgtcatgagcgactcctcggagaagacgtgggagtcaaggatggggggcggcgtgcacaccgcccgcccacaccttctgcccccgctgcagaccgggcgtatgtgtgtctccaatggaaaaatcctacccaggacgacaccacatccttgctcccacaaataaaaccttccacggaactcagggctgcagaccagcccttcgcaagccaacgcgccccgtgggcactcggtcccccggctccgcgtctctgccaccttcccaccgcttcttctttaaccatgctcttgtttcccctcgctgatcgcaaggctgcgggcgaggattccagagagaggcctagtatggggaacaaacgcttcagaggggtccgaggtgggctggggacagccagtggatgggaaggagggcgctggcgccgggcggctggggtggaggagtggcgggtgccctaccccggcgcagagcagccgccgagctgtcatgtcccgagcggcccccgcgccctccttgcgcccacctccgccgcgctggagttcggggtgtgcgtggagggggctgtgagcgggaagcggcgcggacgcggagtccgggccggtgcgagtgagcgcgtgtgcgcgtgggagagcggcgggagggggccgggctcgcagccgcagcgaaccacggccccgggagcagagccgagcgcgcccccgagccgccgcccgccggagctgcgagcgctgaagccattcatgattttggtgacgttattccaggagtgggcgagggagggcggggcctctcggggccaagccccgcccccgcccctataaatacggcttcccgggctctttgtggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactggtgagtaccctgcgcctgcggcgggcgtctgtctcgcggcggtggctgcgggcccgggcgcctgcttcgtgccggctccgggtgcgagggcagccggcggcgcgggcgctcagcgctaacccgccgcccgagcccgtgcaggagtcaacgtcaaggttgcaaaggtgggggtggggggagggggtgctgagaacatccagacaaaggacgtgaactcggagccctcacctaagtgacggccggagggtttgtattggttggcgggggagccaggggtcacgtgtgaatcccccccaatgaaaccaccctatgcggagagctgcaggaggcgcgcgccccacttggcgcaggggggctcctgctcttcccggg

SEQ ID NO: 382 - DNA, 2003 bp, Homo sapiens
gtatgcaatggaaaacctatcttcaagatttctaatggcaaactcttagatttgtgggctgataattgaagttgacgagagcacagagcagaaatgtgtagaagcttaaaatcgaagagagtatatcatgcaaattagcaataaacactataaaatgtaacggataatagaaagagtttagactaaatggaaaatatcatttaaaatattcccttggtgtgggtgtgcatgcttgtactaatttaatgccatatctacctcacttagattatgtatgtaggaaatacttaatgtaataactaaatggcagattttgaaatgatgtgatctaggatatggaaactaggaatggaattaagaataatgagataaatttatgccaaaaaaaatcattgtaatacatgccacatatatcatgtgtagctttaattaacacagaaaaaaatgcaggacatcccattaaaagtaaaacaaagaacaaattgaaaatgctttctgaaacacagttatatgttcacaaggactgaccaatcctgatggtctaattcattagtgtcatgtgactgtcagtctggaagtgttatattttactcacgtacaatctaatagcttttcagcttgcctgaaggtgttatctgcagtatgttcatcgttacttggtagagcactttaacactactttgaaagtgaaaaatatttgggaaaatagactgtattctatcttttagttttatgcagcataactataagtctctgtattattattgttgttgtttttcagcccctctgactgataagccacccaagcttttgtatcctatggaaagtaaactgacaattcaggagacccagctgggtgagtaattccttaattctagttaatatgctgctctcgttacattgtgacagttaataagcctagattgtaacccgatgtaatactcgcagctaaatccatttgtattcatagggaacagaattagaaaatgctagcatacctagccatttcattccttacagtgcgtgccttaggacccagttggacatatggatgtaaaaactcacatgctatttagatggttattggaaaatgagataggctgatgattttagtgatggtattacagcactgtcttacaaggtttgaattggttttcaaacagacactatggaacaatttgatttataatatctattaataggttaagatgcaatttctgaaatttaggggaaagggttcaaatttattaaaataaatgtcaccattatggttaaaaaacattttaagtgtaatcaaatataatataaattttgctagttatattttggataatctattaataaaatatgaccaagtgacttttggttaagggactagcagatttgggacataaggctatagacaaaatatgtattgaaaaaatgtacaattatatacgaatcagaattctgacttatcttagaggttcatctagaaattttgagtttgatttagctatattcagttatactaaattatgaaaaatttccctcttaattataaatatatacatagcaattctgttatattctcttaggtcttattttatttgaaatgtagtatgcaggcatatgccataaactttggcagaagagtttttgtttgtagtggtgcattataaaaggttatcaaaaatatgaatttaaatgaatatccatgtttgttaaggaatttcttcttagattaatcatacaagagtgaaaatgcatgtactgtatataactaaaaagaatcagtataccatcccttaagttattaatgttattcttattcctggagtgagaatttgcatcaaaattgtaaattcattttccaaatgaagattacagatgtgataatctttactaataacatacccaaagttatagtacacaaagatatgatgatggttttagcacctataaaattattgtggtcaatggctttctagcacttgaaatgcttatatttgctaagtttaaag

SEQ ID NO: 383 - DNA, 2028 bp, Homo sapiens
tttctttggccagttgaaattttgttgtatcgaagttcacatacaaaagatgaccaatggcttggaaatcttttttgaaaaagaaagccattgcaaatatgcttattataatggacgctgactgtagcgttaggccttattgttcccattttacagaatagaaagctaaagaaagttacttgcccagagcttatttttaatcagtaactgaaatgacggcaccatatacattgtctctaatatttaatattaaattaccaaaaaaattgcctcagctgttcactgtgatctgaaacatgtgttgccagggctctttttcattcccaggatgaaagatcccttgtaggtatgtggactgacatatcgacacgatatttcccagatgaccaaatctgtctcttcccccataaacacccataacaacacatataaacaagctgttcttaaggaaaggacctattagttgagtttatatctttgatgtgaactatcttttcacttctatatatggtttcaatcaactgacaaacagaactcattctagcttcctcgaacccccaaacacaaccatcatagaaacagcatttctgaattgtaggcctaagtgccttaaatgtctccatggttccagctgcgctctcagcattgctcccaccaccatcatccttgcgaggagacaaaatctcagccttctgtgcacagcagccctggagctgaatgtcaggggacccagagggaggggacgtgacctacatgtctttattaatatttctgaaggacctcagaatgacaaaacatcagtatggttgtgctgaaagtttaagcagcgtaagaaagggttaaagtaagcaataaattatggcagaggcaaagaagtgttaaccacagggggcagcaactaaacttattgataatcagatacaacagaggagcctgttcttgaaattaattattttccagggtgcactgccttctccctagatctttctatatactttcacctccaaaatcactcatctctaaggatagctggcagtgccttatcctaaaagaaagcatctttccctctcaaactacatttgtttcagaaattctgtaaggccagactctcttaagttgcttagcaccaatatttgtgtcaaagacaaaaaaaaaaaaaattacttcctatccttctcttcttcaaatgcatataaatgaaagagttggacaacaccatgtaccaaagacacaaagtcacatttgggtgtttgatgctttccttccaacggacctttggtaccagaagaaaaatttatggcagattagaaacatgggtaaagtaagtaacctacatgaatagggtcggacgtttctcaaagttaagaggataatttcaattctcctccgatctccttaccctcaacccagaaaagaggggcaaggcatgtgacagggacgcttggggaggcaagaccttatttgaaaatctgcctgaaggccaacccgttagactgcccggggccctccacccagcctcagttctatgggggacgtggagtcaggcgatgatgtcctctgaggcagcgtccatctccccttaacattaaggaataaggccagagggttctcgctcatttgggaaaataaaaaaagcaggaatggggcgctggaaattctataagcttttccccaccactcacaaaaacacagctgtgaaaataaataccaccccccaaaccaagggtctagggccaccaacagtcctcctcctcctcctcctcctccttctcctcctcgtcctccagatccagctgccaacagcatcccccgctcctgaagaaatgcaccgcccagaagggaacggcgaaagggggaagaagtccaggggacccccggcctctggccgagagcttgggtgggggcctcggccgtcgccactcacccggggaggggaaaagctccagatcgactttttccgtcttgatgatggtgagagtcggcttgagatcgacggccgccttcatggtgccaggagtgggggacgta

SEQ ID NO: 384 - DNA, 2033 bp, Homo sapiens
aatgaacacatttattactatgaatttacacaaattcttcattgtctgtaaacagcctctaattcttttttagatttgagagataaaatgtgtattccatgaagtttgtgagttaaaaactctaactgggaaaaatgttaaccagaaagatgtctgattacagctaactctctggacctaattataacagaaacagaggctcttagaactctgcttttacaaaactatgtagctcttgaatttattccagacaataaaggagctctatgtgcctttattgatcaagaatgttccatgtacatcccagacaactcaaagctgatctgagattcgtctgacgttaaaatgaaatcacttaattatatcagatcaaatgttaggacctgtgatcctgggatagtaatctattgggagaatctggaaggaaaattacagagtatcctaatactaaaaattgtgtgtgttttatagtatagacataattatataataccacttaatcccttattaaaaagaaattacaagtgtgatttttgtgtcaaaaatgttgactaggtaaaaaattatttgaacaaagctagaaatgaagggacccttagcaaaagaaatactcgtactaatgcagattcaagtcttaatagttgaaactgtgggctgtgagagagaaaaatgtggagacaattgcaggtggaacctctcttaatccaaggaagaatacatcagtattacaaattaattctttaagttgatgaatagctttttagcagtttttgaacttgccagcaagcttgcagataaaaacatttctaagtaaattatatggcatatgagaagatagtaagtgcaatgtagaaaagtaaagtggaatggaggataagtaaaggggtcagtttttaataggatggttagggataatatcactgagaaggtgatatttgagcaaaacttgaagagaggagggagaaagtcatttggatatataaagggaagacagcaattgcaaaggtcctgatacagggccatgtctgtcatgtttgcgggagatagaatttatacatatgaaactgaggtgaaggcaatacaaaaaatgtgtaataaaacaattctatggtttttttttttttttttttgagacaggctctcaattgctcaggctggaatgcagtggtgtgatcatggttcactgcagcctggctgcagtgagctcagctgcctgggctcaggtgatcctcccacttcagcctcttgagtagctggagctataggcacatgccaccaggcccagctaatttttgtctttttggagagacatgggggttttgccatgttgcccaggctggtctcaaactcctcggcacaagcaagctgatggtcttgccctcctgaagtgctcagattataggcattagccactgcacctggcccatttctataaattaaatatataagtgcttagtaatgggaaaaatattccatgacattgaggttttttttttcacaaaatatcttaagggaggtgagtttaaatccaggttttccaggaagttattaaatggtttggtaagatggagggcattctaggtgggacaatgtgttggttaatataggtgtttacctatgttccaggcacatagtaagccctatatatatttcagctgttaatattagggatcaaatgtagtttatgagaggtaatagacttagctggcaaggtttagctggcaagaaggagtcactttaggtatgatcaagctactatttttaaccattaaaatagatctttgaagttaccattacatgttaaacaggatttctttcctcttttttatattctagataccaaaataatttccctttctcatcttgaaatgacctggactaacagaagaaattttcctgcattgcttgtgaggatcttacataaatcaaaactgcgatactatggaaaacctgataaaaagatgattgaaccatatcaggtacaagtaataagatatcatatgttaatttaaaagttataaattatagcttac

SEQ ID NO: 385 - DNA, 2061 bp, Homo sapiens
acactttaaatcatttttgcaacaggaagagtatggacaaaaacccttaaagtgattgcataaagtataataaaaactacagcatatggttaaaaaaaaagattatctatattagaagaatgtaaacaactgggcatggtggctcaagcctgtaatcccagcactttgggaggccgaaacgggtggatcacttgagcccaggagtttgagaccagcctgggaaacatagtgagaacttgtctctattaaaaaaaaaaaaaaagaagaagaagaacataagggtaggaggaatacaatgaaagtctgtatataaagtgaaagatgtaaagccttggacatcttctagagatgtatcatatttcttgcaattagtttatgatccaaaagttaaaaacaaaccagttggattcacccctgtgacaggagacgtatttccactcttcctcatatagggaatactgtgtatatgaaataaaaccaacaatgtccacagtaacatttctaaactaaatatattaaatgtcatactaccatttgctataacatgtctcaacacagaccagtgatataataccaagcacaattcaagtgaaacaatattacaaaaccaggtgctcccaaaatatcaaacagcacagtttaatgtaaaagtaaaaaagaatcccttgtgagtactactattttagtccaactttgttatgaaatgggtagaagccctcaagcagaacaagcactttgccacctcaagagtggagatcttctttgttgctcattaatggcacaagacctaacccctaaggaggtggactgacatcctcttatgaaaaagatgctctgccagaggagaaggcttctgcctacagaacaggaaaacccctcttcatgtttacctaccacagtttttaatgcagtgaagatacacattgggctggttccctaagtgtcattcctgttccctaaatctaattttatatgagattacctcaagaactgatttccgatctgcatgtatttgcatgacattctcagcccattccatcagtgactcgccacgtggaacttttactctttcatgcttgagacgaccaactcgaaactctccagggtcatctcgcctaacactgcttgtggttctcgttcgctccacagtggcttcacgtcggttctgtaaccatactattgctctgaaatagaaaaatatctatgagctgcagcatacgttaacagctgaatgtactactaaaccagcaacagaattcaaagatttaagaaattaaaaaatagtattttatcaggtgatttttaaaacacagtaatctttttttgttacataaactgcttcctgtcacaagtaaaaatatatgaaactccttttattataatctgccttaagcaaactgagaaagtactgggtctatattttgcctccttattttagcagttcaataaaaataataatctgttgtccaagccccaacatcattcaaaaaaaggaaaaatgtttcctatcagagaaatttagaaatgattaagctatctttcaaactgaaagccgccatcaaaacggtaattataattttaaaacaatttttcttttttttttttgagatggagtcttgttctgtcacccaggctggagtacagtggcattatctcggcccactgcaacctccctatcccgggttcaagtgattctcctgcctcagcctccccagtagctgggattacaggtgtgtgccaccacgcccagctaatttttgtatttttagtagagatgggggttctgccatgttgcccaggctggtcttgaatttctggccttaactgatccacccgcctcagcctcccaaagtgctatgattacaggcatgagccgccacacccggccacattttcttttttttaataacaatccatttatggtgggaggaagaaccgacaattaggaataagaagctgaaggttctactctcatgtgtgctactattttctcatgatcttaggcaaatcagctaagtacgtgcagaatcaatttcctcatttataaaacaaattataatc

SEQ ID NO: 386 - DNA, 2178 bp, Homo sapiens
accttcatagtgccttttaaataattctgtcagtccattttaatgtagccaagatgtgcagagtatgagtgtgtgggaagcggttggcggaggactgaattttttttcttttaacagaaggacatataacatttgcttccttctctcaaaatattagtggttacataattaaaataaaatttattgtaaaggtttcagtcaaaaatattgatgaaaaagcaatataaaaccaaccatgtgtgtagatatgtatatacacaattatataactatatctacatgtacacttttcatactaagaactagatcaatgtctttaattccttaaatgtcattagctcaagtttgaacagaaacatattacattactttttttttaaccaaaaggcttcattcatttaataaaacaagaacttacattttatttccttgaacggacagagaaatacctttcatttatcaagtgtgtaaataatgcccatgtgacagaaacatgcataataatctcataagagaatatccagagataaaagacaagttgaaactcagggacattttacccaagcaattaatttccagatggagttgccttgatcagtcatgtaaccactgggtaagagttctaaactatcagaaagagttctaaactatcagaatcaaaacagacaatacaatagaacatacttggaagctacctggccaataggttcactcatgtctttctgataattcccctggtcccacctcactccctttctctgtctcttaccacagctaagcagaaattcaaccaagtaactgaccacatgtactgtgtgttgatctataagaaaaactggagagagaacttgaatcatggcatttgtgcgtatgaaattcaatcacatactggcactcatctaagactgatcccacttaaagcacccaaacgggacctacctaattaattcaggagatgtgttactgctcagaagagtcaatcagcagcgtaagtatgatctgtccagcagaattaactggctcatacacatgtaagagagtgacccagctactttgatttcctaattttgaaaacgctaatgattattttagcatttctttttttgcagatgctatggctacaatgactgaggactactggagagtccaggattgattaagtgtctggctgagagaccaagaggaccagacacatgggaagtgctgtttctcgaagctctgccttcaggcagacaaggaaagacctggtcgttcaaagatgtataaaagccctcccttgcccatccaagcctgatgcttacatgcaacttttaattgaccatcccttggtcctgagcacaaagttctctgtaagagcagctctataaggacatagtgagaaaggtcagctccctgggacgagcatcggtattccatgagaacaccaggtctgttaaaggttacccgtctgcctggtgtgactggctggagaaataaggtagggagaatctagatatggttgaattgtcattgctgctcaaaatttgtttctttgtaacaacaacaacaacaacaacaacaacaacaacaacaacaacaacaggtgaaattatcttgaaatacaaaagaacgtctgttggtcctgagagtgaaaaaaggaatccttaacagcttcagcttgcaccaagaggatttttttttatcagcttcccttcataagagaggatggaggattttggaagagacagaacctgggagaaattcagtgagctgccacttactgttaactactccacagaagaactatatgtttattggaattcagtaaatgtggcatgtaaggatttagtcaatgtctggcaaaatgctgccacttaggacccatttggctaatactagaagtagtcatcaagttaactgtaactgcccaacattttcttagaagccaaagaacttaaacttttatagaagaacgcccagtcagtactatattaatgtgtgtattacatttattgactgttgaacagagcctgattcccaagagtctttaaggccataataaatgcaaaaattgtaactaaatttcctttgtactcttcagtctttcttgtaacctcaatgaaactgaaagtactattttaaaagtacaatgactacgacaaaattccatttaaaaatctttaaagtgttgggttctga

SEQ ID NO: 387 - DNA, 2193 bp, Homo sapiens
tagaaccttcctgtcgttacaagttctaagtttggtttttatctcgcaagcagcactactgtgtgggaagttgtggggggtatggagatgaaagaagaggggcgctacctcctgggaagtgacaacctagcgggggaaatagatgtatcttcccagtgggggtgagaagtgtcattctcacctatttcagcagccttggtggtatgaaaaggcatcccaaccagcacagaagcaggatgcctccaagactgccttggttggcacctgcagcctgaagggggagaaaaaggctttgctagctcccctaccatcgaggatgaagacccccactgtacacagtgtataaggtttctttccatgtgaatcccagtgactctccttaactgggtggaggtggaaggtgtcatcagccttgtcccagatcgagcccctcaggcccacagagccccagtggggcctggctattactgacactcatgtcacactgagatgtaagacggcagcccaggccaagcttccccgggccccctcagattctcgggccctcccactcccctcaggcttcctcggcctccctgccaaacatctatctccctttggaccccactgctccccaaaactccccacgcccttagtctgttccttcagttccccaaactccttcagcctcatctagactcccctccgtccctcttctaggaccccaaaagctctcctcggccccaggaccccgcagaggtcccgtagtcccatctctgagaccccacaaagcctttcggacccctcaggtggcccttaggcctccggagatcccttggctccccacactctcctcagaccccagctcaccttagcctcgccccgaacccacctcacacaccccaaacgcccacaagacgccgctctgtctagtctctcccaactcccgcgcacccccggacgtcccccccaccccaggcccggatcctggaatcacctgggccccgcgccccacgccccgccgccgggcccacctgcgcgcccagctggttcagctgctgcatgtcgccgcccacggcctccggcaccgggtcctcagtgcagtgcaggcggcccatggcgcgcgccccagccccgcaggttccaccgccgccgccgccctgctcagcttcctcctccgctgccgctgccaccgctgccggcctctccgcgcatccacaaccgcactttcgccacggccgtcgcagcgcactcctcccccggccgccctgggctgtccggagccggggagccctcgcagggccgcggacacgcgcggccgccgggctccggggaggggcaggggcggcgccggcaccggcagacgcgaggtttcctgccagctctcccgctgagtgacctttgggtacggcgcttggcctctctgaacctcagtttcaccatctgagaaaatgatggctggggtagctccttaaatgagttaagcctccagaaatgtttaacgcagagaccggcacacaagaggtcttcaatcaatggctagctgctattatcatcatcactgttactatgcactccagagatatttatggcagcctactcgatgccagacactggggacagggaagggaacaaagcaggccagagtgtctctcggagagctgacatcagagtagagactaggtctcaaccttggaagggcatcagcatcaccccagcatcacctggtattgccgggccccgcccccagaggatctgattcgaaaggccagggtggagcctgagaatttgcatttccaataagcacccagggactacactttgagaccttctggagtggaagaaactgacttaccaaagtttcctcaaaatagtgcgagggctttgactgtgcggggcagggagggtggtggtgaggtgggtgaggggaggttactgagaccgtgatcatcactgcagcccctcaaacactctaacccccatgccctctcttcccaggggctcctcacagttcccaggtgaatattaccctaatccccactggaaacatgagaaaatagagacatgctacccagaatctaggaactgaacgccaagcctaagggcttcacctagcccctaagtccagccttgagggtaaagaggtaatgccgagaaacctggagcagggaaatgtggggggtttggctggccttcctcaccagccctcctcct

SEQ ID NO: 388 - DNA, 2195 bp, Homo sapiens
attcctttaatttctgtgccctttcaggattatatttttccctcttgacccttcccgctacggagagaagtcggttcgaaaccatcacagcacaattcacacacggggtccccggcccgacgcgcaggtggacgccgcggagaaacccaccagcgacaccctcccgaagaggggccggggctcctccccagggcgcaggtctcgggaaactaacggagacggccccaccgcggacgccggggaagacggcccaggagggcccgaggcaggggagcccggggacggctggcgaggggcggcctctgcgctgaggggagccccaggccgcgcaccccaggcccgcctgacagggcggccggcgggggcggcgttcgggaaagaagggagcgccccgcgggcggcggctgggggcgtccgcccaggcgcaggaggggccgggtccgaggcagccgcgccgccccagccgggcgcccaccccgcacagccccccgggcgcggcgtccggggatccgaccggcggaggctctggcgggaagggatcggggaaccggcgaaaccgtcccgggccggacgccgcccactcccgcggcctgccgcgcccacctacccagcagctcggcccaggccctccggcggccccctgggtcctggcccgaggcggagttcgggacccacgagtcggacatggccttggcgcctacagccccggcggcggctccctgcgcccgagcccgcgctgccttcctattggctgcggccaggcgcgcacacccgttggctggcggcggccaggccacgcccctcaggtcgaggccttgcgtcgtggccatgttggtcctgggggaggcgcctgcgcgcggtgaggtagtttttgcgtttggctttgccgccgcggtgtagtccgcgggggcgtctcgcgcgggcagactgccgcccctcaagcgtggttcctgccgggaatgactggggttggtcctgaagagaccacctggccaaccaagccgaggcaggctcagagcgccgcggggagcgcaaagccgcgcgcgcctctgagctccgggcagccgctgttcctcccggcggccgaacggtccgcgcgcagggcggtgtttcggcagccggagaccgcgcggtagccgcgcctgtattcccagcgctttgggaggccgaggctggagggtcgcttgagcccaggaattccagactagcctgggcaacagagcgagaccccatcacttttgtttcttttcttttttttttttttcctttttttgagacggagtctccctctgtcgcccaggctggagtgcagtggcgcgatctcggctcactgcaacgtctgcctcctgggttcaggtgattctcctgcctcagcctcccgagtagctgggattgcaggtgcgcgccaccacgcctggatgatttttgttatttttagtagagacagcgtttcgccatgttggcccaggctagtctcgaactccggacctcaggtgatccgcccgcctcggcctcccaaagtgctgggattacaggcgtgagccaccgcacccggctgagaccctatcttttaaccagcctgggcggcagagcgagactctgtctcaaaacaaaaccaaacataagaattcgtaaaagcgagtgcctaggcgaagctaatgtgcctcaaagtcctgggtaagtagaggccctggagacccgtccgcatcctctggcagtggccttggaaccaccgaagggattcagccgaagggccgcgttcccggcaggcgtctttattgtgttgattacgtagatggcgtagatgacgtagatgacgttcagcaccacaaacgaagagccgaggcacagagtggggccttggattcatgagatggggatggagcagaaatgagaattcggagtccatgaaacccccacaaagactcctgcacggcccgactcggacactttgcaatctgctggttgagggggatggtgtgaactcagggaacagcctgagatcgcgccgctgcactccagcctgggcaacagagcaagaccctgtttcaaaaacaaaaaataacactaagcaattaacaggactagactcagaggtgatcgagaaattgaaacaggctggaaatttaaattaactgtgattaatatgtggaggtctcttgtacgaaaggtgaacaatatgcatgaggaggaaa

SEQ ID NO: 389 - DNA, 2228 bp, Homo sapiens
tcccttgttttatactggaaaattatataattcatgatctctaattttcaaacattctcaaaagtttagatcttcagagataagctctgaaaatatagatccatacatataaaatatctatgaaattcttttaaaaactattgtctaactacaaaaataatggcatatacatgcataaaccatctttaattagaaaatttagtaacattcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctacaaaaaaaaaaaaaaaacaaagcaagcaccttggtaaaaatccagctattcagttttctcatgagattaaatatttcaaaatattctttctgtatcagttggctttttaagtatacaggggtctagttttttatctacaaatttctattcaaatatgagctctattttgaataaaaggggctacgttgtgagagaagttctaaagacctcaaatgtccttagacacaatggcacttgacttgacatgcttttgcagacttgatagtatttggtttaaaacagtggtttctaaccactggaacagcagaaacagacttctcaactattagtaatcacaaccaaataagagcagagtgcataacaaaattagatattcaaacggagtcctcccattccaagaaactggaaacccctagtttatgttaaaaggccagtctaaattctttcacttacatctttacagaaaactatattttctctcttccatacccagaaatctaatcagaaaactgacttttctcatgttcaactggacctaggggaatatgacagaaaagcatcccataggctttaatatactttttaaaatatataaaactgaaaattaatagccatttaccctgaaagagttctgcgtggactttgtcacttgcatagtaatagcatgtgcctcattgttcagaagattagctttaggtcctattttcaaatacgaaatggtagcataagctgtaaaactgtagtcttctctgcagaaaataaaggccaacaataagaaagcttttgaaggaatcacggaaaacaaatttataaaagaaataactatatgcgcagtaattcttaacacattgacttgaaataataaaatttacaagaatgcaaataaagcctttaaagaaaatattttcgttacttttttttatttatagtgattaaagtttgagtgttttaggtaaattactttctatagcatttaaaagttcacacaaaataactgcaaaaccgtttattctgttgcaatttttaaaaaaaaaccataaagacaacctgaaagaataatgaatgagtttgtacatacttaagatactgctgtattagaaagtgtgcaataatcttctccagatcttcacgaggaagtgtgggagccacaacacctgctactctcagttttgctgcaccctttcccatccaagaatcaatcagtttcaatggagtgagtttttcattcagttcctctgcctgcttcaggatcttgattagatctctgcagtactctgttatgttctttctttcaaatgctgtaataaaacaaatatggtagcaggtaattaggatttagaaatgagggcaaagataggctatcttaagtagttaaactggtttaaagctggttatcaatgtgagccaccctaaacattgatttttaaatgtattctgaattaagactaggctattcctcaagtctctgtcactagaccaagttatggtctctgtaagcattgtggggtttacagtgatatatataaaaaaaaattggttatcagaagccctgccatatactctagaaatcagaaagtgtctgccagacatgattactaagttactaagaggtgtgttttataggagaccctgtctgttctagtataggctcctgagtgaactctgatttagcaacaagaatgtcctcaactgataacccaattattaagagaccagtactctgatttatatataacactcttgttattttataagatagtctaataaactcataaatttctctgtctgcaaagttaaaaatacagtggcttccacctaacaaggcatcagaactcagtaaggtcttaccatgaggtact

SEQ ID NO: 390 - DNA, 2263 bp, Homo sapiens
ttgtgccttaaaaggtcattggccctttatactctctataaacatgtaaaaaaccgtgtgtgtatatgtatgtatgtatgttcactcatgcactcatttatttatttatttagaaacagggtctcactctctgttacccaggctggagtgcatgatcatagctcattgtagcctcaaactcctgagcttaaggtatccttctgcctcagcttcccaacatgctgagaatacaggcatgagccaccatgcctggctagtatgtttttacttatcatgaaaagattagtaggaagcatttaattttcctaactgatggtcacacaaaacttttttttttgtaatttattttcctgtgaccaccattgaggttagatgcatctttacgtgggaaatggccatttgtatttcttttaccataaaatgttttcataggtcctgtgccttttaaaattgagtttgtgttttactcttcattgtcagaggttcttaacatatttggatgtcacctgttccatatgatgttagtaggctgatgcctgtccacaatccaagaatagatctgtcctagatctttgttctcaaaagtcatccagttgtcaagaaacctgagatgtgatccttccacatggcaaaggttcccatcaagacatgaactaggctgccgattacctcatggccaggaaaagcatgggggatggatttattgattggccccacgttgcatccaagcactttggccagggcccaatacattgccaaaatgacagtcaacaggcctaaagtttactctcatgatgttctccagcctgccatcaaaatacttttctttttctggccacttcttcaacctctgacacattaataatattcccatatgattcatatgcacattaataattgttaagttggggaattttattcttttttttcctttgaagggtaaaaattttatttttgaggaacttcttactgcacattttccaagagagtcacataagaaagcaaaaatgttatcctcccctcatcctagaaataaataaggacataattttttttttaatcatgacacttggaggcttagcgccagcatccaaaatgaacaaaaacggaaaaaaaagcatttattttatatttcagatttctttggttggggttctccccatgcggtattaatattacttgtttcaatatctattacccaaacagtaaaaaccaggaaaaaaatataaacctagcgcttgctgaaactggggaggctgctctcttgtcttctgtgcaggaattcccaggttctcagtttgctggaaaaatttgttgacattttctttttgtagttgtttcttaaagaataacagcaaacattccaatgtccaaatcttggttcgtcttccactttattgcttggatgtttctttggtgttggtaaggctgtggcctgctttttgctttgtttctgaacggtcattaattctttaggtcaccctgccgatggtgaaggtgcctggggagcctggtgttactcagcactgctctgctcggtggatggagcagggttctcagttggtgcttcacctgccgtggcctctttgccatcttgtgaaggagcgttaggagaacgtgggcgacgccggtaattgtagggacgccggtatccacggcgaacaggcggctggtttggaccactggaggcttgctgattttctttatcttcagcctctccaactgctggggcaggtcgtgggcgaggaggtcccctgctatggtaccttgggcggtaagttggatttcgatgaaatggtccctgaagttgtgctccttctgggactccatccttcagctctccaatctcaacagcctgtattctgttgggatggggtaagaccggtgagcgacggtcaaacgtctgtcccacgtggtaaggcgggaaccgctgctgcctgtactgggggcgatactgggggcggcgcagccgattccgggccccagagaactgcctatcagtggtaggggggtcaaatccttcactgctgccgctcccttcttcctcctcctcccagcgtaatcccggggagggccatggcgccttccatagtagccacgtctgtaacggcgccaatcagcgcgtaacgactgccctccacaggaactccaccccggccagtcacactggctgcttctgcacccttctctccttaaaccacatcaaactctacagtttctccatctcctacactgcgcagatatttctgtgggttattcttct

SEQ ID NO: 391 - DNA, 2410 bp, Homo sapiens
ggttctctgtaactgttagagaatgcaagttcatgtctgaaaacaaagccttgaattagagataaatttgggtttcattttgttttgcaggatttaaaaaatgtcactaggtactgctatacatcatgtgactcttaaaggttttatctaaattagcttaatgataacatcatcagcactttcacgtggcaattagtagtgttttcaggggatttgttgcagttgatgtgatttttttttttttttttttttgagatggagtctcactctgtcacccaggctggagtgcagtggcgcaatcttgggtcactgcaacttctgcatcccaggttcaagcgattctcctgcctcagcctcccgtgtagctgggactacaagtgcatgccaccacacccagttaattttttgtatttttagtagagactgggtttcaccgtattagccaggatggtcttgatctcctgacctcgtgatccacctgtctctgcctcccaaagtgctgggattacacgcgtaagccactgcgcccagcccgcagtttatgtgaatttaaggttagaacagtggctttcaattctagctgcatgttagaaatgccttggggcctgaaaatgagcaaatgtacactgtccagagtccatcccagactatttaatcagaacctttggaaggtgagggaggggactgggacctgagttatttaaatatacaactaatttagaggtttttgttttttttttttaactttctaaaaatcttgtcaaagctatcagtaaaaggaaacttaaaacttctcaattagagaaaatggaaatgaattgtttctgtataatttcttttcatttgctattctggcattctccccctccctgcttttagtagcagccttgaacaagattatttaattttcaaaataacattttttttaaaaaaaatgactgctattgtcactatcctgcttccttctcccttcatgggagtacaatatccatctacctcctaccctccttgccttggaaagtggcagtggaactctacagagctcctcatgggatgaagtgaggtaagagagtgagaaatggggggacaagagtgtcagatttaacattagaaaacttgggtttgaggccaggcacagtggctcacgcctgtaatcccaccactttgggaggccgaggcaggtggattacttgaggccaggagttcgagactaccctggccaacatgaaaccttttctctactaaagatacaaaaattagctgggcgtcatggcacacacctgtaatcccagttacttgtgaggctgaggcatagaattgcttgaacctgggaggcagaggctgcagtgagccgagattgtgccattgcactccagcctaggtgatagagcaagactccatctcaaaacaaacaaacaaacaaacaaacctgggtttgacttctgtctttggcagttactaagtcatatttacttggtgaggtagggacctttctgcattccattttcttactggaatccctatctggccttccttaaaagttacgtaggtggttccacatgaaagaatgtatgtcacagtatctcgctaagtttcattaaaatgttatagcagcattaatacttttcttgcattaacaggagaaaaagaggaatatttcgactgatgtgatgaaaaggttttctgtctcagaaagaggatctttgtggcctaaagcctctgaagtccagtctaactgttaatttcttatgccattgtctagggctggagaagtggcttaaaacatattatttatgatcttattaatgatatatgtttatagatgatcggatataaaagacctagtctgtatactgatttatgacccatatattcaccattatgataccacagcttcttcatttgcttaccttccacttgtataaatttctagctcctacatgttttgccttattgttaatactgttatgtgaaatccacatcttattatattcagccttgaatataaaaggcagacaagccattcgtatttgccagtgtaattatgtgcttatgatattttcatacagtttaaaatagttgatgctatatggatttatcacagtattttgtaatacatttttacttgctgcttaatttgaggaggaaatattttgaagtttctcttttctttgttttccctcagagctaccaatccatcctttaaggaagtattgtcaaggattgagtcccatgaagactgtaggaacttacccatgatctcttttctcattctccccatgcagagggtgacccgccttcccctgctgatggatgtaagacatgacggtggctttttcctctgtggatagctgtgcttctctaaatctgatttagaaaattattattattccacttaaattgatgcata

SEQ ID NO: 392 - DNA, 2502 bp, Homo sapiens
atcatctaagataaccaggtagaaagtcaccatccactgccctctttcactattctgccccccttttcccctagcccgtggcctcaccactgtcagatgcctgacaagctcagtgaaattggggctctcacggtagctggccaggacctcagactccacaccttgcccagccacctccagtacaacctggggctgctccacctcgagcagatgcacacgaccaagtcccctaagaccccagaacagcacctggggtcagaaaatgggagattcaggggcctgcaccagacaaatgggcacccggatgttggggaacaagggggctttgagtgcctggtgatacctcaacacggaactccctgagcactgggcacacgttgggtggaagggacaggcgtccagagtggggctcaaccaggggtgccagatcctggggctccacctcactgggcactgagggctgtaggagggaaacagtcagagggcgaagaggaatcaggccaaaggaggaaaagcctaggtgtggggaggggatatggagaggtactggtgaaatgtaaatgcacaggaaccaaccaaggctggattggtggaagggagggggtctcgggaagcagcttcgtgcaggaagggagcagggtgtctgaggcatgcaggatggcccaacaaggtgaacctagcacatgaatacttgcaatgttccttggggtcaagtggtccaatgaggtgacctcaggacaaacctgcagtctttattctctggggaaaagagacctggaggctggtcctgggacatatccatgttttatattccctagggctggatggcctgatggactaacaagttgggctcacagcctgtgctagccacgccagggcatgctgacctcaagtcggccactgtagtctagttcaatgagttgaaaggcggcaatgagctctccggctgcccagggtcccttcctcagggggaagaactgcaactctgggcgttggtatgggtcctccatcagctttacccttggggcggccagtgccctgcccaggaacacgggggggccctagggggagcagggcagtgaagacaaaggggaagaggctcaggagccagggaaggtgggcatcaagggggaaactcctggccaggaacccagggagggcccaggccacactcacaaacttattgtggtcaaatacattgatgatcactaatggaggctcctcctgcaggtgctccctcctcccatccacgatcaactgctcaaataccaggagttcatcccacagagggctcagcgtctgctccaggaccttgggggccatacagagaagcgggtagcagcagatatcaggagaaggctcccaacatgcatgccatgcgaacacccctgctctgaaggaatactttaagtaaatgctcatcacaagaagagtgagatgtgaggaagacgaaagcatcttcagttggtgttgcagccagcccctcacagccctgcctccccattgcaattggcccctcagagtccaggcctaaagtcaaccccagaaaatgactcctcgccgctaagacctccagttctacatcacctgctaagttagggccatctagtaccccatcctgataccctgctctgcaaacccagagtgcgaggagaggggccttggggaaaagctcagacccaccctaacttgtctcctgggtcccttccacccacatgtcatcccagccctcacccgtgtggtctgacactgggtagagatgaggactcgagcaaaggggtccgagaggccactgtcatctgcagccaacacaccccgggcctggtacaagtgagcccggagttggaagtagctaaagtctggggtgaggggcaaggaaggtgtcatgtttgcccaggggaaccactgaagtcccctgactgagccccacaccttgggcagagagccaggtgggccttatacctgccctgcccaccctctgcactcaccgtcccggtgtaggctggagggcagcccggctgagggctcgggcagcaaatccgggggcagctcagaggtgcaggccttggcttgcttgcccaggcccagccgcaggaagagctccagcttggcacagacctcaccaggggctgccccgggtgcctgtgtgtgaagaaggcatgtcagggccccgatgcctcttctcatgaccccagctagacctagcaatcctgcttccccagggcacacctctactgcacatcgccacaccatgccaaactcccagtccactccctacctgcccagccttaccctcttcctaccctccaccctacgccatgaccctcacactcttactccctatacctcttgccctaacactgccacttcccgtaccccactccccagacccctaactacactctgagctctgctctcccacctttgtcccctccaccccctacacgtttacattccccatccccaaccccaagggtcacggcttctccctcctagggaccc

SEQ ID NO: 393 - DNA, 2514 bp, Homo sapiens
ctttcttcatatgaagataaggtatagggaagagtcatatctagtatttgggaaactgaaagaaaccccagtggacccacttgagtgtacatcatggcaggaaaaaaaaattgtttcagatgtattattttctggtaccatagataaagaataaggataatgcaatgggaacagttgaaatattggcttgtttacttgcatttgtatgtttgtttttaaatttttaccctgtgcattagttcattctcatgcttccataaagaaatacccaagactaggtaatttataaaggaaagagttttaactgactcacagttccgcatggcttcggaggcctcaggagacttacaatcatggtggaaggcccctcttcacagggtggcaggagagagaatgagtgccagcaggggaaatgccagatgcttataaaaccattggatctgttataaatcactatcatgagaatagcatgagggaaaccacccccatgattcagtcctccacctggtcccacccctgacacatggggattattacaattcaaggagagatttgggtgggaacacaaaaccaaaccatatcattctgaccctagttcctcccaaatctcatgttctcacatttcaaaacacaatcatgcccttccaatagtcccccaaagtattaactcattcaaacattaacccagaagtccaagtccaaagtctcatctgagacaaagcaagtcccttccacctataagcctgtaaaatctaaagcaagttagttatttccaagatacaatgggggtacaggaattgagtaaaaatacccattccaaatgggagaagttggccaaaacaaaggggctataggcccatgcaagtccaaaatccaatagggcagtcgttaaagcttaaagttccaaaatgatctccttaggctccatgtctcacatctatccaggtcacaatgatgcaaggggtgggctcccacagccttgggcagctcttcccctgtggctttgcaggatgcagccaccctcacagctcttttcatgggctggtgttgagtgccagtggcttttccaggtgcatggtgcaagctattggtggatctaccattctggggtctggaggactatggccctcttctcagagctccactatacagtgccccagtgaagactctgtgggggagctccaaccccacatttcccttctgcactgccctagcagaggttctccctgagagctctacccctgcagcagacttctgtctggacatccaggcatttccatacatcctctgaaatctaggcagaggttcccaaacctcaattcttgacttctgtgctcctgcaagcccaacaccatgtgtaagctgccaaagcttggggattgcactctctgaaacaatggcctgagctgtatgttggccccttttagccacagctgaagctgaagcagctggggacgcagggtaccatgtttcaaggctgcaaagagcaagggggggtgcctgaggcctggcccactaaaccatttttttccttcaaggcctcctggcctataatgggagaggctgcagtgaaggtctctgacatgccctagagacattctccccattgttttggtgattaatatttgtagtgataggaatattctatatcttgaaaggagtttctgttacatggtgcacgcatttgtcaatacacatgaattgatatacctaacaggtttgtatatgatacagtatataattttagctccatttctcccccaagaaatatagaaatattaaactctacttcctgatatgcatgataaagggtttaaagatgaagtgcattgatgtctgtaacttattttgaaatgcaaaaaaataattattttatagataagagcattaattgatggatatattttcataatgaaatgttgggggaaatacttggaagtgaatataatcaactaacttgcaaccgtaagttggagattgtatcaaatttgttagaggtgtggaccaagccaaattaaattgtaactataagttttttaaaatttgtgttgagctaaattgtaaggtaaactgaaagaagctgtgtaaaagaaccaaggatcatcatggtaaagagaatgaacatgaggtgtgtgtgtctgtgcatgcacacatgtgtgtgagagaaaaagagagtgagaaggggatagctgggcacagtgactcacaattggtatcctcaggacttgggaggtggaggtgggaggaccacatgatgccaggagttcaagacccacctgggcaacatagtgagaccccatctctacaaaaaatgtaaaaatattagctgggcatggtggcacacgccttgtagtcccagctacttgggaggctgaagtgggaggatcacttgacccaagaaattcgaggctgcagtgagctgcgattgtgccactgtaatccatcctgggtgacagagtgagacctcaaccccagagagagagagagagagagagaatattttaaattattttg

SEQ ID NO: 394 - DNA, 2672 bp, Homo sapiens
tgcccacaataacttatatttttttcagagagagagtgaaaagacgcagtatacgagtgtctctggaagaataaaatgaaacacattcagctctcaaacatcaatttttgtgataggtactttgtttttttttttttttttttcctgggatggtgtcttgctctctcgcccaggctgcagtgcagtggtgcaatctcagctcactgcaacctccatctcccgggttccagcgactctcctgcctcagcctcctgagtagctgggattacaggtgcctgccaccacgaacagataatttttgtatttttagtagagatggggtttcaccatattgatcaggctggtctcaaactcctgacctcgtgatccgcccacctcagcctcccaaagtgctgggattacagacgtgagccactgcgccgggccttgtgataggcactttaaaaatcaattcttaatctgggcgcagtggctcacgtctgtaatcccagcactttgggaggccgaggcaggcggatcactagaggtcaggagttcgaggccagtctggccaacaagatgaaaccccatctctactaaaaatacaaaaaattagctgggcctggtggcatgtgcctgtaatcccagctactcaggaggctaaggtaggagaattgcttcaacgcgggaggcagaggttgcagtgagccaagatggcgccactgcactccaacctgggcaacagagcaagactccagctcaaaaaaaaaaaaaaccggccgggcttggtggctcacacctgtaatcccagcactttgggaggccgaggctggtggatcacgaggtcaggaattcgagaccagcctggccaacacggtgaaaccccgtctctactaaagatacaaaaaattagcctggcgtagtggagcatgcttgtaatcccactactcgggaggctgaggcaggagaattgcttgaatctgggaggcggaggttgcagtgagccaagacaacaccactgcactccagcctgggcagcagtgcgagactccctctcaaaaaaaaaaaaaaaatcaattctaagattttattctccattctactggaagggacaatggaaacccgctataatcactagagcaataagaggcgttgaagtaaccggccatcactacctgcttctgcccaaacacagagccgatattttcctttatgctggggcttccacctgtgcataccacaggctgtcgttttccttgtccaagctgattggtgcaacttacacggatgcctgctgaaatgatacagtatgcatgtaagacctggaccattttggcatactcctgtttaaaaaacacaaacacaatattctacattactttaatattataggaattacacagctcaagttacaacatccaacgcaaggttctcacatcatcgcacaaatcaagggaagcactgttgacagaatgatctgtaaagaggtgtcttcctatattctacagaaaggaacgcagagcttttggctcctggtcacagtcctctcacttcccaatgtgccatgcatcctggtaaaacaactaaaaagtacagcctgtaatcccagctactcaggaggctgagggcaggaggatcacttgagaccaggagttcaagaccagcctgggcaacacagcaagaccctgtctctacaaaaaatttaaaaaaaaaattagccgggcgtcatggcatgtgcctgtagtcacagctactgaggaggctgaggtgggaggatcgcttgagcctaggagttcaaggctgcagtgagccatgattgcaccactgcactccagcctcggtgacagagtgaggccctatctctaaaaatgaaaattaaaaaactgaaacgtacattgtgtttgattttataatctctccttttgaaatgtatcttcgtataatagaaacactggcacaagcattttggtatgcaaagagatacacaaaaatgttcactgaaacaatctctatgaacaaacagaaacaacctaagcaagcatcattgaggagttgattaattatggtatagccatagcgcagcagaatgacaacaaataaggcagtgtgcaccgactaaaaaagacaatcacaatatgctaagtaaaaagtcagttatagggccaggcatgatggttcacacctgtaatcccagcactttgggaggctgaggcgggaggatcacttgagcccacgagttcgagacctgcctgggcaacacagaaggacccatctctacaaaaaaaacaaaaattagccgggcatggtagcacgggcctggagtcccagctacttgggaggctgaagtgggaagattcattgagcctgggagatcatggctgcggtaagctgagattgtgccactacatcccagcctaggtgagagagcaagaccctgtctcaattaaaaaaaaaaaaaaaaaaaaaatacaactttcaaccacatacaattctgtattacttgcatgttgtacattctatattacttgctttcattatattaacttatgaatttatcttgaaaattattccaacagttataaacacatgaaattaaaagcagcctgaaaagatatacaaactgtaaataacagttatctctgacaaatagaagttctacattcctgtattctgctaaggcactaattttttta

SEQ ID NO: 395 - DNA, 2796 bp, Homo sapiens
tcgagaaaaagagtttataatgctacaaaatgaacaggagataagtcaactgaaaaaagaaattgaaagaacacaacaaaggatgaaagaaatggagagtgtaagcaaattatttccacctaaggaacaagtggtagtctctgttgagtgaaatgaatctttatgttttaaactggttggttttaatatacagaaactgtgccataactgtttttaggctagttttttgtgccagaaacctgttagtttctttgaccttttaaaatatttttctgatggtctaggtataggcaaagacagtgtcttatttatctctgtatacaggcctttgcatggtatctttcatatagtaaatctacaatatatgcttatttggttgacaaatatttattgagaagctgctatgtaatagaattgaggagtcagctttttttttttttttttttttttttttttgagactgagtctctctctgttgcccaggctggagtgcagtggctcaatcttggctcactgcaacctctgctttccgggttccagtgattctcctgcctcagcctcccaagtagctgggattacaggcacctgccaccacgcctggctaatttttgtatttttagtagagatggtgtttcaccatattggccaggctggttttgaactcctgaccttgtgatccacctgccttggcctcccaaagtgctgggattacaggcgtgagctaccgtgcccggccgaagagtcagctattaataagatacagtgttttgtctgttaggaactccatcaaaagaatggataaataaataattgtacattgagaccaagtgcactgagttgccagatgaagtttgatgacttcatatcatcagtatgcatgtgtgttgactggtgaattcattcctccacttgctcttttaaaaagtgaatttagggtcaggcacgatgactcacacttataatcccagcattttgggaggccaagttggcagaatcatttgagcccagaaattcaagaccagcctgggcatcgtagcagtgggacccctgtctctacaaaaacattaaaaaactagctaggtgtggtgatgcatgcctgtggtcccagctacttgggaggctgagatgggaggattgcttgagcctgggaggtcaaggctgcagtgatttgtgatcacgccactgccctccaatctgggcaacagagcaggagcctgtaccaaacgaagaagaggaagaagaggaagaagaggaggaagaggaagaagaggaagaagaaggaggggggagggatagtggggaggagggggaggaatactttattagaaatttaattgagtaatataaaaccatttcagtgggagtagcagccccagtgacaagttttactttcacagagagtaagaccttaacccagctgtgtggattaaatggtggattttaattatctataccaatatattctctgtctttgacatagataatcaaatgttaacttctcttttctctttatgttttctgtcataaatgttacatttaaaatgataaaagattatatggcttgtgtatgttacagtgatgtaatatatatcaataagagtcccaattatggtatttttgtcattttctcattagatttttttcttgaatatcagtttcacagtgggtgatactcattgtatgttaaattttaacatactcattgtatgttaaaggatttagttggaaggtggaaatttacgtattaagcaaaatcagaataagaaataggttatctatatatttcattctgaaacctacaaataccttatgcttttcaggttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagtaatccctattttaaataatcttatgtatctgaaatcttacaaatattagcattttttttgaactgtagaatatagttctttcaaaaatgaactgtattgcacaacagtgtgaatgtacttaatcccaccgaattatacacttaaaaatggttaaaatggtcaattttgtgtgtattttaccacaattttagaaaataatgaactgtgttatatatagataactttgtaatataaccaggaagtccttcagaactgagttttggctaaactagttctcaaattgagttataaagcacttttagacttttaagtgagttcgagctcttacttgaagaaaaaataaagctaatcttttttgagtaaaaatttttacatttgtagtgactcttaaaaatgaaaactattggcttggcacggtggctcatacctgtaatcccagtactttgggaggccgaggcaggcggataagtaagtcaggagtttgagaccagcctggccaatatggtgaaacaccatctctactaaaaatacaaaaaacaaaattagccaggcatgatggtgggcacctatagtcccagctactcgggaggctaaggctggggaatcgcttgaatcccgaaggcagaagttgcagtgagctgaagtcgtgccactgcaccccagcctgggcgacagagcaagactccatctcaaaaaaaaaaaaaaaaaaaaaaaaaaaacatgaaaactatccaaatttgtaactattaaatttgtaacttttaggaaac

SEQ ID NO: 396 - DNA, 2808 bp, Homo sapiens
ttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactg

SEQ ID NO: 397 - DNA, 2854 bp, Homo sapiens
gaatgaaacgtgttgtcactgtatgattatctacttccagaattatggtggtcatgactggctgtgggcacagacaaagtcagttccttccatgacacaagcactagtctatggttatttgtattgatagagcccaccaccagcaaatttatcacaataggaggtttctgcttttttatcttactgcctcttgaattatgaagagaaccaaagcttttgagaaaagatggaatttagggagcttatattttaacttgttttcagattttctcaagagcagtaacttgtccaaggtcatacaaaatagagtttataactttctaaatcccagttctgtgctttaccaatatatcacttttgggcacataaatggtctccagaccaccctttcactacaggcaaaacatccccatctgctgaatatggagaagagaaagaaggcccaactacccattctctaggggcaatttgggtgactctggagtggttgcatgaccccacttatctgtaaaatggagagaacgttcttgcttgtgtctaacaatgtgcttaagcttgaatgaagcaatagttgagcatacccacaggattaacagcaaaatcaggtttgatgcaattattcaccagcttttcagagaacaaaattgaatggataacatgaagggtaatagtttcttcaatacaatccattgtataaagtgcttgcttaggagtttgacaaaagtgcattcaaatccaacttttgtctttgtatagctaagtgagagtaccacataatcttttagaatattagttactttatttctaaaatggggataatacaatggggttcacattttgtgaacatcaaatgggatttagagtttaaattcagttcctatgatatttgctgtgacctttccaggctactttacttaccccacatacatagctcctcctccttttaaaaaaacacacactccaccccacacaaagtttcccccaccccaacttcaacccctgccaaaaacagcaaaaaactggtgcaaacagcagccattgttaatgaaaaaagggagaggaccgtgggacttttccaagggtaataaatttaaaaactgtaatctgttgggagtaatatcagagaaaacaagcaagaattctattagtgactcttctgcatttctgttcattaatttagcaaaatgtgtgacctctttttgtgttaggctgataatcattcccaaacccattgatactaaacaccttcccatttcaagtcttgctctgtgtcctattgcttcaattctcttttctgctcttctccagagccacagtcactcttgatccccatttctcaacagctctattttatggcataaatatgtaggacaactaggggatggtttttttttttttttaaggaatgatcatgaggttgcagagccagaaaactactgcccatactatccatttcctcttcccacttagatttcagctttagattcctgaaagaaaggcagaatagaaaggcaggattattccttctgagagagggaaatggacacagataacccagaaaaggcaaagaatatataacagtgtaaatgcaaataattttcttttctgttggaatatagttcctgagaaacacatgcacaaacacaaacacacacacagtcaacacaaaacttgtccttgctcattgcagcttggtattcactaggcagtgtgagagtgggacttacaagcaaggcaaggtttatgaatcctccttatctttttcttcatcctgatttaaaaaaatatctttgagtccaaaaattcaaaccaacttaaaatctatttgtgaagagtgtaggccagtctccatcttgctctctcttactatatcaccaccattttcaatgaattgatgaaatgaacatgtttctagctattgagggtagtattactgtttgggaggcactttcttggtccatagtgataggataccagtctccagagccatgtccttgggcttaatctttgtgtctattttttaaaaatattctggaaaactacaggcaagacattataccctaatgtcctcttttcttggaatcacccacagtgtcctgtagaagatgcctagcctaaaaagcatggttagaataattctactaattaatgtaacatattctccattcctttgcaatagatattgtcattcttgggtagctgcttcagacatgaagctggaaataaaaacatctaatttaattttaagaataagaataagtaaataaagtggggatattttcacagaactatgcattcattcattcttcttctaattccagcagagtccagatgaagctccacaaagtaaaaatacaaggaaataaaaaggaaagtgagtatacagtatatataaagaacatctgattaagcagctttatcatttgagcatggaatttagctttgaggtccctagcagtcaagcagaagaggaaaacaattcaaagcacaatatgctgacattcaagtttcaaaattattcacacatatgtatatatagaattatattttgataagtgttaaagttaatgtataaagaggtagagtgctttatcaacaggcacatgcattgtagatatagtaaggtgtctagattcctaatttctagggctagattgtctgagtcacatcccagtgccttctcagactgtttagacagtccattgggcaggcttgtgaggaagagagcaaggttcacatagttaacagccttccctccagtggaagttttatagcaactggattctgaggaggctatgctgaatatatggaatcatctttactgccagatgataactcacatttgtgtatgtga

SEQ ID NO: 398 - DNA, 2868 bp, Homo sapiens
tccagagattgtcacactagatgtagcaaatcctagtttggaaaagttagttatcatgcaatgaagaaaactatggggaagcaaaagcagtggtgtctgtctcgataagcttcatacaacaggtcagagagacttgcttgccctttttgctgttataaacacccacatctaccttcttgtcctctgctgcagactctctaccaacaacggaggcatatgggattacccagtgggagagaagcatggaccacttctagatagatcatcttcaagatctgatctatacatgctgctgaaggatggactgtagcttccagtacgcattaggggtgatggccctggaaaatgtatccctgcattgtttcctagtttcactctgtaccttatgctccccccatctttaccctattcacccttatcacctcccaggacagtggtcaggtcttacaaaaggctagtgcttcaggaagatgtttatatctcttccagaagacactggtagctcccctcatttcctacaatttggaacaaaggtcaaaaaaataattcttggcatcatgcttggttgggagttgggaatggggattgtgatggatcatatactcatcactgtttcatttctggatttcatttttagctttggatatactgtcccattgccaatgttaacgagcaatatctctgttcttttccttattatacttttttatttgtctattatttcctctatgcttagttactattaaatgttaattttcctttctattgaaaacaactgttggagacactgattttcagcttagtatatagatagtaaaataaagacgatgcccttttattgctacaattctatcacttttacaagctctagaatggtggaatgggcgaacaacactatcactgagatcaaacatgtattctactttgggttttaaaaggcagaaatgacgaattaaataggttagccactcacaagctggccttaagcaaaaatactggaaaaacagaaaatagcaggcatctgccagaaataaattaggtcttgggaatgatcttgtatctgaactaggatccccataccctttctggtactctgaatttattttaaaggcatttctagataccttctcttttaggcaagggcctgtcctgtagcaaatggagttacctccaagactgttgtatctctgttactcctgaagcctcagaaattttagtcattatcatttgatggctgagaaacaacctggctggcgatagatgctgaactacttcctttttacagtttttgttcttttaatttacctcaataagtcctgcccctccaaacaataagttaaaagtatgctgagttagaatgttaatggatttggttccattaatccctaaaccataggagtggcaaagtggttgagagagaaacaattttatttttggcctttttattattattctagcattttagggcttccactcttttatttttagatggttaactcattgatgatacctatttgccatatagctgatcccaactgatgaaaaccattctaaaacatcaataattaattcacttaaagacgatggtccctctgtccctaagacagatcctatcaagagagggaaaagtctcttttctggaaacaaattgacagcaaaaagatgaaaaattagtctctgtcaagctggacaggaggtagttaacaggtttgtaaaaccaaacctgaaacctaccttcactgcccttcaacaaggagaaactattccctctctttcacccctttgtaacacaattctactgtttaaaaggacatcttccctaattaccacctccaataaatatccattctaaattattctccacccaattattaaagttttttacaagctcggtgggggaagattttccctgagacaaacaatgaacagagtgaggattttggaaagatagaaaaagctacaaggcaaagtggtcacagcataagaactgaaaatagccgggcacggtggctcatgcctataatcccagcactttgggaggccaaggtgggcggatcatgaggtcaggagatcaagaccatcctggctaacatgatgaaacccgtctctactaaaaatataaaaaagtagccgggtgtggtggcaggtgcctgtagtcccagctactcgggaggctgaggcaggagaatggcatgaacctgggaggcggagcttgcagtgagctgagattgcgccattgcactacagcctgggcgacagagcaagactccacctcaaaaaaaaaaaaaagaactgaaaaattctgccacctgtgatttagtcatgaagcgggtgaaacatagtcaagttggtatgaggaaaaggaaatattaatatttgtgatgagactgggacttattgagaatcttggttgtctaggaaatgatcagttactaagaaaaaagtaagagagtcagttgcattacgcacagacttgtgctcagaaaaggggtacaaggcagccttatattccaggtaagatggtgggattggggatgcactggaatcatcaatcaaatcagaatcctttactcctcctttccaatcctcctggagaggtggtgccaacatctggcctctgtatagtacaccaagggaaaaaaacagcagacacgaggagagcaagagcagcttcccagcccatggtttccccagatccttagcactccctaccctaaggttagagggttggatttctgctgatccaatcccagccttacttagtgccctatggtcattctccctggtccaccctcactatatccccctgccacccaccctgaagaacacaaagctttttagttctctgccacaaggtaattttaaaaa

SEQ ID NO: 399 - DNA, 2968 bp, Homo sapiens
tctaattgaaaatgaattttcaggactagatctgcaattcataacaccatctctatgggatatgaatgctgaactaaatggtacctcgatttactttcttaatagttacctactttcgtttgattttataatcttaaaataatattggctagtttaacacaaatactacatattcataaaatctacttcaagaagaattttaataatatcactatctttttttttttgagacggagtctcgctttgtcgcccacgctggagtgcagtggtgttatctcggctcactgcaagctccacctcccgggttcaagccattctcctgcctcagcctcctgagtagctgggactacaggtacccgccaccacacctggctaatgttttttgtatttttagtagagacggggtttcaccatgttagccaggatggtctcgatctcctgacctcgtgaccccgccgcctcagtctcccaaagtgctgggattacaggcgtgagccaccacgccaggccaataatgatattacatcatgcttaaggactgtttctaataaaatggtaagaagagctgccctcttaaaagtataaatcagtaccaagatttccaattgataagaatgtgaaaaataactactttatatattctgattatcaaaacaatacttacctaaaaacatcagaatatcttaatgaatgcaatgagtgcagaagctccataatcctggcttcaggtttttttttttttttttttgagacagagtttcactctgtcgcccaggctggagtgcagtggtgcgatctcggctcactgcaacctccgccctcagagttcaggcgattctcctgcctcagcctcctgagtagctgggattacaggcgcctgccaccacgcctgccaccacgcccagctaattttttttttttttttgtatttttagtagagacagggtttcaccatcttggccaggctggtcttgaactactgatcttgtgatccacccgcctccgcctcccaaagtgctgggattacaggcgtgagccaccgtgcctggccggttttatgtttctatgtggaggttttccattaaagtaacattcctggcctctctctcccctgcttatttaattcactcgtctccaaaggcaatgctatctactcaatagctcaagcaccaaatccaggagtcatctttgatttccttttttctgagacagactcttgttctgttacccaggctggagtgcagtggtgcgatcttggctcaccgcaatctccacctccctggttcaagcaattctcctgcctcagcctcccaagtagctaggactacaggtgtgccccaccatgcctggctaattttttgtatttttagcagagatgaggtttcaccatgttagccagactggtctcgaactcctgacctcaggtgatctgcctgccttggcctcccaaagtgctgggattacaggtgctagccaccatgcccagcctcatctttgatttatttccttcatctctcccatcagactgatgagcaagtactatagattttatcttcatacaccttcgacatgcaccttaatcagttcagattcttactatctgcatcttagcctaggtcatgcttatttcatatcaagattactgcaacagtctcctaacagtttccttacttgtatgcctatcccccataatccatttactccacagcagccaataccatcttgtacaaatatagattaggtcacttaaaatcctccaatattttcccattgtcctaaaaaattatcactttatgctgacttataaggacctacaagatccggcccctggccacccctctgatctcattgcccacttttccatccctcacccattatgttccagccatactgaccttctttctggccaccacagagcttttgcactgctgttccctcttcctggagtactcttccagactcttctaagactgactccatgtcattaaggtcttagctctaatgtcgtgttttgagagaggccttccctaattacccaaagtaaccccttactcatctattgaattaccctgatatttttgtttatttatttgtttaatgtctgtccctcaactggagtatatgttccatgatagtaagcaccttgtctgccttgttccatctagaaatctataagtgagcatggcacatggtaggttttcagtaaagttgactaaataacgacaaaaaaaatgaataaatcttagtttatttttaaaactacaataaaatataggaaaatagaattattaacatgaaaaataagtgattatgaaaaccagtagtaaatgtctacaatggtacagtggtttaacactggaggcaagcagagaattcttaaatatttaaaccaagatatgatcactttacttttttagtttacctgaagtatccacgttatcatgtccttctggccttctaactggggaattcctttgagtttttccaaaagcatttgtatattcatggctgaacttcccaatccttttttaaaacacaaaatcacacatcataaatacataaagtcatctcttggtatcctcagggaattggtttcaggacccctgtggacatcaaagtccactaatgctcaattcccttatgtaaaatggtgtagtatttgcataaaatctatacacatgcttctgtatgctttaaatcatctctagattacttataatgcctaatacaatgtaaatgctatgtaaatagttattagataatattgtttagggaataatgacaagaaaaaaaagtctgtacatgttcagtacagtgacaaccatcctttttcctttttccccctgaatattttcaaactgcgatgggatgaatccctagatatggaacccacagatatggagggtcaattatgtcttcataattatgtacaaattacaatttctagttaatgttatttacattgata

SEQ ID NO: 400 - DNA, 3018 bp, Homo sapiens
ctaaaagatttatattggggaagatgaaaggaaggaaggaaggaaacttcactttccaaaaacaaccactgggagtccgctttgtgcagcgataggtaagcttctgtgcaggaacgggcgctgctgcaccccctaccacccacgcagcctcctccctatctgccttcaggtggtagccagaggagttcagagcctctacagagagcacaacttctccagctggaactgaagggggcctgcccctccacaccggcgggtatttctcgaaaggtggagatgagagactgagaaaagaaataagacacagagacaaagtatacaggaagaaaagtgggcccaggggaccggcgctcagcatatggaggacccgcatgggcactggtctctgagttccctcagtatttattgatcactatctctaccatctcagcgagggggatgtggcaggactatagggtaatggtgaggagagggtcagcaggaaaacatgagagcaaaggactttgtgtcataaataagtttaaggaaaggtgccgtgcctggatgtgcacgtaggccagatttatgtttgactttatacaaacatctcagtgcagtaaagagcagtattgccgccagcatgtctcacctccagccataaggcggtcttctcctatgtcagtaaatagaatgtatgatcgggttatacaccaagacattccattcccagggatgagcaggagacagatgccttcctcctatctcaactgcaaagaggctttcctccttcaccaatcctcctcagcacagaccctttacgggtgtcgggctgggggacggtcaggtctttcccttcccatgaggccatatctcaggctgtctcagtggggggaaacctggacaatacccaggctttcttgggcagaggtccctgcggccttccgcagtgcactgtgtctctgggtactcgagactggagaatggcgatgacttttaccaagcttattgcctgcaaacacatttttaccaaggcacatcctgcacagccctaaatccattaaaccttgagtcaatatagcacatgtttctgcgagcacagggttggggctagggttacagattcacagcatctcaaggcagaagagtttttcttagtacagatcacaatggagtttcttatgtcttcctctttctacatagacacaataacagtctcatctctctttctttcccccacaagaacaaactccccttaaaggaatctatttaggaagattatttcaaggatacaatgtacattcattcctccaaaatatgcttagatgaacttaaataatcagaaagttgtgtgtgtatgtgtttcacattttcttggtccacacggaaccccttgagaggtccctgtgggccgtgagcctgtttgtagacacttgcttccaccgcttgatgtcgcagacatcgcagtccctgatgtagggtctggccctatggggcttagtgggtgttctccccgtgtgtggagatgagaaatcgtaaaaagtaaagacacaagacaaagagataaagcgaaaacagctgggcccgggggaccactaccatcaagacacggagatgggtagtggccccaaatggttgcgtgcactgttatttattgcatacaagacaaggggggcagggtaaggagggtgagtcgtccaagtgattgataaggtcgagcaagtcacgtgatcataggacagggggcccttcccttataggtagccgaagcagagagggaaggcagtatacgtcagcgttttcttctatgcacctatcagaaagatcaaagactttaagactttcactatttcttctaccgctatcttctgagaacttcaaagagggaccaggagtacaggaggaaagtggacaaggagcgtgaccattgaagcacagcatcacagggaggggtttaggcctccggatggctgcaggcaggcctggatactatccagcctcccacaagaagctggtggagctgagcgttccctgactcctccaagaaaagggagactccctttcgtggtccgctaagtaacgatgccttcctaggcactggcgttaccgcctgaccaaggagccctccagtagcccttatgcgggtgtgacagagggctcacctcttgcattctcggtcacttctcacaacagcccttcagcacctgaccctatacccaccggttatttcttggttatattagtaatacaataaagagtaatattaaaagctaatgattaataatatctacactaatgattgataatgtccatgatcatctctgtatctaatttgtattataactattcttattgtaagtatattctttattatactgaaacagtttgtgccttcagtctcttgcctcagcacctaggtaatcctccgcccacatctctgaggggctgaactgccccccaccttctggaagctgggaggttggaagaggggatgcgtgcgatggactcagcacacagctgggaactcgaggcacacctaagccttcgcttgtgctgtgcggagtccacacttccttccccactggggtctcaaaacctcccctcactcaacagggtggtgctgctcaaagctctgggcacacattagggctggggagggggtggtggagagggggctccagcctgcccaaccaccaggcaacggggcacctgcccctctctcagctgggtctggacccgcgtcccaggctcaggctgcaatgcctttctctttctctttctcttctttttgcagttccgttgggtcctgcccaggacagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaag

SEQ ID NO: 401 - DNA, 3108 bp, Homo sapiens
tgttttctctacctattctacttgattaaactcctcattgatgtcagacaagatcacccatatcagcatacctggatggaaaacagatggcagatggcagggagacatgtgcaatgtatgatgtgaataaactcctttttacactagcatgacaacagatgctcagaccccacaatgcctgtcagaatgctattctcatgttgagaaaagaataaacaatttttttcggactaaattccctccaaaaggtttttcagatgtagaaatgggactatagtaggtgtttgaggcgctccagctgggcctaagagagttgaaatgagtgagcacctggattatcttagagacatagatggaatcatgtttttgtacttggattggattatttagcagaaaaatgcttcctagaaggcctgaagatgattgattttattgctcacttcagcaaatcccacatctggtttgggccctatcagcagagaacactataatcagaacatcgcttgagagcccagtggttaagcacctaacttcaaaggccatgtggatttgaactctggctccaggattcattagctgcagtactttttggcaagttacttggcccctcagagtccccttttctaatttttaaaattagtacctacttcacagtgttttgagagttaaatgagctactctataaagtgcttagaacaatgcctggcaaatagacagataggagtgttagctattataattactgagcaagccaacttatgactctcataaccattagcttacagtcttggagacactttacctagccagcaaattgtatgattaattgcattactattaaacacaggtagccagaaataggctctttgtttgaatttcataaatatctaaatgtgttgcttccaggttataggattcaccactgtcagacttgctatttgctgatttaagtattcattttttccaatagaattgcttatacttgtgccttttattgttttaaataacaaaatcacttaaatttatagtctcctaaagtctttgagagttttgttattaaggcaatccaacaaaatacaagaaatacaaaagaatatttgacataatcatataaaattatctccaatatgctggtgtatttcatgtgatgagattctaacctcaattccttactcataaagtggggtggacaacctccattttgccatgtttttggcatgcttctaggcatgttttaattctcatgaattacactgatcactgagaaatgttatacaaaaataagatttactgaaactatgatttaaacttcccaacattgtcttgcaaacattactttaaaaatcaaagattttttcctcgtgttgaattcgtatactgcattttataatgcattaactttttgagctagatgtggtggctcgtgcctataatcccagcaacttgggaggctgaggtaggaagatcacttgaggccaggagttcaagatcaccctaggcaacatagtgagaccctgtctctaaaaaaattgtttaaaattagccatgtgtggtgtcatgggtctgtaatccaactattcaggaggctgaggcggccagatggcttgagcccaggagtttgcaactgcagtgcgttatgatggagtcattgcacttcagcctgggcaacacagtgagacactgtctctaaataataataataataatttttggtacttttataatatgtagccataactatttagtaaaaatatattaaagaaggttgctaaagatcaaatttagtgaaaggctttcgagcagctttagaataggtctactaactattaaataatttttaattattatttttccttaatctctttctgcttgaaacaggagatcagtgcggttaattcttcaactatccaagcctcatattttggaacagacaagatcacccgtatcaacatagctggatggaaaacagatggcaaatggcagagagacatgtgcaatgtatgacatgaataagctcctttttacactagcatgcgagctttatgtttaacatgaatgtactttgcaaggtattgatgtatattcatggaaatcttccattcagttatccacaattatccgtgttctggggcctcaaattagttatccatttcccatttatttttattataaattgcacagattacaagggaagcaaatttgtataatcactcttgaataaattcttctcttgacaggagattaaatggtatgatcaatttctcatttaatttaagaaaaacaatttccaagttaactccatgaaattaatctttctctcctatacttaagattaatagactgctaacatcataagcagttaaatatttataaggccatatagtgaagataacattagtacctatctcacggagtgagaattaaatttatatatatgtgttttatatatataacacatatatataacacatatgtgtttatatatataacacatatatataaacacatatatataaatttaattctcactccgtgagataggtactaatgcataggtgctaattactaatgtgtgtgtgtgtgtgtgtatgtgtgtgtgtgtgtgtgtgtatgtatgtgtgtgtgcatatatatatatatatatatatatatatatatatatatatatgggttaggacatacgtatatatatgggttaggacagagcttagcctgtggtaggttctctattaacacctaagtattactccattttcatactgctataaagaactgccctagactgggtaatttataaaggaaagaggtttaattgactcacagttcagcatagctggggaggcctcaggaaacttacaatcacggcggaaggcaccgcttcactaggcagcaggaaggagaagtgccaagtgaagggggaagaatcccttataaaaccatcagatctcataagaactcactatcacgaaaacggcacgggggaaaccacccccatgaatcaattacctcgacctggtctctcctttgagacgtgcagattatggggattatggggattacaaatcaagataagatttggtcggggacacaaagtctaaccatatcaac

SEQ ID NO: 402 - DNA, 3331 bp, Homo sapiens
aattgtctgaatacagtgtgaagtttggatgtgataatcacccagtttgtgtaatcatggcggacacccaaaatggtggctcaaacaatatgcgcacttcaaaccgtgtggatcctaaagacatctacgtttatctattagtagaatcacctgatctccactcactgctcacagggcggacccacctcaggcaggtagagcaaggtaatccatattactttccattacctagctggcagtggactcaagagtttgtggaaaaagatcccttgtggtttttgaattatttaccattcaaagtcatgaaaattcaaatgcaggcagctttattttcagaaagttgcttaaaaatcaatctctaaacattattttgattttacttttgagctttctttatccagaatactttttttaaagatacatactttctgttatttttgaatccatgtattctcagtaaaaccaaaatcaaacaaatgatgagcattgtggaccattacataaaagttctggatgtgaatagtaactaacatttaacatacattgagcactcaccacatgccaggcattgttctaaaccagaagtgggcaaactttttccataagggctagatgtatagtaaatactttaggctctgtgggtcatgctgtctcagctacccaacactgccattatagttggaaagcagccacagacaatacatacatgaatggtcatgactgtgttcccccaaaaagttattttatagacaatgaaatttgaattgcacaaacctttcacatgtcataaaatattcttttgattttttttcaaacaaaaatcattctcagctcaagagtcattcataagcaggcagtgagccagattttgctactgacattaaccctctcagctaggtactattattatttttccatttgacagatgaagaaagtaagtcatgaagaggttaggtaacctgcttcttcatgaaacaggaaattaagaaatggaaatgtggaaatatacaaatttagcaaactgaacttttgcttgtttacatgcagctttttgtaaaaaaaggtgttcacaattcttctagcttaactgtgcaaggaagaggatcagaccagaaacaaattcagctaaaattgtcttaatttactggtaaatcaagtttaacccattcgataaaagctatagagttcacactgataaactgagtgaagaaaatacttcagtggtctctacctcagggttaacagaatttatagaagctccaattggctaggcatggtgtttcacacctgtaatcccagcattttgggaggtcaaggtggcagattacttgaggccaggagttcaagaccagcctggccaacatggcaaaatcctgtccctactaaaaatacaaaaattagctgggcatggtggtgtgcacctgtaatcccagctacttgggaggctgaggcatgagaatcacttgaaactggaaggttgcagtgagctgagttcgtgccactgcactctagcctggaaaacagagcaagactctgtctcaaaaataaaataaaataaataaaagttccaattttttcctaatatatttccagcccaaatcttgagatatattttgctaaggccaaaacaatttcttttcaccatcatcatctactaaacaatgagcatctctggaacagacatcatacgtgattaatttcttagtttattcatctattcagtcaaacatttattcagcaattatggcttgtcagataaaaataatgattaaaaggtccatttttatccacaaggagctcacattttgtagaagaaaaatataaataagaagctataattgagtatgatgagcacagaaaggatgctatgcgaatgtggaagaaggagctctctaccagtttttggaggttggggaaggctacatggcagaagcacaatgcctggcacagcacaagttataaataaatgttgttgaatgaacggatgaataaatgaacaaaccaataagaaaatatttcctgagtgtctacttgtggaggaacaacaaagtttgaaaatcaaggaggactcatgttggagtcagatcgcagagaactttgaatcccaaccacaaaaatatggtgttagacttcatttggtgagccactttttaagatctgaatctacttttcatatttatgaagtttaaaaatgacatgaagggaaagtgcgagggtgataactagggactgacagggtgggtatgggagggtgcttattataaacaacactaaataggaagacttgtcagtgccagtcactgaggggtggggggcacagctgtgaggtggtcaggatgagggcgggccacctaggatcctcccagataataacacaggcagccttttatcctttgaccactctagctggatttcagaattgtctgcttggactttttaaaattgtaaaatacataatatacacaaaagctatgcatatctactgcttaaagaataacaataaaacagaaatagaacatttctatttctagacaatcttaatctattggttgaaaatttgagcaggatgataatgcgtgcaagcatgacttaaaaaacaaccctggctttgtctgcaggacatatgagaggaggcaatgtctacaaggaaagagcctggagtggtttttggcatttgagcattgtgatggctttttgatgcattaacttggctaggccaaacaacagttcccagtaattcatctaggtactgctctgaagagattttaccgatgggattcaagtccctaatcagttgactttaagtcagatcaaaagagagttcactccaggtgggcctggcctaatcaggtgagccttttaaaagacggcttaggccttctccaaagtcagagactccaaacagctcatgtctggggggttccagtctgttcctgatagtctcttcctgactacctgccctacacgcttcagacttgctttgccagcccaattgtgtaaaattccttgcaagaaatctctgtatatatgcatatgtggacacatatacaacacacacctctcatatatatgtataatcacctactgcttttgcttctgtggttaaaccttgactgatagaagcattaaaacagaacttgaaatatatattaaaacagaatttgaaatatatattatatatatacacacacacatatacatacacacacacacatattcttaaatgcataatccactaaatctaattcactatatataaatacctgtgttctgatttgttttgccacgtccagtcaatatgccaggttttagaaaactgagtttaggattt

SEQ ID NO: 403 - DNA, 3351 bp, Homo sapiens
cttcaccccaccacatttaattactccagatttacgaccctttaaatcattctatcatgtttaaattaacttacacaactgtcaagggataaatgtcaaaagtacaatatttagatttcaagctcacagtattctcaataaaacaacttatatatgcaaactaacattaagttgtttctcctttctttgtccattattatgaaacatacacttcacacatatgaaatggacagaaaacccatggggaggggaaggttctgacatttaaacattcgtgtctagccataattttaatttaactaaatgctgatgacagaattagccaagaaactgtttcaaataagattaacatcaatactgataagtagataatatcacacattaataaacttgttattgagttaacatattcaattgtcatcttatttttaaatttttttatatttaaaaattcaaaaagcctaaaccagtacttcggcaatcataattacaagagctttaaatatctatcttttctgaagattgatgttaattgggtccttgaagttctagaagggtggttctttcctgggtgattttgtcccccaaaagatatttggcaatgtctggagacatttttactgtcatgactgagggaagtggagtgttactatctctactgggtagaagccagcgatgctgctaaacatctccccattacaaagaattatctggtccaagatgtcaatagtgcaaaggctgaaaacagttttagaggggtctgtgtacacatttatttcatctcaagagtttgtcctataacttacttcaaaactaataagcttacagagacttaaggatttctgcagaagcatcctgcacacagcagatgcttaacagaaaactaaggaaaaaacaattatgtatagttactgccaatttttagcagaactctgcaatgaatgacccccattactaaatttcaacttaggaaatacatctctagttaagattttggggctgtggatctagataaataaatatttggaaatcctgccaaacatcttttcaggtttatttgataatgctgaaaatcggaagacatcctatatttttgttatctaagcaattactccacataatttatgagtagctgctgtaatggcatgtaaacgaaaattagatgcataaattcatcctagcacattttccaggcaaaggtggaaaaaagtgccttacctctgtggaacacttaggtacggtcagagccaaacacagacactcaaaatattaagtgaatcaaacacattgttttatttcaagatcaagctactagttgttactactagttgttactatgtgacatggtcccaagagaggatattaaaatatacatatatacataaagctgagcatatgggtataggaattacagaaaacatcaaaaaagtcctctcagctattccccagaggattttccacaacgtttcaagatagccaagttggcagaggggtggccgcccaggttcaccgcggagttcctattttgactgtaccgtcattcagaaaagagtcgcccgaacaccattttcaagtcctcccggcaggacacagtcagttttctctgcgtagcggactccctaaaagcgctcgacttacctggcaagaaacctgcctcgaagaagtggcagcatgaggtcagaaatctggacgcgcattacggggagagtcaccgagaaacctgggcatctcttacgtcccgcgcctcaaacaccctggtccccaactctccacacgtcgcagctgccctccggtcatcgaggccaagcggccgcggggacgcgggaagaaaaacctctgccctcgccagggagggccttatggcgggagggggcagcgggataggaaagagaatctgagccgagacggcgccgacaggcctgggcgaaaggggtgccacccacctgcgcgacctcttcgccatccttcaagtaccgcataggagcaggctgggcggggacgcgggtcagcctcctccagcctccggcgaatgctccttctccccgatcctctagccgcttccctcgctccctctggaggcggccgagtgcggaacgcacgtcctcgacagggcaggacggagggacagcgggggcggaccgcgacccgaccccgaccccggcccgcagcgccgctcttagccccggcccggcccggccagggatacccccaacatgtcaggaggcgcgatcccgccctccgccggcttctcccgccgcttgtcagcctccctgccctggccccagcccggctccgccacaggcgcccgacccctgccctctcccccgcagctagcagttctgcagggctcgcagtctcctgcagggttttgtccgcaccgccgaatctcgcgcccagcctccctcaagagccgccgtttgaatctgcgcacgcggccctgaacctcattggctgtgggggccgcacgcgaagaagcgagggcggggaggggagagcgcgcgcggctgagggcggggctggggagctggaagctgggactggaactcgcgggagtcggggaaggagccgggagccagggggtggggccgcgggtggggccgtaggtggcgcatgcgagccgagctgtcataggacccggaacgcgccgagaggcgcaccgcgcggggcctgctgggagagcgagttcctgcgctcgccgaggagtgggtccggaagcggcgccggagcgggtccggaagcgggcggtggagaagtccagttgccccaaaattcttagggtgagcgaaccgagtttctggcggggtgggtggtcccgcggcccaccaagggaacgtctccgcagcctcgcctcggcgacagctcctggctccttaggtgtcttccgcctcactagttaggatgcgcggtcttcagacttgagacaaatctaaccataaatttgcgcggccgttattttttaagcaaaaatgtgagctatttttacccagacatcatagttacgagagtgacgaagactctggcaggaaaccaaatatcacctgttttcctcaaaaagcagcagaagagtgacaagtgaaaaaagttcctagcgggagacgtgcttggaaccggagataatctgtgtctaccgctggtcttcaaggtgcttaatttcgtgcccgctctacaggaaataacgtgcgcggcggaggagccctgtcctggagaataacgcgtgaagaagacagtggactgggcatttcgtccagatgaatgagcatggtagttaagtgtagaaggtgaccttcttccctctggagagaccagggaggggggaaccaccggaggagtttctagcggttgcagctactt

SEQ ID NO: 404 - DNA, 3356 bp, Homo sapiens
acacacatatttacataaatatgttttccttacaaaactggggttatacaaaaccttttaaaaactttattatttggccaggtatggtggctcatgcctgtaatcccagcactttgggaggctgaggtgggcagatcgcttaaggctgggaattcgagaatagcctggccaacatggagaaaccccgtctctactaaaaaatacaaaaattagctgggtgtggtggtgcacacctgtaatcccagctactcaggaggctaaggcacaagaatcacttgagcctgggtggcagaggttgcagtgagccaagatcgcgccactgcactccagcctgggcgacagagtgagactcgtctcaaaaaaaaaaaaacaaaacaaaatcaaactttattactttgtctcatataattactactatagtataaatgtttcttccctccaaatctcatgttgaaatgtgatcctcagtgttggaggggaggactaaagggaggtgtttgggtcatgggggtggatcctttatgaactgatcaatgccctccctttgtagtgagttctcgctctattagttcctgctaggacctggttattgaaaagagcctggcacctccctcctcgctctcttgcttcctctctcaccgtgtgatctctgcacatgtagcaccccttcaccttccatgagtggaagcagcctgaggttctcaccagatgcccaatcctccagtcagcagaatcattagccaaataaaccttttttctttacgaactacccagtctcaggtattcttttatagccacacaaaagggactaagacaattacatattcttttaaaaaaagataagtatgtatttttttttttttttgagacggagtcttgctctgtcgcccaggctagagtgcagtggtgcgatcttggctcactgcaagctccacctcccgggttcacgccattctcctgcctcagcctcccgagtagctgggaccacaggcgtctgccaccatgcccagctaattttttatatttttagtagagacaggatttcaccgtgttagccaggatggtctcgatctcctgaactcgtgatccgcctgccttggcctcccaaagtgcagcatgtactattttaaaatgtgactaattgttcctctttattacttagttgcttctaatgtttgtgttgttctacatataacatctctgatgatttcccttcagttaatacctaagagtggaattatcaaatcaaagagcaggtattttttaagactttgttttttaagttaaaaatttttttttttttgaaaaggagtattgctctgtcactcaggctggagtgcagtggcacaatcttggctcactgcaagctctgcctcccaggttcacgccattctcctgcctcagcctcctgagtagctgggactataggtacccaccaccatgcctggctaattttttgtagttttagtagagacggggtttcaccatgttagccaagatggtctcaatctcctgacctcgtgatctgcccacctcagcctcccaaagtgctgggattacaggtgtgagccaccgtgcctggcccccaatttttttttttgagacagagtctcactctgttgctcaggttagagtgcagtggtgtgatctcggctcactacaacctctgtctcccaggttcacgcaattctcctgcctcagtctcctgagtagctgggattatacgcgcgtaccaccacgcccagctaatttttttgtatttttagtagagatgggtttcaccatgttggccaggctgatctcaaactcctgacctcaaatgatctgtccgcctcagcctctcaaagtgctgggattacaggcgtaaggcaccacgcccaggccattttaagactttaaacttatccaaagactcttgtcactgtgccttcaccaaaatttaataaaccttttcagaacttccttattcctggttgaacagataaaatcaaattcctgaacaggaaagaagaatgaatgagttgttgtcagttaatgattactgtctttggggaatgtgatactgactgaaaacttaatttttatggtacatatttcttttgcttaaatgacttacaatgaaaaacgtctaatttctataattagaaaaaaccaatatggatacagtaatagggctggagaggaaggacattcctaagcatgcagacaggacctgggctactgaactagactcaacagggcactggtgaaacagatgctcagagctctccttataattgtatatcacagtaattctcactgaagacatttaaagtttatggcaacaaattttaattatgttgaactcagttttgtaggtaagcaacagcagatattatgcagtttcaatcaggaagagtttttcttttccgtttttttttttttttgaaacagagtcttgctctgtcactcaggctggagtgcagtggtgcaatctcggctcactgcaacctccgcctcccaggttcaagtgattctcctgcctcagcctcctgggtagctgggattacaggcgcccgccaccatgccttgctaatttttgtatttttagtagagaggtggtttcaccatgttggccaggctggtctcgaactcctgacgttaggtgatccacctgcctcggcctcccaaagtgctggtattacaggtgtgagccaccacgcccggccaagaagagtttattttcttatgtcctttaacaagatctaagccagagttttgggttaatttcaggatgcaattttacagggtaggttaagtgtcccaaaacaaaacagaaatcatatataagataaatatgtgtagcagttaataactctgaaatattgttaattcaccagggctcagacaggtaaactatttatcacaatatactaccaataaaacttacagtgggtggggctgaggggagggaacctagaggacaggtcaataggtgcagcaaaccaccatggcacacgtatacctacgtaacaagcctgcacattctgcacaggtatcccggaacttaaagtaaaaaaacaaacaaaaaaccaaaaacctatagaactgtcatgttgatgactgctttaattagtttataactttaacacctgagtcaaatttagagggccaaaaaatgcaagtgtttggaggtttgagcagttaccttttgaacccgagagagaactgccctgctgtctcctcttggcgtcactgagaatgtcaatgaccagcgtggcaaactcatgggcgttgaaccgagctaacttctgtctgccctaaaggtgggaaaataattggaaatatttcccagtgtaaaaatatatacataaata

SEQ ID NO: 405 - DNA, 3374 bp, Homo sapiens
gaaaaggtaatgaggggaagtgaaacagtgtgaacttactcggaaatgcaaaccgagttcaactcacccaggagcaaacaaacgacagcaagacaaatcagccaccgcactcgcggcttcccagaaagggcctcatgaatgagaatgggttgctaggtttccttccctctctcctgacaatcgcttcccacaagacttccaccgccgaaagaatacaggccgggcctggtgactgcggagtgagggaaccgcgccaggcccacgaggccgctcgcgaccgctcccgccttcaggaccctggagagcggccgccgcgcccctgggacccacgcccaacccagaacacccgcgctcgcctcccgcgcctcaccaccccagcactttattcgctgcttcccgcctccaccttcattttttttggcaaccaccgctcttgtttttcacagacagattaaattgttttttgtttggcatgagggggtgtttggattggccgagctacattccggtttgtaactacactaaacgttagtgtaccaagaaactaagagcgtctcaaagatgacagtctgaacgtggcaggtgaccttaaaaagccactgagttcaacccctttataaatgaactcaaaaaataaagagacattcccaaggttagccattaagttagtggcaaggttgagtgtagaaccgtgggtttctgacttctaaactagtgcttccctccactttccaaaagaaaaaaaatatctcattgcttaggtctcctaagcaacaagtggaaggtggaaaggccggtgttcccgggaataagaaggacacatggagtttggaaaggaggtctgcagagggttcacttgtagtagcagccctaacatggaatcccggtgtccccagctccacgcaacatacctacagccgcactggccagtccctttttccaaccagcctgtggagggtctgaggcccttcagccaccttcagccactatctggaccttccatagacaacaatcccaatagaatctagtagccaaggccaactctgtgcctctggcaggcagagccctgggcacttagggagatgggaaagggcagggggaacaagggaagaccagagaagggaggggaagagcaacagttacaaaagtgaactaagattttcatccaaattctgaagaaccaggcgatgtgaacacagacccttctgcataccgcatgtcacattcagcgcgcatggtagtcccctgggaatgttaccatgcagattccgatgcattggctgggtggggctcaagagtctttatttctaacaagctcctaggtgttggcgaagctgctggcctacggaccacacttcaagtagcacggagttaggaaatacaggagtgggaggggaaagaatctaactataggcctttccttctgctttcaccgaccttctcttgcacccccaaagtaacgcttcaaaattctgtagtaaagagccccatctaagcggccggacaccacagtaaccgtatgctggttttgtttctctctccccaccccagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccggtgagtaccgtggtctccactacgccccacacccagcctccccaggacaccagcctctcccgattcttcctaaccccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctccagggaactaaccccgcggccccaccgggtcccactcccgaagggacgctgcgggctacggggacacgcggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattcacgaggtccgagcacgcagtccagcacactctagtctcgctcggccccgcgcgccgaggggaggcgatgacacagagggcttcgcggacgccctctacgcgcgcctggcttcgcatccacactcttgggacttgctaatgcggggctggagcagtggggctgcggccggggtggaggtcgcgccccgcgtggggcctcgggggtacccctagcacccgcggcggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgg

SEQ ID NO: 406 - DNA, 3415 bp, Homo sapiens
cccagcagactaaagtcagttttccaaaaggactctggaattcagcaaaatgaatggaaggtcctttacagcgtactcactccaccattgtacagatggcagcactgaggcccggagaggctctggaacttgggagaaaggctcaggctaagagaagccagggactcctcacccccagcctgtgagctgctgcagattaaggggtcattgaagatgggctagtggccaagggaaaaccaccacatccagggccacacccgtcacccctcaccctcatcccagtcagggcagcagcagcatcttcctgtgcaaaacaaaatgctcatctcctccaagagctgcttctgagggcctgtcctgccccttgccttgggtaatgagggacaggctggcagtgccctgctcagctcttcagtctgtccaggaaaggccaggctaccagagctccctggagtgccagtggccaggtaagcggtgcagcctcatgtcttctttctggatgtgctcgtaacaggactggagggagagaggcaaggctgaggccagttgacctgcctgatcccaaccacatgcacaggatctagggctcaatagctgtgtgcacccacctcccaacccagaggaggcgtgtctccaactcagccctcagccacagtctgcgaggaaaatggggcccttcctctcccactgtgcttgggaatgcagcatggagcaatcatggccccagggtccccagggctgggatgcactgtgggacccctccctggctcctttaataagagcaggatcagggacactgtgaggacccttcccagagtcacacatgagctgtgaatttgagctccctcccactatggtgttatgatgtctgggaagggaaaagggtctgccccaggggccagggcatttccacctcggtccacagcccctgtcccttacctccagggctgtgagcaggaagtcatacaggcctcctgtgtggttggggtccatcatgtcacggatcaggtggatctcggctcccaggtgctgaattctggagaacaccgccccaccaagagagcgagggagacaaggagaagaggcctgtcgcggacaggcagctggggaaggagcgctggcctggatggctggacacctggggtgtggtcctcactctacctctagcaccccagcaccctggctgggaccctcccttttctgggccttggcttccccatctgtacagagagaagctgcatccataaaccctggggttcagaggtatcagaagatatcgtggttgggggtgggaccctgcccctgccctgcacccccagctcctgactgcctcaccgggcgcgcgacaccacgtagatgagaagtggcagcaggtcgtccatgggcagcttgtactcccggcccaataccctcgacaccgtgccctcaatttccccgtatgtcctctccagcacctccagcttctcccgtgggtccaccgtggtcctgcagcagggtagctggctccaggtcaaggcccttggttcagtcccaaccaggagcaccccacactctgcctccggacccccaacccactacggctcacactcacatgatcttctgcaggcactcggtggctgacaggaaacacttgtccctgaccagggagtacctctgcatggtggagggagtgggctggatgaggccatggccccccagctctgacatcccctccttcccagggccgggcctgagtcccccgccacccttcccttcactgccagctttagtgcagccccaccctgagggctgagtgacccagggcaagtcacagctccactgtgggcctcagtttgtgcaaccataaaacggggtgaatagtctccatgaggttgggaggatccaaacggataagaagataataatcataacaggcactggccactgggtgccgcccagttctgagtgcctatgtcgatggttctcaaacccaagggcttagtgaaacacaggttcccgggcccactccctgcatttctgactcggtaggtctgaggtggttccaagaatctgctttcctaacaggttcccagatgatcctgatgcttccagcctggcaggcacattttgagaacagctgcctcatgtgcccacttcaccctcacaacaattttgaggtggttctggccaagcgcagtggctcacgcctgtaatcccaccactttaggaggcgaaggcaagcagatcacctgaggtcaggagtttgagaccagcctggccaacatggtgaaatcctgtctctaccaaaaatacaaaaattagctgggcatggtagtgagcacttggcaggcgcctgtaatcccagctactcgggaggctgaggcaggttagtcacttgaacccgggaggcggaggttgcagtgagctgagatcgcaccactgcactctaacccgggcgataaagtgagactttttctcgaaaagtaaataaataaataaataaaataagaattttgaggttgttctagtgttggctcccttttactgatgaggcagctgaggcacggtgcacgagcctcttgcacacggtcacacagccaggtaagaacctgtgtttgagcctggtggttacaggccaacagcttacctccaccacactgggaggtcagaatgacagtgtctcctcccaacccaccctgcccctccccagctcctctgcagcctccgcccagcaatcatgaggcaaagggctcctcaaagcctgcaggacctctgggggcccctggcttggggctctggcctccctctcacctgattgctcgtcagcgtgaggtccttgaggggccacaagtgcctgaaattgaaaaagtgagacaggaggctctgcctcgacaaggggcagagtctgaggtcagagggcaaattccctatgccactgtttcccccggcagatctgggtcctgaaaaggggaaggagatcagcctaggtcatggggaggatggaaggattcctggagaaggcagagctccagaagctccagggaggtaagggcggcccaggggcttgtatgagccaggtcgtggtgaccagtagagagggaggggtgaggagactgcactccatccaggaggctctgctgagccagcacagggctgtgagcagggggatgcagccctcatgcagcagaggtggaggctggtgtggggaagcgacactgaggtggtgagggaggcggggcatgcttgggaagcactggcagccaggtctttaggctggtggctggtcagatgcaggacacagtcaccaagatagaggaagaaacagggatttgcagggtgggtgggaagcaccatccctgtgtaacaaaggagacctggatgtgggagcagagacagtgcccgtgccctctactgtggacagtggggtcacttgtgg

SEQ ID NO: 407 - DNA, 3513 bp, Homo sapiens
cttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtcttctatgtcctaagtggtttgttaccagaactaacaacagtgctatgccactcaaacctcagtagaagcagtgagtaaggaattcatcgactcaggaggatcttactgcttctgtcctgtctagccagcagacctaaagcatgtgttttgatcgattctttggtcacatctggaagatagcagatgctgatattaatgtcatttttagggttgtgagcataaggtccagatccacctagttatttttcaccagagttttaaaagacgaaatcgttgaagctgccggcatttagtctagggctttccgcattctcttgacctgcttctcttgtcttgttaatttaggcatgaaacggtgtcgcagtactctggcgtctttattccaggagaggcttcttacaagataaggcactgcgagtcgattgttacgccacacctgtaacaattttctataaacatctcatggccatcaaaaaaccttaaaactcaatgcgtactcactgtgagtgttcagtgccagctagtgctccaccccttctccctctcagccggcgtcaactgtctcttcgcctgtgctcccgggtgctctgaccctggtggtgggacaggaagttggttgtatacatgtacttttctctgtggccggtaggtggggactccatgccatcaatactcattattttaatggttagattttttttttttttttttttttgggggacgtagtcttgcactgttgcccgggctggtgtgcagtggcgggatcttggctcactgcaatctccgcctcctggattcaagcgattctcctgcctcagactcccgagtaactaggattacagggcgcccaccaccatgcccagctaatttttttttttttttttttttgtatttttagtggagacagggtttcactatgttggccaggctcgtcttgagatctgcctgcctcggcctcccaaagtgctgggattacaggcatgagccattgcgcctggccaactgttagaattttttttttttttttgaggcggagtctcactctgtcgcccaggctggagtgcagtggtgcgatttcggctcactgcaagctctgcctcctgggttcacgccattctcctgcctcagcctcagagtaggtgggactacaggagcccaccaccgtgccccgctaatttttttttttttttttttttttttttagtagaaatggggtttcactgtgttagccaggatggtctcgatctcctgacctcgtgatccacccgccttggcctcccaaagtgctgggattacaggcgtgagccgtcgcgcctggccctgttaaaatttttaaaaggaaatttgaccagcctggccaacatggcaaaacccatctctactgaaaaatataaaaattagctgggcctggtggcgggcacctgtaatcccagctactggggaggctgaggcaggagaatcgcttgaacccgggaggcggaggttgcagtgagctgagatcgcaccactgcactccagcctgggcaaaaagagtgagactccatctcaaaataaaataaaataaaaggaaatttaatttcaaactctgaaacttcctccaagatcctaagtactgaggattgcatgagtctttggc

SEQ ID NO: 408 - DNA, 3594 bp, Homo sapiens
acattagaacttcaaataatgaatggctgaataagagaaaatttgtagggcagtaggtgctaaaacatttgggcacatggaaagttttaatgtttaatttcactaatactgtattatatatgcatatcatgttaatcaaattatctgttttttaaatgagaatagccaattctagaaaaaaatggcaaagttggcacttttacatacagctggtgagactacaaataaatacaactttctacatggtgtttcggctgcatattaaaaaccagtaaaatgttcatactctgcgacccagtagttctgtgcttgagaatcaaatctcaagaaacaacctaaaattcaggcatcactatacgagttaccagcttttaaaaaaatattacaaccatgtggaaacagcctagaatatctgccaataataagttacaaaggaggcaaatgaatattaaaattttaattgctttaacatttaatacataggtgattaagagaacatacaaacaaatatatacatatagtgttaacaaattctctctagatcagtgtttttcaaattgtgggtcatgaaatcaatttagatacttgaaatcaaatgaatttaattggaagtattgggagcattgggagcattgctcctagtaaagataagcactgtttcatgaaactttttaaatgtaaatatacatattttgaatgggttatggtttaaaaagaagaaaaaaatagctgagaaaaactgctctagtggcagaatttataggcctttgacctttcctatatccaaattttctataaatgccgtggtattttcaattgacagaaaaaaaaatcccactaatcttaatctttgattctgtaggaatttaagtggaaggaaacctgtgtatcttcaaatactgtatgaagaaataggacaataaaagattatgtggatcctaaaagctcagccaagtgtagggaatacattgtgcagtgaaggagacagaaaaagttttgccaaaatattaagagtctggcttttaaaaatctacagttttgttctttccatgtttttttgcttctttgttttcataatgagtgcattctttttagaattagatagaaaaaaagtatagaaaagaactggaacactcttgacctgataaatactcttcggattgctgactttaggaatgacacgaggttccttgctacaactttcttcatcgcaggaagtgccagaggaaacgtctgatgaggctctactaacggcataactgatttgttgatatagttcccattcctcccatctgcctttaaaagaagcaactgtaaatggatggtttttctcaccatacctaagtaggaaaagaaatttaagtgctaattagcgattcaactttctacaagatctccaatctttcctggagacaatatgctaacttattttaaaagaaattgccttaaaaaattgaaggacattatgaccttcacctactacactgttataaattaggatattctataagagctattttggttaattgttcagaaaaaaacaaagactagtttcttttgattcagttaatgaactgaattgtcccatggtagataactctccttcctttctgatgttgcctataacacttatctgttatcaacctacagtttgtaatagatactgttaccaatctatagtttgtaataaggtgcagtgattaaagccacatttcaaatattttgcaaaatcattgtgctttccacctcacccactttgaatagaagtctgcattgtctaacagaagtttgcatctaaaatcttaaccaagaagtatccctgctgccaactcaaggctttggggcatcatctttcatgaaggtatgtaaagttgtctaacttaaggtttccaggtatcacacagcacacaaactatgagattactcacctacagcatacttcaaagggatctacccatatggtcatctccttcggaagtcccaggtgagaaaaatctacattactttccacacatgccctttctagaatgggatctttattctgattgttgtttatcctgatgcacctttttaaaaagcgaagggaaacgaagacatgatgacagacactttagcaggagaatcacattatgcacatactgttccaatacacatagctcccacctcatcccctcagcctccttcccctcagcctcctccaccctccactcttacaagtaagacatcatcaacttttgatacagtggctcagaatgtatgttgcatcactaagtcacaaaattagttatctttcatggcaaagacaagttagaaattgtttaatctacctcacataaggggctttgctctgttgtttccagccacagtgtcatctactatgtctcctcctttcaattccacgttcaaacaaataaactcgagcccataaaacttttgttacttatatgcagaaaacaagatcactccattttcctaggagctggctggttgcttggtgattgcttccctttgccatcccacatactagctctcacctgaaggcttgccctttagaagggcaatcagagtgccagtgacttctgtatgtttcaaacaagatcgtcatcagcttttctgcaaagtcttctatttgctgtttacttagtttatcatgttttttcaccaatcttgtgacaaagaaaactgttgttgcaatttcatctctcatgattcaagaaaaatagataaggaggtctgaatcattaaaaggaagcaagaagaaatagaaagaaatggtttaacttattatcaatatttaactgccatttggaaattttacataccttaaagttaaaactgagaaaatctgctagaaagaagtccttagtaaactaggtaagtacatgaacactatcaatcaacataacagccaagaacagcaattcctcaaatagcccagttttaaaggttttcaaaggaaaaaaaaaagtctttttaaaattttaaagcacttaagtaataaatgaaacatcactacaacttaaaaaagatcctgatatgggacagtaattacctcaagcatcactttttaaagatatattaacaaagagcaaaatatttcaggagagagtaattccaaaatgtggctccaagttgcatgctttaggaataatcaaacacattatacttgccaacaaaagctctttagcccctaagaaaagtgggcgagacttagaagaccaaccgcactatcccttatgtttccaactctcacccacacctgttcgtgagttcgaggctgaagtttatataagcctgggccctaaaggctgatggatgtttcaccttacacaggtgctgcctattgaaatgatcatacagctttttcatatgccaatctggtctccatccgattgctccttggcataagtggagtgggttctctatttgaagtgtttaaaattttcaaactggatctatattttctattttgctattataatcttatcttttataacacagagtgagaatcaagtgttctccttccatatcctaatatcgtacattccaatgatgtcatctctaacttagctgacaacatattaaggaattttg

SEQ ID NO: 409 - DNA, 3617 bp, Homo sapiens
acctactgcaacagttgtatgactgaaaacaattttcataaactacagataactcctaaaacatacctgcagtatcttctggcttcttggtattagccctgtaaaaaaagttacatcaaaattttaacaaaatactacacaaaatgccatgtttgttgggaaaagaaatgtcttatgtgaaatgttctgcatagaatagaacagtgatgacatggtccaaagctgacttttcctaaaagaccctatccgacaggcaaaagtgacttaaacactttaccccgtgtgttcatctgtttcagcaaaaggttctctttccccatgctcatcagttacatcttcctcccttgtttctgtaaaacggtttctttcctcacattcatcacggactggatcctttcctgcattaaaatgtaaaagacaaaccttttttagaggaagatgctgctgtggacattttttgtggagaaatgtactagttgtagacttttttggggggggggggctctctgccaattaaagctttaaagcagagctatacatggaatcaccggttcctgaccattttatcgagggacttttggaagcccttcgggttcaggttccagtaaacaacgtactacagttcagaccccttggatgtcaggactgcacccatggagaagagctgctctgagagcatctgtaaccctgctatgagggggagccttccacggggaagcctaaggcccttgagcctgctttgaaaacctggcgcatcttagcacgtgcacaatggactccagagccacgaaggggcctggggcctcgggctgcccctgtgcccccagcgcagaaagcagacagaccgtcctcttgggcgtgcaccttcttctgggtccccttgggctgtatttacctgcatgcttcttcccccaggccgccataaattgagcctccaactgggccttggcagccctcctgcccacaggatccgtggctggttgtcctgggaagctagaggcgatccccgaacctggtgagcgcaaagacacactaaggaagctaaggaaacctggcatcggaaaggaaagccattgggatcacaggttcaagaagggtggggctggcccgccctgggtctcatgtgggagcaggaagggacggaaaagatgccagtgtcccctcctgtcctggcccgtccagcccgtccccggggctggctgcaaagctcacagctgcccctcacacctgaactccacggcctctgcgggatcctcgccgcccttttgggacagaactcagccctacctctgagtcacctagcgaccccatgtggctgggagggccgctgggtgacacaggatctccccagccacctctaggggaatgtcaggggctgcactgccactcgcccccctggacgcacaggggacccccggtgacccccggtgaccccaagtgtcctgtcctgtcgggcggccaggcaggagggccccactcagactgtcccccacaacacccccgcctcactcccacttctccccccctcggcccctccccccaacacatgcacaagcccccaggaccctcccgggccctagggatcacccaggcagctccagctccctccctgccctggcccaccccagcccaccctagcccaccctcagggcctcgccctgacccaggccccaggcgacgacgctggggccatttcctcacaggtcggcgggctgcccagcgcttcacaccctggttcccagagggcctcgtgcctgcgttcccgcctccccaccacgagtgcttcacctgagggacccctgatgtggcgccctcaaagaacctgcaggcagcggcaccactaggacctcttagaaaacgggtcctctcaggaagctgaggcaggagaattgcttgaacccaggaggcggaggttgcagtgagcccagatcacaccactgcactgcagcctaggcagcaagagccagactccgtcccaaaaaaaacaaaacaaaaaaacaaaaaaaaagaaaagtaaagaaaacgggtcctcagttctcgtgagagctgcaggcaggacttcctgcgctcctcgctgattggtcggctcagtgcacatgcgtgtgacgggctgtgtggggccaggccccctgctggcacgccctcacccttcccctaagtgacagcccgtggttgctgtggactggggtgggggtggccctttggggcctctgtccccacaatctttcagcttctcctcctggggagagacacaaggacttgggatggaggccaagtggacagggcctagaacctcgccctggggcttgttccagccacccctgcccctttggctagaatggccatcaccctgtgggtggagcccaggctccctcccatgccctgtgtgcttccaacatgcccagctgcgtcctttttaatcaatggattgtgcttttatcgtttgtgtttgttggtttttgagactgagtctcactctattgcccaggctggagtgcagtggcaagatctcagctcactgcaatctccccttcccaggttccagcgattctcctgcctcagcctcccgaggagctgggattacaggagcccaacaccacgccctgttgttgttgttgttgttgttgttgttgttgttgttgttgttattattattattgcatattcggtagagacagggtttcaccatgttgtccaggctggtctcgaactcctgacctcagttgatccgcatgccttggcctcccaaagtgctgggattacaggcgtgagccaccgtgcccagcccataaccttttttgtttcctcactacttttctttctcatcctcatgccccagacttgcccacaaaccttcatactccagacttatccagacatatgccacaaccttcacccacaaattaatgccttaatacttatcgttaactcagctttttcccacctccgatcccctgtaatagggagagagttgtttcggagttgggagtgaataaatattgcctaaagtttgtaaatcaagatacagagtttcattatactattgaaattataaaggcagtcatcaggaaaactaatccacagccttaaatgcctatataaccaaaaagagcacacacaaagcatacaaatcctgtagtaaaagttggaaaataaagaaaatactacagagaccataacataacataaaagaacagaattaaggccaagtgaatctgttgagcaagaaatatgaatgagataaactcgcattctaaaggaaatgacttccaacttggatcaaaataaaaacctaagtatatgctgtatgtaagaatggaattaaacaaaatgatacaaaaagtacatatcagaaaaatatgaagaaaaggaaaatatggatctgagaattgatatctcatgaatgtaaaataatgcaaaaaataaatgaataaactaaaggcagagtacactgaacaagagaagggcacaatctactctgacaatctcacatgaatcattttgtgcttaacacagcatcaatgtgcctaaacccaaaaccgtagaaaataaaagcaaaacaatcaatgaaaatgaacagtgatatgagagtttaagctccgtctgtccaggagaga

SEQ ID NO: 410 - DNA, 3624 bp, Homo sapiens
gatgtcagtcatgaatcatggtgaaactgaaaagagactcacagtagataatcctattggtgaggaacttgaaagcagagagcttccctggggagtggagtcacagaagtgagatttagctccaaaagaaaaacgaagaagaattgtccatatccaaagaggaagctgaccaggaacctttccactcatgaggttttaccagtgtggcaagtggaaagccttgttacctttaattataaacagcattgcttacttgttaaaaaaaaaatcaacaggcaatgaagtgtttgccagaaaatggatctaaatcaattggtaacaagtaattaaaagcagcttattgcttttgtttgggtctttcttttcctttgctctttattttgatattatttgcttaggaagcaaccttattcaaatgtttatttcaaataatttcaaattttcatttgtaggttatggagctttgtagcattaattcttatagaattaatgaaagaaaccaaaaaaggtgactggattctcagatcactctttttcttaaaaaataaaaatattttaagttctggggtacatgtgcaggatatgcaggtttgttccatagataaatgtgtgccatggtggtttgctgcacctctcaacccatcacctaggtattaagcccagcatgcattagctatttttcgtaatgctctccctcccccaccccatcccccaacaggccccagtgtgtgttgttcctgtccttgtgttcatgcgttctcattgctcagctcccacttataagtgggaatatgcagtgtttggttttctgttcctacattagttttctgaggataatggctttcttgctccatccatgtccctgcaaaggacatgatctccttcctttttatggctgcattgtattctatggtgtatccatctatccagtctatcattgatgggcatttgggttgattccacgtctttgctattgtgaatagtgctgcagtgaacatatgtgtgcacatatctttggaatagaatgatttatattcctttgggtttatacccagtaatgagattgctgggtcaaatcgtatttctggttctagatctttgaggaattgccacaccatcttccacagtggtgaacaataagtctgaatatctagtgtaaccagtattaaccattgtgtttacaaattatagtgttaattaatcattttcattgttaccaaatcacagtttatatgatgacacattttgatttcaaacacaagatctggaacatctgtctttcccactggtgaggctccctgttggagcgagggggatgtgggggagcaaaaactcatgttttctaatttatttctttgtataattatcattttcacataatcctaaatcgaacacttatggattgttattctgtgagtttgtgcacctgcatcccccttctatgtatggattatttgttaactcagtgttcatatattgctaacacctttgttcatacttgtgtagagatcattgtgatttccttaaaagtagatgtaaaaatcatcactgttctcaagcaagaaaaccttgaaaggcaaataccagtagatctaattaatatctctaaacaaaatacctttgttttgatggctgtctgagaatatcagtgaatagttgggatagggaagacctggaacacagagctaaccaaggagaaaaagaagttattggtatatattatgaaaaggggaatagcttttaattggattttttttctttttttcactgtgcagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggtgggttctgaaggactcatcctcgagctgcacttactcctgcaaaatgagaggaagagaaaaattcatcctggaggttgtaaaataaaaattatatctgatcagcattatacatagttctaatgcgttaagattttattattttttaaacattgattggtgtcagtcacccacaccaggaaggaaaatttcaaaggataaggtgacaaactgtgagatgatctttccaattatttgtctcagcatattttctttttttaaaattttttttattgtactttaagttctatggtacatgtgcacaatgtgcaggtttgttacatatgtatacatgagccatgttggtgtgctgcacccattaactcatcgtttacattagatatatctctgaatgctatccctcccctctccaaccaccccacaacaggccccggtgtgtgatgttccccttcctgtgtccaagtgttctcattgttcaattccaacctatgagtgagaacatattttcactttgaaattgctgaatttctctgttactttgaagcagctaaggtaaatttggttaataccataacattatttttacaactaaatgccaagaactctgggagcaggaagataggaaaattcagtacagatgtctgtgtgtcctttgctggatcttgttgcttatgctgctgtactctgatctttgtcaggtgaggtcgaaagtcagtagcatggggcatgtgtagacatgtagatatataatgtggtttatacacatgcatgcacacacatgcattcctactactataaataggatttaatgtggccttgaaaggatatctgaaatattgtcagataaaacatttgaactgcataaggaagcaatgtgctttcctgtgtagggtccacaatggttggcttcccccccatacccaagtggcctgaattcattggcctgctctttccaagggctatgtatttccgtctgacctctacttgagggagggatcctttttggagaaattaccaattaagaccatgtcactagaaaatctattaaggattataaagacacatgattaataatttatggtgatctcttcatagaattatttttcctttcagccatttcctgacatattttgttacataaccccttttaataaagtaaaatagacaccgttttgagtataaatcccaatgtgcttttgaattggccacatcaccctggagtctgcagatttccaatagctgactgaacctggagtaaaatgcagagtgccctttaaacataatttgttctctgatgtcccttactagtttagtctattttataaaactgtaatgtaggatcccccttggcagatttcagggtactccattttcctatagtatcaaaagatttttctttaaagagaaaaatctgtattacctttactttctagagttgtaagtataagttgaattgtattttagaataatatccttgttacccacagtaaagagtcaatttttttctctacatgaaggttacagagcatagaaatttaagtgaatttagacactagttgcctactaccattttatggataactgtcataatgact

SEQ ID NO: 411 - DNA, 3660 bp, Homo sapiens
tctgaaatcatttgcttataatgaacacttaaactcatgcactaagacaaatgaagagtgttttgacaaacctacaaaaatctgaaataaaatattttaaatgaatttaaacataggaagaaagcttattgtatcttaaaactcctacagtatgcttattgcatatttataaaatgagatttatttttagggggtggaaatttaaataaattaagagagggaaagaaataaagcaacaaattttcaacgtataaaactctatttttagtaaatgccattgttaaatgcaatttttggagatttttttttctcctacaaatgttaaggccaagtatggtaaaaagtgtaatattataattataatgctgtaaaatattttaacatatgcattataatataagtattctttaaagtactctatgtgttaggcatctttgtttttatttttctggtgtttcttctacagataatttttttccaagtatcccaagcatagtttcgatgaggctcctttttttttttttcttaaaataactgttcccttagattatccattcgggctgctataataaaatcccacagaatgggtgaattataaactatagaaatttatttctcacagatctgagagctgagaagtccaagatgaagtctctggcagatttgatgtctggtaaagactttctttctcatagatggcaccttcttgctcctaatcaccaccccagatgccctgcttcttatactataacgttgagggttagaatttcaacatctgaatattttgtggggtacaaacattcagaccatagcacctgtctatacactctctgggctccacctctgtcctaccttgagtcattaagtgatttgcagtgttgctaaagtttttaatttaattaatttaattcaagatagtgtgagtaattataattaaaaacaaaaattttccaatctggaaaactccacagtaatagtggagaaagatagcatctttaccattggataagtacagtcatgaactgcatatatgccagcggtgctgtagattgtaacactttatttttactgtacattttttacttttagatatgtttagatacacaaataccgttgtgttacagtggtctatagtagcatgctgtacaagtttgcagcctatgagcaataggctataccagatagtttgggtgtatggtaggccataccatctaggtttgtgtaagtacactctacgatgtttgtacaattacagaattgcctaaggacacattctcaaatgtgtcgccatcgttgagcaaacacagctctattaaatgagagtataacgaacatcacaggcaatccgctaaaagattgtaaatctcactcttgtacatagccaagcagatataacccattacatatatgttttcaagataaaaaatagtctttaagtaagagcacttgatagtactatttatcacatgtagtttatcctaactttacctggcaattgtggtgaccacctgtgttagcttattgactttatctggaggaaaaacaggcttatcaggttttcatggcagaaggtaattttacaacttaaagcttggtatccactgacattaggtttctaccctcccaagaaactgggagatatgggtgctatctctcttgatgtttacatgtcagagagatgtttcaggtctttgagaaagacattattgggtcataaagttgacaaaaggccaatctagtcttcgaaaggatttatatacatttcaaaaaacagaaagtgtgtacttataagttttaaagtaaatgcccaaagaaaaagggagaaaggaaaatcttttcccttattttcaacagagaattaagcccctagttttaaatttgtatttggtccttacaatagaatagtagaatctatgtgtttgacttttcttaaaaacatttttatgatgatttgccaatgtttcctttaaaaagtttgtcctgaggagtcatgctgtgctttcttcaattttatttttaattctctcacttgcctctctgtaggtcaaatagaaaatatatatattttaataagttaaaagtcaattgataaaaatgtaatttctgattcaaaatttatccttctgctttataatttattttcatttaatcagtggatgtttgattttagcatggtgagaaagaagctaatttaaaaactcaaattgaaatctcagcattgcacagtgtttgatcagagtcacattaatcacagttcatgtcaaatttctcaatgctgtaaagtatcattctgaataatgacttgctctccagggttcttagttattaaaatagaagttgaggaatgggctatagcatttctataatcatgggtttcacagtatgcattttagtaataaagatgaaggagtaagatttttgatactttttcagagtattctcattcaatacacatgtatcttgaaattatatttgatcaaaagttgtttgacttgggaactatcttctgttcagagcttgttttcttctaattacaattagcagttactgatgctacaatattcctttatgaagccaagaactgaaccaaaatacaaacaacataaactaccacttgatgagaagaacttcaaagtcaaattgcaaaaggtgactaaaaaaggggagtactttcagccgttttcaaaataatctatgatatgtactggaaaacttctaataatccttgtcattttacaagtaagtagagagtaatagaaaattcacccttaatagaaaaaatgtaatcataggattaaatttaaatcaatgacaaattatagtaataaatgaacactaggttgaatgttttgaaatcttagaggtttaaaatagataaattcctttaagtgagccaattctgtttccatttatgagtagaaattcaaaataatgttgataatttttatatatacattaaatatcttttattcctagaccaaaattcatttatgaccttcagagatcgtataagtgcttttgagaaaagaatttaaatattatgtggtcatatggagaatgaagtgcttgtactgtaaaaggaagctataacaatttcctgacttctgtgctatcaaataatattataaatgtatatttatttttatatgccattttttgagacagcttaaatagaatactaagtaacaatttatattgtaaatcacaaatactttgctattaagaaataatgtatataatacttgaatgatttagtatcttttttaataatataggattttcttaaagctttgtctctgaataagactctttcaaagtatttttaatcatcattatgctgtgtaatcctctgcagtactgaaatggaatctcatttcattataagcatattagtttcttagaatcacacacaaaaatctaatttataacacaactacttagaatttcatggttgggaaaaatatataggacttgtctatggagttatttagatatctagcaaataaaataattttataaaaagtactcacattttgaataacaatttggacaatggaaaataagtgaaagaaagctaaagtatttttaaaaataccctgtatacaggtagttcatgcataaaacagaaatgtaatggaatgattttgaattttttgcatt

SEQ ID NO: 412 - DNA, 3706 bp, Homo sapiens
cagaggatcttaaagtcaatccagtagtttctaaaaatatagggattaatatgctacagtagatatagagattttatttaaactcacattcttgtagtatgtactccagagcttgaaaaagtggtatgcagatgtggtatttagcaagcatcaggatcctgaaaccttgttgaacagaaccaagtgtcctgatgcagattccagtaaacttttcattctgtatttacagactggggatgactttttccccaaagatgataaaggtaatatgatcagtggaaaaggaacgttcttggatgcctgggaggtaggttccagctttgtctaagtgtgctgggagagaaatcctcagttatccatgagattcccattgatatgaaagaggccatgtgcctgatgctttctaatttcatcattgtgattctctagctcttctaatatcctcctcatcacctttggcttttgggtgcatctgatactatttatatttcaagcctactactgagtcttcaaataagactggaaatacaatgtaccccactttggggaatacacatgctgttctcaaaccagggtgaggcatttggaacagagggtttgggcctgggtttgctcatagcagctgagtaacctagggtcagttttgtaactcttgtagggctcagttttctctttaaagaaaaaaggtcttataatacatactactaatatatatctttcggggtgtgataaaacttaagatggtttacgtgccgggaacatcagtcataaagcccatgtaatcatctaaccctaggagacagggttaacatccccatttataaataatgacatttgaaacctagattggttggtgacttgcccaggtcatgtcacaatgtgtgtggcagagctgggattagacccagactcatctgaattgcaagtccaaccaccaaaaccatcagcatggtgcttggtaagcagtgaacacacatccggaaatcagggaactttgtaatcccagcactttgggaagccgaggtggaaggatcatgaggtcagaagtttgagaccagtctggctagcagagtaaaacgctgtctctactaaaaatacaaaaaattagccaggtgtggtggtgtgtgcctggaatgtgagctacttggaaggctgaggcaggagaattgtgtgaacttgggaggtggaggttgcattgagccaagattgcaccattgcactccagcccaggcgtcagtgcaagacaccatcttgaagaaaaaaaaaaaaaagaaaaaagaaaatcagggagcctgagtgccctgcttctcagatcaaacccatgacctgtttcacatcatttcatattgaaaatgaattaagggatgaatgttttctctggccattttttattataccattatgtccttttgcaaatgctaatagagaacgaattggagaaataagatataaatgaacagtggcatataactccaagagttaatcatgttatcttggcagctgtctgtgtaggggtgcatgtagttgcgagtttgtattgtgttttacacgggaaaatatattaagcctcacctttctgaaatgcttagaattgacatgattcaattaaatgtagttttttctgtgtattgtttgttcaaaagcattaatccacaagcacagcattctttttttgatacagattctcactctgtcacacaagctagggtgcagtgacaccatcttggctcactacaacctccctctaccaagtaaaaaccattctcctgccttggccttccaagtagctgggactacatgtgcatgccaccacacatggataatttttatatttttagtagagatgaggtttcaccatgttggccaggctggtctcaaactcctgacctcaagggatccacccgtctcagcctcccaaagtgttcagattacaggcgtgagctatagcaccaggctgtttgcattacatttgatctgtgtttttgccttagctcctatgatgatatgaagtatggcaagtatgtcaatgtaccctgcttctcacagtgctatgttttcttaatgaacatgaggatgactgctaaagaaaacatttgaaaggcatgaaaagatatcattgatcaagttcagaggctctgatttgaaacgagcatgcttgaatacgtaagcattggatgtttatgtagacccacaaccagttcagtagaaacctcattgactaccctgaagcagaggggaggaaaaaagtataaagaagtcaagttttaatacgggaaaactaacctgacctatgatgcacaaaagcttttaaattatctaattgctgaatcagaagtttttgggaaacttatgatttcatagcttccaaactctacttcccaatttgaataacttaatctatgctagtggttctcaacgttggctgggcattagaatcacctgaggaatttaaaaatcccaatgtctaggctacaactcagacaaaatcagtaagaaactctgggggatgaaatccaggaatcagtcatttttcttttttaatttagagagagtcttgctctgttgcccagagtagagtacaatggcatgatcatagctcagtgcagccttggactcctgggctcaagtaaacctctgaagtagctgggatcagaggcacacgtcaccgcatccagctaattaaaacaaatttttttttttggtagagacagagtcttgctatgttgcccaggatggactcaaacatctggccttaagcaatcctcctgtctcagcctcccaaagtgctgagattagtcatgagccactgcatccagccagtacctttcaaagctcactagtgattccaaattgcagccaaaattgagaagggctgcataaagtgttccctgaacatgtcatgctcatccctgcctctgagctttgctcctgccttcctgccttcctgtgtcatatgctcatgtttttcccctcttttctctctctcggggtttttgtttgtttgtttgtttgttttttgaggcccagcttatactctacctgaaaggactcccctgacaactgcgggctgtgtgaatctcttccttctctgcctttctgactctgtctatgccactgtcatgttatctgaggcagcctcagtgtcatgattgatggctccatagaagggaactctagcactttaattggactgtaagaatcccagaagaaggaagcacattgtatacttttacatcttgacaacttctgggcaggatctagaacatgtaatagatggctactaaatacatgttgcattggaggctgctgctaacatatatgatatctttgggcaagtttggaaaatgcccaataaaggctaaaaattatacaaagattcccttccttgcatgtccatgcagcttctgtaccaggaagcatggctggatatgcaaacagtgggtcaggttttagccccacacaactccgtggccgggtgcccctgctagggcgtaatttatatgcatgaccttcttgcaaaccaagccatggttggtgtgggagacagtgactcaggacccacaggtgaggcttctccgtatgctgcagcctcttcctgactaacacagcttgcccaggtttgggtgtacaatgtacacacacaacagtagctccctgctatcatttggattcattaaaaattaaatcatctcataagcttacaaat

SEQ ID NO: 413 - DNA, 3960 bp, Homo sapiens
gaatccctctgatttataggcctatggactgttttcagaaacctaagataccctctagggagggaggttagtacacagaatgtatgctgtcaggtcctttacacttgtactttaaattaagttctgagggctgggctcagtgactcacgcctgtaatcccagcactttgggaggccgaggcgggcggatcacctgaggttgggagttcgagaccagcctgaccaacatggaaaaacgccgtctctactaaaaatacaaaattagccaggtgtggtggcatatacctataatcccaactactcgggaggctgaggcaggagaatcgcttgaacctgggaggcggaggttgcagtgagccgagatgttgccattgcacaccagcctgggcaacaagagcgaaactctgtgtcaataaataaataaaaataaatttggttctgagttatctagtaactagcacaaagacagaaatgtagttatccatgaaatgcagtttgtgatgtctataagatattcacaaatgcttagcaggtacttgttgagcatcttccatgtgtcatacattgttctaggtgccaggacctttggcatcaagaaagcccctacccttaaagagcttactttgtaatggagatagactacacatttgataactggttcttgaggtcctcttatacgccagacactattctaggttccaatggcacagttttaattaaaggtagatgatgtctctgccctcttggagcattttattctagtgagatctatatagtacataacagtttttaaaaaagatagatccatgattcccagatctgagaatcatgagacaaggttttcccaagggtcatcagagagaaaatatggtattgtgattctcaatctttcttttttctttcttttttttggagatggattcttgctctgtcaccaggctggagtgcagtggcgtgatctcagctcactgcaacctccgccttccgggttcaagcaattgtcctgcctcagcctcccaagtagctgggattacaggcacccaccaccacgcctggctaatttttgtatttttagtagaaacggggtttcaccatgttggctaggatggtcttgacctcttgacctcctgatccgtccgcctcaccctcccaaagtgctggggttacaggtgtgagccaccgcacccagcctgtggttctcaatgtttagtgcacatcagattgacctaaagagtttattaacacattgctgggccccacctccagtatttctgattcaggaggtctgcattggagcctgagagttggcatttctaacaagttcccagataatgctgatgttgctgctctggggaccgtgcttttggaactgccagtacggtatacggcagcagtccccaacccttttggcaccagggcccagtttcatggaagacaatttttccgtggatcagggaggtagtgggggatggtttcgggatgaaaggattccacctcagatcatgaggcattagttagattctcataaggggcacataagctagaacccttgcatgtgtagttcaatagggtttgcgctcctatgagaatctaatgccaccgctgatctgacaggaggcggagctcaggccataatgctcatttggccttctggcctggggtttggggacccctggtgtaagagacatctgccacaatagccttaccgtggttactacagaatttccacagagctgttgtgcagaaccacagttgaataaaaattctgtggaaggccaaaaagatgcataaggttattgtagtagagcatttggtatatagaggaacatttccagcctgttccaagaaagaggtgttagaaggtggtatccctcaaactcttagtgtcaatttgaggttatagtcctggacatagagcttaagttcatgtattatgtggtgttggcttgagtgcttgttgtgtgtaggtagggtaatcctgtatccttactattaatttatttcccttttatactccccccacctctcctccccaagagggaacaatgttacaatcattttttaaaatggaaataatgtattaaatgtgaaacattttttatttcagaactgttcgtcaggtggcacaggagcagttctttttaatgtgcaccagatgttgcatgggacaccggcctctacttttcttcattactctactctttactgttttgggggtgagactttttaaaatatgcttatcaatgtgattcattctttaagcaagaaacattcagaaatttgtggttttagcttgcattaaagttaggacagtctatatttaataaatgaagtactactttatttcccgcactgtggtagtcatcttctctagttaactctgggtttttaaaaaagtggattttgaggatggacgtgtaaattgatattattctactctgtttccagagcacagcaagagagagagctaaacactcaggcgactactttactcttttaagacaccttcttaattacgcttacaatagtaatattaatgtacccaatgctgaagttcttctcaataatgaaattgattggcttaaaagaattagggtaagttttagttaatactccatttatatgtcattattagtaaatagaatgttttattgatgatttatattttttgagcattttggttaaatggaaaactccaaagattgataaaagggaccaaagaatgtactctgcatcagtggacgttagtaatctgtgattcacaaaatgcatatctagtttagtaaaatgaattgcttacttgacacttgaaatactgatgttcagcttcttttattttagcattttgggcctttttgcaaattctaatttttaaaaaaagtattcttgaattgtttatgtcaaaaatgagtctgatagagcagaactttctaccataacatctgatactttttacttaggcaaaatgatacaagaatttatttctgaagagatttgtagtttttaaccttcaaattagcatttcttctagtagttcataaagccaatttctagaaagttctgaagaaaacaaagttgtttgaatggaaagacttaaggaaattatctcatatccctccagctctgtctcgttctggctcctctctccctctttacctccctttcataagctagacatttgatttcttcccccccccaccccaccccccgcctttggcaggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagtaagttctgtgttcttggttgtaagctacatatcataaccttctaaatgtttataatcaaatttaattaatttatagtagtatcatgtctttgtactttcttgatcttttctcttttttaagaatctttatcaaatttacagtaatttaagaaatacagttatgccttactttattcaagagacatttctaaatttgtatttaaataagatttcatggctggacttgctggcctcatgcctgtaatcccagtactttgggaggccgagtccagtggatggcttgagcccaagagttgaagaccagcctgggcaacatggtgaaaccccttctctacaaaagaaaaaaaaaaaattgccaggtgtggtggcgcacacccatggtccccagctacttgagaggctgagatggaaggatcacctgagcccaggaggtggaggttgcagtgagctgagatcgcaccactgcactccagcctgaaggaacagagcaaggccctgtctcaaaataaatagataaataaataagatactttataaagtaattgttgtttagtttttctctttggaaaatctgaattgttaatttcattta

SEQ ID NO: 414 - DNA, 4026 bp, Homo sapiens
aacatgcctgtcatctataatgtctatgttccaaatgactaattcaactggtttgttcctaaatatattttaacatataaaaaggtatctgcacatccaagaaggcatttagttcagctcaaataggatgcttgatatattcaacatggcattaatatttaacccaaaataattagtgttctctatcattttggctgtgactttcttttggaattgggaaagggggttatgggggtttgcaggacaaacactcctgagattctctcattttaatcctgctgacaaaaatataccaaacagaaatagctacaaggaatatgtaaatgttctgatgttatcagtagttgaaaatttggaatagtgaaacccataaaataaattctagacctgatgtaaattttctttcaagagcccaaatgtttgttttctttcgaggctatgtcatccatttattttcccctcacgtctccggaatttgttggttccatctctatggaaaccattcagaaggatgataatgtgaaatctaccacccacatgtgcacagccctccctatcagcgctggtggggtgtaatatcactctctggttcagatcagctttcagagaatagaaagaaatagtatttaaaatgcacctgaaaagtaaatgaaaagtacaggacaacatcatctccttctcaaaacactggctgctcctacggtaaattaacatccgcccacagccagaaagcaatatggtgaatattctttatggccaccaagagcaaaggctgctggccagtattcagatggctggaatgctgcagcccgttcatgtacttttgaggcttttcttaagggggaagagaaacaggccattttcttttgaaattaaccttggaatttaccattcaaatttttaccaataccacaatgaaaaagaagccttcatcaatgcaaacgcattcacagacgctacagagaaactagttctttgattttcctgtccccttattaataaagtggagcatattgaaactaagagttatgtacagggacagcaatactggaatgattgtgctgagagatctggctcctataatgatatgataaaaataattgcatctacgacaaagcacatgcacccaccaggattacatttgcaatgatggaaaagcagacaaagatgcaaagtgtttatcaaattgttaacactcattgattgggagcatgtacttgggtatttcaaaagctcctgttggtacaacttatgatttcccacttagtgaagcctgcattcccttaagtaaagttggtttttacatatgttaatctaaaagccaatctgtgccccttgctaggaatactttgaattgcagaggcaaccacttactctgtcctcatgtcatgatgatcctgctagaaattaaagttacctcttccacaaactaacttttaaaaaatcacctaggaattatcaccatactccatctatgtctgatttgtttccatgctggaaatgaaaagtggacacctatattttcaaataagatgtcttccttttaagactaattcatcatttgaaataaaatttcaactcagtgtttctggtgtataaaatggcaccaatccaaaaagatgggaaaaaagagcctaggagtccccacctttcctcctccacagttagacattatatcccagtgaacagcagaggcagatgtccttaactgcccaggctggagtgcaatgctgcgatcttggctcaccacaacctccacctcccaggttcaagcaattctcctgcctcagcctcccaactagctgcgattacaggcatgcaccaccacgcccagctaattttgtatttttagtagagacagggtttttccatgttggtcaggctggtctcaaactcccagtctcagatgatccacccgcctcaacctcccaaagtgctgggattacaggtgtgagccaccatgcctggcctttttggttctttacatcatacagcaaacagcaatggaaaacaacaaaatagcatggaagtggactagaagtattttctcaaatgcaggagaaatgctttcagtgttgttctatcagtgaggaccagagtgggcaggagacacagacatggatggacagacacacacacacaccacacaatcagtgaggaccagagtggacaggagacagacacagatgaacacacacacacacccctagaagtaggagtgacttggctgggcgcggtggctcacgcctgtaatcccagccctctgggaggccaaggcgggtggatcatgaggtcaggagttcaagaccagcctggccaagatggtgaaaccccgtctctactaaaaatgcaaaaaattacccaggcacactggcaggcacctgtaatcccagctactcgggaggctgaggcaggagaatcacttgaactcgaagggcagaggttgcagtgagccaagatcatcccactgcactccagcctgggcaacagagtgagactctgtctcaggcaaaaaaaaaaaaaaaaaaaaaaaaaaaaaagaagaagtaggagtgacttatctaactgttgaggtaagactggaataagtaactgagcatgcatagctcaggcctctctcatatcttttctagaagagcctgtctacagaatgcacatgttctctttctctagaaagtgctagcaataaagctgatattatgatctccaacaccatgtctttttgtcagtcagttgtgaatcaaaaattttgggggtgggaggggaagggaacacaattatctgtcccccttaaaaatcctgacagaagggccaggcgcagtggctcatgcctgtaatcccagcactttgggaggctgaagcgggcggatcacctgaggtcaggagttcgagaccagcctggccaacacggtgaaaccccatctctactaaaaatacaaaaattagccgggggtggttgtgggtgcctgtaatcccagctacttgggaggctgaggcagaagaattgcttcaacctgggaggcagaggttgcagtgagccaagatcacaccactgcactccagactgggatacacagcaagactccgtctgggcagggtggtaggcggggaatcctgagagaagacagtggaccaagattctctcccagactccaccaatgactcaatgagatagctcagaagtagcctatgtcccagggtctccaaggaggagtaaaggcctgaatctgcccacctgcaggtttcacatcttactcaaatacagcacagaaattaagctgcagaagaggaagagatgaccagatccacaatttagcatcctagtagattttatgggactggaagtgggaagaaacttctatttcctcaacatttgagcaagaacatttctcgatccagagaaacccggtaggttcccggacattggagacagcactaggaggtgggtgtcagtgtggaggctctgagactgcaaggggacagatggaggatggagagaattatgcaaatcacagtcatcctgttcctgaactgagaaatacattaccatcctgagttctccagtaagttccgcaaaatcgtctgtggcactgagcagttataatagcccatgccaatatacgatctccagatctggtttttgcttgaaatggcatgcagagttgcaaggatttcattttcacctaattgtgggaaaaagagaaatgttacagacagatgtctcagaaaagagctctaattacagtttaaatccctcattttgtttgagtatttatgacagaataactatatggaaaatgtaagagtcatccatccaaccaacactaagtactgtatgcgacatctcaaaaaaaaaaaaagtccccaaacaacactcaatttctcctcaaggttggcccccccatcactgttttgactgttccttattcggttctgtttgctagaactgcccattttaacacttgcctcattccaggctttttctgttccctttctatttctgctgtatatacgctaaataaaaat

SEQ ID NO: 415 - DNA, 4029 bp, Homo sapiens
aatgtttctcctgtcatcttgtcatctgcctatactaataatcctcttacaagttcctgccatttacacaggccatgcggaatatgcatttgtgagggggaaggatggtcaagtgtcagcagcagcccaggggttttgtgggtggaaggatgaaaaagatgaagggtcatctggtcccagggccctggtgacagtagcctctgttactctgcagcagtcagcataggtgaccagaaagtcactgagggtaggcactaaaaagcctcaggagtggccaggtgcagtggctcacacctgtattcccagcactttgggaggctgaggtgggcagatcacgaggtcgggagttcaagaccagccggaccagggctgcccctcatgggctgtggactttggactttggattggcataaataagaaccgggacaattcccaggaagggatttgggggtgggagtaaggtggggaggaggtagggctcaaacaccaagctttctcaggtgtgtcaaggcaagagaaacttacgcagtatgaggcgtccacacctctgctccttcagtgtcttttctgggagtgagatcaagaagagagggtgtcccgtcccagcagatggtgaaaccccgtctgtagcaaaaatacaaaaattagccgggcgtggtggtgcgtgcctgcaatcccagctactcaggaggctgaggcaggagaatttcttgagcctgggaggcggaggttgcagtcagccgagatcgcaccactgcactccagcctgggcaacagagtgaggctccgtctcaaaaaaaaaaaaaaaaaagtctcaggagctcgggcagccaggtggggagctggcccatcaggagttggcatgcaaatgagccacgtgcctcccagcgggggaccagaggccaggtcagggcaacagcctccagggctgcccgtcatgggctgtggactttgtataggcataaataagaaccgggacaatttccaggaggggatttgggagtgggagtaaggtaagggggaggtagggctcaaacaccaagctttctcaggtgtgtcaaggcaagagaaacttacccagtatgtggcgtccacacctctgctccttcagtgtctttcctgggagtgagatcaagaagagaggggggggtcccgtctcagcaggaagcccaggctgcccacccagtctgaggggacggcactgactgggcaggatctggcaagaggggagtttagggtgcagatttgggtccaattcagcttgtgaccagaagagggatcatcaactgggatcccagatcacatggaatcctgtggttcccttgagaactgcctggacccccaggtcaaccatatgggctggaaaggaagtaagttctagcaaaaggaccttcatacaaggactaaagccgtgggaaccacacttcaattcatgactttcagcatatcttgaaagcacttagatagggaaggtttggaaaggcagaactgctactgccgctgctgctgcctcttctttccattttgtgtctcagctcaaagatagagcttctctttaccctctcagcccagataaatatcttgttttgcctttcttgcatttttttttgtttaaagaaatttggaggctgaattgggaggatcacttgaccccagaaggtcgaggctgcagtgagccatgattgcgccaccgcactccagcctgggcaacagagtgagaccctgtctcaaaaaaaaaaaaaaaaggccgggggggggagcataatagtggaaatgctctgtcttgccctgaaaatgaatgctgtagagagccagggctgccactcttggctgctccacaggttgcttctccagatgcggagatggggagaagggacctgtggccccaggctgaggtctgtgaggggcctgctgctgtggctcacttgctgaccaaggaggatgccatacggccccccactggggtctgagggcgcaacccaagccaccctgaaggggtgtgtgcacaaggagctctcaggagaagcccccaaggtggcctgttggaaggctctgatgggaacatttccttccaccttcaagaaagaagcaatgggaccctgaagaatgcagcccagagagatccaaagggtcagaagctctggggcaaatctggtaaacttcctgggggtgccacagactcatctccaccttgccctgtggtctggccccgccttctggtggagcctgcccccgccttctggtggagcctgccccgtccccaccctgacacttgacctgtggctgacagtgggccacctctgctccactcaggctccgtggccggagagtctgcagcttctctggcattcctcctccccgtctgggtcctgtgatggaaacagtctcattcagctgccccagagactcacaagtcctttactcattcagcaagtattttccagtccctgccatgtgttgggcccctgttaattctatagtaatatttgttgtggtaaataaaattgccttcatagtgatgtcatggtggagggaggaacactcaggagaagagggtgtctctgagcccacagagctcccactgctatttctaagaggccagcaatacatctttgcatttcagaaaactgggtctattcaagaaataaagatggatggaggtcaaaatgggaatggatttggagaacagagtgggggtggggatggagcaggatggaaatgagagggggtggagagggaataggggggaggttggtgatggggaggggacaggataaggaacaagatgaggaagggggaaggtggagttggagtggagatgaggatcaaagtgaggagggctgggtcatcctctggcctctcctaccatgccccatctacacggatgcaaagaaaacttcattcactcatcgaacgtttctgggactcttcctgaatgccagacttgcattggtacagaaaaatgactctcttcatacttgccttcaaagagctcagagtctgggctgcggagaggtctttttataaacaaaaacactggccgggcacagtggctcacacctataatttcagcactttgggaggccaaggcgggtggatcacatgaggtcaggagtttgagaccagcctggccaatatggagaaaccctgtctctactaaaaatacaaaattagccaggcgtggtggtgcatgcctgtaatcccagctacttgggaggctgaggcaggagaatcacttgaacccaggatgtggacgttgtgatgagccgagatcgtgccattgcactccagcctgggcaacaagagtgaaactctgtcaaaaaaaaaagagctatgacagacaagtggggcacagaatgaggagccatctatccctggtgggagtctgggaggacttcagagaggaagtgatggttatgtgtgtttaattggattcatttatttaattcaattagtaatacattcacatgttcgaaatcctaaaggcacaaaagaacttgtgtctggtcatggttgcataattctgtgaatgtaccaaacaccatggaaaccattgaattatgtactttaaatgggcgaatgatacagtatgtgacttatagctcaataaaattgtatttcagaaaagggtttatgtctccatcccacatctgataatagttcctccctgaagtcaaataatatggtgagtttcttctgtatcttttttgttgggagttggggagtgacatttgaagtggtgaatgagctgaatttagtcaagtagtggactgcggaatacagtgttctggcagtgacagaggcacgaaggctcgtggttctgtgaatgccccaatggttggagcatggggtgagggtggcagaatggcaaaggctgattgggggtggggtgagcagagccttggaggccatgcgaggcagtgtgtacttcatctgtaagcagtgatgatccagacctttaagctgcatgaaaaacaatgtgacaataatttaaagacacccaaatctccttccaacatcccgttgtca

SEQ ID NO: 416 - DNA, 4204 bp, Homo sapiens
acataaacttttcattctttccaccattcatgatcatcacctcatacttgagtcattccaaaaaaaaagtgaattctaaattcccaaattcagaatttagtaggaattctaaatactactcttaatttatccaagatacttaggtatcctaatgaaaatcaatataaggcaaattaatgccttagctaatataacagtagctttacttttgtatgtatgctctttttagctgcaaagactgttgcttttgcctggaataatccttcttcaaaggtagctcaaatgaaatctaccctgaactagaggtctgagttagcacaatactctgtaaaaattttcattatcacagttattcaattatactttaatgattaacatgaccagaggtgagacctagccaggtcactgtctcaagagttacaagcagaggaaacaactaaagcaaaggtcctacaatggagcatcattagagtgagtattcaaggacaaataagtaggccagtgtagctggaatattgtgagggcaaagtagggaaggaacttagaaggataactaggaatcaatttcctttaatagactgtgaactgcttgagggcagggcttgatgaccatgtatgataacaaaatattaacaggactaacatttatggaatacttcttacatgccattacactattagcccttactattatttcagtgctcaactatgggcacagtcatccctatttgtggatttgtagctttttgaaactaagtttcaaaagctactcaaggtaacaaaactaagcagctgagcaagaatgtgaacccaggtctttctaaagccaacctcatgctattaatcataatcccactgactgacttaatgtgttcagtacttaacaggtactcaataaatacttgctaaaaggtcaatgtaataaaatgaaaaatattatcatgctggaggtttcaaatattggccaaatcttaaaagcatttttaaataacctgccgcaaattttaaactccactagtcaatacactttatgatcacgtacagtccactgcagcataaaataaaggaattctaaacactagccttgcttgatccaaaagatactgagggatcctaatgaaaaataatataaggcaaattaatgccttagctaataaaatagtagttttactttttaaggtacagataattcagactagatcataatttaagaatgattaacctcaactgattatcatagttaaagccaatagatacgttaaacacaaccatcatgcagagattcatttactagtctgacaaatatttgttggtaaccttttatttgccaggtattgatctaagtgcttgagatacaacagtgacaagatcaaataaagattcccactcttgtgaaatatatgttctagtagcaggtaaatagctaatatacagtacatgggccgggcacagtggctcacgcctgtaatcccagcactttgggaggctgaggcgggagaaatcaccttaggtcaggagttcaagaccagcctggccaacatggtgaaatccgtctctactaaaaatacaaaaattagccaggtgtggtgttgggtgcctgtcatcccagctatactcgggaggctgaggcaggagaatcgcttgaactcaggaggcagaggttgcagtgagctgagatcgcgccactgcaatccagcctaggcgacacagtgagactccgtctcaaaaacaaacaaacaataaatataagcaaaatacacagcagcacagcagtcataggacagtaataagtgctctgaaaaaaagaaaaagtagagaagagtaaaggggactagacatactagactggggctgaggacaggttgcagtattaaatgaggcctctttaggaagtgcaaagaccaggggtgagacttggccaggtcactgtctcagagttacaagcagagggaacaactaaagcaaaggtcccatgctggagcatgattagagtgagtattcaaggacaaataaggaggccagtgtagctggaatattgtgaagggaaagtaaggaaggaacttagaaggataactaggaatctaaatttagagtcttgcagaccacgataaagactttagctttctttggttctttcttcctttcagtctctgctcaaattccaccttaacaggtgagactatgataggcaaagggaaaacctagactactcagtataatatagcaactcaacacccccaactccccatatttccttttctctttattcttctttaatttctccataatacttactatcacctaacatacttgccttattgttatgcaaactccttaagtaggaaagaactttggtttgctaactgctatctccctaatgactagaatagtacctggcacacagctggcaccttaaacaataatttgttgaataaatgaacaaaaatagtgatttggcagttagattactcataagcctggtcattaagtgtctcaacataagagacggatccacttttacttaagtgtactggccaaatcaggtttctaaacctattaactgaagagctgaatctctcgagaggtagcctgttggccttcacctggcagattcactgtctttattaatgtcattagacaagactaatgcttttatctgaattatagtaacctctatatttaattttttagtgtgcatcaacttacatttaaattcttgttaatcgctgcatataatgttgaatacttacgttaacttcaatctttttgcatgaccaggcattacaggaacataaagcattttgactccctgtaccaccattgttggctcaattccatacttctcctaaaagtgaatatccaaaaaagaaacaatgaaagcctcgctcaaacataaaatgcttatttaacattgttcgtaaacaatgttttatgaccagtaaaaaaagcaaattcatggtaaataattataacttccaataaaattataaataaaaacaaaacagaaaccagacataaagctactaatgaactaaatgaacaaaagtatctcactttgactgcatttatgaaatccaagagggtgaaatcttcttttccatgtacggtccatcgatcccaaattgtaaatgatattccatttctgttacagaaaaatattcagaacagaaacattgaaattttcttccttttagtgatgacacacacacaaaaaaaacccactttcagaagtccattatttgtgatcaggctagaaattaatgtggggaaataaaggataatatatcttctaaaatattccataatcttatttcttcatcacatcatatagataaccacttttaatcagtaccttgctgatccttccagtgtattataaatcagtatgttttagcaagacagtgttgtctctctctttttaaaatgggtttcactgtgtggatgttccagtaccccattactggacacttcggttattctaatcattggccacgataaataatgccagaataattatcttgcaaatatatagtttgagacttgtgcaaatgtatctgaaatatagtgctatatatcccttactgtggattatagtattttgtactctcattagtaatgtatgagagtgtctgctttctcacacccttgttaaggtaggttttttttcaagtttttggttgttgccaatctgaaaactaaaaagtacaggcccaggaattgttctgctttgtctcaagcttgtggaattcttctaaatctcatgacctacagtcagacaccagggtaccttctaattcatctggcagacacagatgaaaccataatgccaaataatgtggcagataaagtgctgtaagggttctttggctactttagtcagaaatatttaatgaagatgaggtttgagctgatcttgaagtgatggcaaaaatttacacatacacaatagaagaaaaaagaggtgaagctagtatttttcccttttaaaaggtaaaatattttatttcattctcattatacaagagaaatagactttcatacatacctgattttagttttccttacttcagttgtctctgtaaatactacaattggaatggctaagttaagaaaacaatttttgtaagcttcaaatggatagccaccagttactttgatcatctccaaggcaacctagataaaagaaggtgatctgataatataa

SEQ ID NO: 417 - DNA, 4205 bp, Homo sapiens
ctcatacttatgcaaggagttcagcatgatctgagggagacagatacaggattggtggcactgaaaggcctgcgttaaaacagcaaaacatccatttctccaggatgcagaaagtcctctggatcccaagaaagtgtctctgctgttgagggaagtggggttccaccaggggaggcttctccgcggtttatatgtgctattcccacagcttgtttggaaaagggatgtgagatgctacacaccattaaaagcaatgaatgctcatcacaaaatcctttcacctggtggaataaagtactaaggctttcaggaaggctatggtcatttttaaaagactgagcttgtttgcaacttgcctaacctggggtcttccaggaacaatccccgactaaagaatgttctttagaaaagcacgactttacaagtttgttccgactccacgcagtaagtactgtggcgcatgtttaaatttaaatgcgactttgccatcaaggctgatatcttttccacccccaggagagtttagggctagacaacggaagttccccaaaagctccagtccttcaaaggggagtgctcccgctccccgttcgccaggcgtggatgttatcagcttagtataaacagcgctaaaggccttattagagaaggctgtggcagtttctccagggcagacgtcgcctcccgttcaagcagcgtcccttcccacaacccccgtgcagaaggcgcagcgcggccccctcctcgctggtcccagacctggcgggctcctcacacctacctggccccctccgttgagcttgttggtgagcttgactttgctgaaggagacgggagccttcatccagtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctcctggaaaacacggggcgggcgcaggaggaccccgacactgaccaggtaggccggaggcagaagctgggcacagaggcctcagttatttcggggcacagaggagccccctggggaacgtccgagggtgactcccaagctcccccttccccgagccctgccaggtccaggtggcctcctcaccatctccacggcctcgggagggaggggaggagaggacctggcgaagggtttcagtgcaggaggccacatcccgcggggacaggcggggaccagggcgcgcctcgcgggtcccgggatgcctccgaggtcgggacaccgaagtgcgcgttcctcctccccaagcttccgcggagaaagccccagaagaggggcttgtagaaatgcactcgagggagttaaccagagcgggaacaaacacaaagccctcctccaggagaaaaagggttcgacctccgggaacttgccaggtcccccaggctgcccaggcgctggagagcgcggcgcgcgcgggctccggacgcgcacccacctgccgttcttggtcacgatcatctcattggtgagctccttgaagcgcagccacagctcgctctcctccaggcccacgcgcagttcgcgctctgtggggtcgcccttctcgctgcccgcctgcagctcattctccacggcgctcagcaggtggtccactcggtactgcaggctctttcccgcgctctcggtgccaggggagctcatcctcccgtccggctcccctccccgccgtccccgaagcccagactcgctacctgagatccaccttccctgctcttggccgccgcccttccgagaaaaggggccccttggaccgagacctgcgacggctcccgggtcccgggtcccggcacagacccgggaggagggcgcggaccaagacttggggggaggggacgggggcagaggggtggggagaagttattccacttgaactccccaaggctctactagtgtaggtctctggggaccgaaattcagtgccctccccataaatagagccgcggcggcagcgctggggtgctcggcggattgggccgcgcacgctttgaagtgccgggcagcctcccattggccgagagcggccatatcagacccagccgggcgggtctgggaggccgggggccaacaatgggctcccgcacgcctgtttcatgtaaatccggggccccagccctgcgagccccggcccagcccctacacccccgcccttctccaaatgtttgcacctccatcaaagcggcggggcaagccccggaggaaggtaagctggacgccccggcctgccccagcccgccccagcccgccccagcccgcacttccgcgaggggctgcccggcagcctgcgatgctccctgattcccgcgcggggtcctcctcgctttcccagcgcgcccggatcccgcagccgcgccaggctggaacgttcgcgcggcctcacctgtccccgctccaggcgcgcctccctcccctcccagggacgagcgcatttggccgggctttgggatgcgccgcgctcgtctcgccgcagtagtagtgctgttctcgcgcctccgatgcctcaactctccagtctggcagtttccggtgcacctgtccccacacgtccctcgcccacggagccccaggcggcgttacgcacacccaggatcgtggatcagcctgccccggcgtcgggtgtccccgcggctctcaccatctggaaaaggaaggtccgcgcgcagagagggaaatggacggaaataagcaaaagcaaaacaaccccttctgagaagtgtcctcctcgctctcttataaaaacaggacttgttgccgaggtcagcgcgcgcatcgagtgtgccaggcgtgtgcgtggtttctgctgtgtcattgctttcacggaaggtgggagaaggtcggggctggcggggtggtccggactagtgggactcggggcgctttccccgcccggcccagcgccaagcggtgtcggcagcggttgttttattacctttcggtgagaacttacgcgaggagagcgaaggagaggtgacaatgagcaggaaatagttcagtggggtctctttaaacagtaacattcctcctaaaacgggagcccaggaagggggaaggaggcagaagctcccccttccaaggcctggctttgcgcttctgcacacctcgcccattcgctggacgagggcctgcctcgggtagcagcctctgtttcccggtctcctgagcgggcaccccagccccaacccctctagagaaagcctgcgcatcgggtggggcagcgagttcagaggagtcttgcgccctagcaagggggctttcccgcggacatggtatctgcgccccgcgctaagtctcccctgccccctgccccctgcccctcgcccctcgcccagccgggctcgctccggggtcgggaattgctggggaagccgaaggagggatccccgcccgggactcgagggatcgacccgcctcgcggtatgcggagggctgccaggagccagtcccggggaagggtgcctgccgcccgtgggggacagggctccttctctcccttctccaacttacaccgacgagtcaggaagccggagcgtctagtccctgtccgcatttctcagtgtcttttgatgtctgggatgcatggatattcccagggggctgacccgaggtggggaagtttccttctagaaagaggcaccaaaaggacctcatttgctcctgacgccggaccctcctgacacgccttcactggctcatcgggtcctgggctttgggggagagcgtggtgcgtgttactctccttactccgggtattaaaatgtctaagaggtcatcgctttggcccaaggcctcccgaggataagataaaagggaaaagtggaggggaggtgaaggaggaacgagggtgggtcccaggcaattgagggcctcggaaccctaggcacgggagcgaaacctctcctgcggcttcagggcaaaggagtcccgaaggctggatccctcccctgcgctcggacggcgtcgcggccgcttttcccacagtcgggaagcgccaaagaagactggagggtttaacagatcgctctaaaactgttccgaacaggaggggcacggccaaataagaatacaact

SEQ ID NO: 418 - DNA, 4230 bp, Homo sapiens
taactgccgggaacacttccttttcagaaatttctaaggaactctatgttattttttccaaataaactttttatcttatcattttgaccattttaagtttacaattcagtggcattcagtacactgacattgttatgtaaccatcagtaccatccatctctagaatattataatcatcccacactgaatctctactcattaaacagtaactctccattcctccctatccccatcacctgatgataaccactatctactttttgtctcatgaatttgcctattctaggtaaatttatataattataataagtggagtccacttatatggcatcccactatttgtccttttgtgtgtggcttattttacttagcataatgtttttaaggttcatctagatctatcttgtgacatgaatcagaacttcattcctttttatggctgaataatagttcgttatatgtatatactatatttcatttattcattcatctgttgctagacacttgggttggtttgtttttaccttttggctattttgagtaatgctgttataaacataggtgtacacatatctgtttgagttcccgtattcagttcttttaggtatatacctgggagtagaattgctagatcataagggaattctatttttaatattttgaggaactggcatactgtattccacagtggctgcaccattttacattcccaccagcagtgggaacctttaacaaaggttccaatttttccacatctccaccaacacttattaaattgtttttttagtaatagccaagtgtcttagtctgttttgtatgtgataacagaataccacagactgagtaacttataatgaacagaaatttatttcttagagttctggaggctgagaagtctaatatcaaggcatgggcatctgtgagggccctcttgctttgtcataatatgatggaaggcatcacatggtggaaaggaaaagagacggtgagagagagagtaagagggacaaaaccatgccctaaataacaaacacacccctgcaataacgacattagtccattcatgaggacagagccataatgacccaaacacctcttaaaggcgccaccccaataacattacattgacaattaaatttcatcatgagttttgaaggggacattcaaaccatagaccgtcctaatagatatgaagtagatatgcatactagatatgcatttccctaaaaattagaaatgtgttgagaatcttttcatgtgcttattggtcatttgtatatcttctttagagaaacatctttttaagtcttttgcccattttcaagttgggttgacatttgttactgagttttaagagttatttatatgttctggatattacttccttatcaaatatatgatttacaaatatttcctctcattctgtgggttgccttttcactctgttgatagtgtcatttgatgcacaaaatttgcttttaattgatgaaatataatttttttcttgtcttgcctgggcttttagagtcacatccaataaatcatagccagatcaaatgtcaagaagcatttcctctgttttcttctgagagttttatagttttacctcttatgtttaggtctctgatctattttgagtttgtgtttgtatatgataagggtccagcttcactttttttgcatgtggatatccagttttaccagcaccatttgtagaagagactccctttccccatttgactgttccttgtcacgcttgttgaaaaccgtttgaccatatatgcaggggtttatttccgaggtctctgttctattccattggtctgtatgtctgcctttttgtcattaccattgttttgattattatagttttggaatcagaaagtgtgagccttctcaactttgctctttgtttctaggattgttttggctatttgtggtcccttgagatttcatatgtattttggaatggatttttctatttcagaaaaaaaaaaccaaaaaataccatcatcaggattttcataggggttgcactaaatctgaagattgctttgtatagtattgacagtttaaaaatactaaatttttccaatccataaacacaagtgtctttccatttattttatatctttaattttttttagcagttttgtagttttcagtgtacaagtctttcacctccttagtttattcctaagtattttattctttttgatgctattacaaatgatattgttttcttaatttccttttcagattattcattgttagtgtatagaaatacaactgagttttgtatgttgattttgtaacctgccacttaactgaattcatttattagttctaagagatttttgcatgtgtgtgtatatgtgggatccttagggttttctaaataaaagatcatgtcatctgcaaacagagcgaattttatttcttcctttctaatttgaatttctttttcttacctaattgctctgattagaactttcagtcctatgtcagatagaagtggcaaacatggacaccctgtcttgttcctgatcttagggaaaaagccttcattcatttaacattgagtatgatgttagctgtgggtttttaatatatggcctttattatgttgaggaagtttccttccatttcaggtcaactctaaagcatttatttttattaatccctcttttttttttttttttttttttttttgagacagagtctcgctgtgttgccagactggagtgcagtggctgtgtctcggctcactgcaacctccgcctcccgggttcaagcgattctcctgcctcagcctcccaagtagctgggattacaggcacgcactaccacacccagctaatttttgttttttttttttttagtagagacggggtgtcaccatgttggccaggatggtctcgaactcctgacctcgtgatccgcctgcctcggcctcccaaagtgctgggattacaggcgtgagccactgtgcccggctaatccctctatcttttaattttaattagaatcacattggatttatagactaattttgagaaaatagtacagataaatttgcatgttgaaccacagaatgttgtcacagaaaatgtgagtggggaggaagaagaaagattatgacattaaatgtaagtttataaatttttatgatactactttgagaaacattaatatagtttataaggaaaattatattttaagggattttctacaaaggtgaaaaaaaatcaccctatgagtttaaaggattttaagctttatatttaattctttccttcttttattaatttaatctatatttcttcttttttcctaggatatcctaaacctgaggaaggaatacttgacagtttgggttggtatagctatcatgacaaatataagtggtagtatgtgtagaaacgtgtaggtaattagtttttatgaggtgcccaaacataggatccttggtagggtaagataactttcttaaatgctgtgtttgtatgtaggttaaaatatataaaacacaattttctttccacattatattgttattttgtgatggtaatctgtcgataaattttctttctattcatatcttatatacatgaaccttaaagcaatctaagttgggtttattttttctgtaacacgctgatttaacacacttgatgtaggcttacgcagtttacacaatgcatgttaaaaaaaaagatgaagtgcagttgtgatataggccaatgaaaaataaagatttcttaataagtaaaaacaaaaatctattacctttcatttcttagactagtttggtaatggttaatcattttatataatgcaccttaggcttgttttttagtatttgccttacctccaaaatctgtggtccaagtaaatctgttgccatcttaaactgttaaacacttgataactgtttatgagatgagaagagcagagttgaacatagcactttatgctttgacttatagcaatttaataaaagtaatggcagtttagaagcaaaggtactagggacagaaacagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgg

SEQ ID NO: 419 - DNA, 4535 bp, Homo sapiens
ctaccttgttagcacaagtgtaaagtctcaccatctctttgatgacaacatgttacattggatggttaaaacatttatcagctcccccagtagactgcaatttctgtgaacaagatacaacttattcttcatagcaactctgacaaagttgcaaaaggtatatatatgttggccaggcaaggtggttcacgcctgtaatcccagcactttgggaggctgaggtgggcagatctcttgaggtcaggagtttgagaccagcctggtcaatatagtgaaaccttatctctactaaaaatacaaaaattagccgggcgtagtggcgggcacctgtaatcccagctactcaggaggctgaggtgcgagaatcacttgaacccgggaggaggaggttgcagtgagccacgatcatgccactgcactccagcctgggtgatagagtgcaactccaactcaaaaaaaaaaaaaaaaaagtatatatttgttgatttgcacatcacctaagaaaaccataagctaagaaggtttggactcaggcgtctggaaagttggtcaccacctctaccccacctcatatctgaatgtcaagagacacgtagaggcagagaagttaaagcaactttctagagacagaaatgaccactgatcaagccacaatgcactctggtttaaatgacatttaggtcatgactgtccttaatctaaaacaaacctagattagtatttcttttcattagtaaatagctaaattctgatggtaaattatgctgaccaaaaacagttcctcacttcccaagttagacatagcaattagaaaaataatctaagcaagctccatttgtatttcttttttcacctgtttattgaatatttacctcccatgaagtctttcagcctattggtggtattttactgttcagatatatgttagaatttcactgatacttactgggcgcggtggctcacacctgtaatcccagcactttgggagatagaggtgggcaaatcacaaggtcaggagttcaagaccagcctggccaatatggtaaaaccccggtctctactaaaaatacaaaaattagctgggcgtggtggcgcacgcctgtagtcccagctacttgggaggctgaggcaggagaatcgcttgaacccaggaggcagaggttgcagtgagccaagattgcgccactgcactctagcctgggcaacagagcaagactctgactcaaaaaaaaaaaaaaaaagaatttcactgatacttttcacaaaatatacagaaggaggcacaaattccaccactatggcactctgctgcgttggccaagtgtcttgatcctttggcctcaattttcttatctacgatattagggtaattgttatgtgaactacccacctcacaagtcctttgtgggttaattcataactgtgctgtgggtatttctttttctttcctttcttcctcctttcctttctttctttcttaaagatgggttctcattatggtgcttagactagactctagacccaattcctggcctctcaccatgttgcccagaccagactcaactcctggactcaaggaatcctcccacctcagccttcaattagctgggatcagaggtgtgcaccaccatgcctggcactgtggatatttctaagtgattattcttctcaaatgaactacataaaaaacaaaagattcatgaatttactaatggttctttgtgatggatgtgctaatatagagactaaaatcaaggctccaacctctaaaacatttttttttaaattccagacttgtttccccatcccactgtgcaaactgaacaaaaactgggctagcactcctgtctggaacatgtaataaggaaataaatgtgctgactcagagaacacagacatatttaatataaaataagatagaaaactggctgaaccaagtcataacacagtctaaatccacatataaaagattgagatgattttctgctttgctttattcaagcccaatgctttatcagcacagccagccaaaaatttacaacccatacacagactatgtaaacctttagttgcacatacagtaagaccagcaggtacacactatacacatttttaattaaaaaaatgactaaccactgattttgtcaccacacttaacaacgacctgatatggcacagagtgatgtgtaccaaacatggaaataccaacttgggcgacggtttgaatcttgttaacttcagtgcaaccacaccccccaaatgcatgtaaagtttgcacacatggttttttcaaggccagcctgtctttgtttccctctcctctgcatttacccaagatcttggctctgagacagaaaactcccactctcaattggttcattccgtcctatgcaattaagcaacaccacaatccagtaaatgcaatggctcaattatttatcttctggccgactttaccaggtatttggaaaaggacaatgtcaagaggtttatttctctctctagagctggcttgacgggttgatggggattttattttgtctttttttctcttttttacaaggcggggacgtggggggagcataatttaacctagaaaaagatgcgagggaatttagaaagagtaccggtctgtcaatttccctacaggaaacttgattcttatgcaataaagcctacccacgaccagccagcccgtaaggctgcaggcgacagacacacctattcctgcctccaaaagggcacagctgtctcctgaaggagcgggaacagggcaagcggaggaagtggctcagcgggagccgccgaccgggcggggaggaggcgctttccgaccccccactcgcgccggtgatccccgtcggcgtgacagtcgctccggtggccggaacgtccccagggccccagggagcaggaaatcgggggactgtccctcactcctgccgccgcaaccgagtgcgccctcgccccacggtgccccctcgagcgcgttctgtttctccgaagaacgaaacttccctccagcgccccgagtcccttccgaggcccgctcctgtcatcccgaagagtcttccctcagggcgaccctccgcgtctcttcatctctcccggccccactgcagcgtccatcacaacatccccaaggtcccagaggccccctgccgctgcggagcccccgggtccccaggcctccccaacggccccaccctgcacccccttcacctgtttctccggcagaggccgagaggccggggctgcgcgtgtgccggggacgggcggcgaggctccctcaggccgaagggcctctccgagccgagggggagagacagcgccaagccggggtgcctgtccaggatccggttggggcttgttccctcggctgcgacgtcggaacccccggctccccctcccagtctgcgccgccgcagctccggaaaccgctgaattacagccccttcagccaatcctcgcccagccccagcctggccgaggcacgccgtcatgcataattcatgaaaggccagctcgttcggccacccagaggtcccagtgcgtgtgcggtacagccgaagccccgcccactgaccaatgaggagagcagctaggagaaagggcggagccaagaggagactgatacgcccctgtgctggctgttccgacagttcggtgctcctccctccgccacagcgagggaagagccgaggacttgggcacagaagcccggggggagggagggaagatgaccggaatgtcctgctgaaaactcagctgagttcctggcagtgcgtgacgtcaaggcactttaaatgcccctgatacagctccctcctgcccgctctcccttttcccggcccttggcaccacgtggtggcgaggttgagagcctcttaccacgcgggaatcagctagttagatagtccccaggtatctccagatcctctggggacccaactcctgaattgggttctggggacaacaaaaagaacatgggtgactccgcctgctttgaacttcagtttctgcgtgagcagggacacacacacccggaaacatgacgtggaaatagagtaattactagagtgcgtggggagagggtagtggatttaaccccgtactccgttccatcacttcaagcatcaaacgccgaccagctagcccattggcccgtacaggcgaatgcagaagacggtgtatacgaaagctgataacgtgtagggcttgacatttttatgcgtctgaattgaaatacatgaaatgttctgcctttttcttttccaccttgcctacttggtatgcaagttttactgaattgaagccagtggttgataggaaatgtagacattttgcctttcataatagaggatgaactttgcataatggagtgatttctgtgtatgtgctgatactatcagggtttttaatttttatttttttgggtctttaaaaatatgttattaatatttgtgtttgtttaatacgaacaggtataaagacaaaaatctaaaaaggacccattatctcactgctcagctaac

SEQ ID NO: 420 - DNA, 4591 bp, Homo sapiens
actagggtatattaattttaacatccatctccttttagagtttgtaaactaaatccgcaaatacataccagatctgtctttggaggatctggacactcagcagagaaataaggtgccgaacttctgcctccactgctgtcagaagatggctttggaggttgagcatgctgtctgtaagtagcacttttaggagtccaacaaaacaggttgatagattctctcacacagcgttcaatgtcaatttctagatagaaatgttttaaaaaagcaaatgtatagaatttagattgctcttttaatgtaataaacaccatctctcctaagtgaatatatctaaatatggctaagatgataagttattagaaaaaatgtcagtaaaaaaaacaatgtatatattaatcagcatatttatgactggattgatggaaatatttggtataatttgcttatatatatttgtaaatgtatctacttatgttttcatgtgtgtcttttacttggaattatctacatatacatatgtatatatttcagagtatcattatttaaatgccacagaatagaacacatctccttatttaaaaatctgccaaatttatgctgatgtttccacttttccaatgtgaaacaaaagttatagggggagaatacaatttgggaataggtagacaaaagatttagaagatgttgattgctgattcagaatgaattctagtaaagtgaactgacagttttactgccattaaataagatataaaattatcagaaaaaatttttcagaatctcaattcagcatttctcaattttttttttcctgtttttgagatagagtcttgttctgtctcctaggctggagtgcagtggtgcaatcacggctcactgcaaccttggcctcccaggttcaagcaattctcgtgcctcagccttcctagaagctgggattacaggcctatgccacaacacccggctaattttttgtatttttagtagacatggggtttcgccatgttgcccaggctgttcttgaattcctgacctcaggcaatccacctgcctcggcctcccaaaattctagggttacagggatcatccaccatgcccaactagcatttctccattctttaataatctcttgagttaaatgaagaaaggttttaaagtttaatcaagtaaggtttaaatgcacttgactaaaagataaaatagaaacactttcatattagatttccttttgtttctcatgtttgaaatgtaagcatctttaatgcagaggtaatatacatagaaaggttactacaactctatattgtttgtgttttggatgagactgtatctctttaggaggccaacagtcctgatgagaagttagccagtcctctatggcgaaagtagaaagatcacagaaaggcggagaaattcaagaagttgactgtgatggagtttagcactgactagtttttatctttccatatttctaaaagtacaaatggcatatattctcatttcctctgtaaaagtccaagtgtcgggctcaggcaggcaatggagaaaaatatattacatgtcagaaagtggtaagttctttttttctccccctctttttgaaatgaagggcttgtaaggggaaaaggaaataggcattaagtaaattctgtggatagtgcatgagtaatcatttagagttatctgctgtggtaaggtgaagaaatctggaagagggaaaaagaaggtaacactgaccatctattatgtgacaggtattgtatactttcacttaatccatttaattcttacaatgattttattaaagacaggtatcgtaattcttcttcccaccttctatttctgctaaagacaaagaaactaagacacaaggaagttaagtgatttgttaagtatgttactatgagtagaagtctgaagttactataaggttataaggcatcttttgttacttcctaacttagatttggaatatgaaaagatagtctgataagaccagttactcaattaggcattccttagtgatgtttaccaacttcacagctcattacttccatggctacaaaaagaggtcagatttcatcacctcatatgctattcctaatataaaaactataaaacagagtgaaacaagctttgaggcatgggcctatttatttgggcaatggataatatagtgaagctctctaacaatatcaacttgttatttcacaaagaaaatacaaacacaaactagaagaaaaatcaaggtttaagacaggtttctctagcctgtttaagaaaaaagagatagcacaattcattttagaaaactttcaattcaaatagttaagataaaaatttggcagctaatgagagaaaatactcaaccatctaaagtctgtctacttaacacagtttagtttccaaaggaaagggtttcagtccatagattttgtatttgcagggctcaaatcaatttgacacatctgtcaccagcaaagtttgaaggtgagtcagtgatctagagtaaaggttgtagtgcagtccttcaatcactggcattggaaaagttatttttatctgcttccaagacatcccatcaacaccataaaaggtttacagtgaatcttgatgatgtactggcatccatcccgattctaccctgatggttagttctaacagatatctcattttccatttcacttgactcatgtcacctctcatctcaaaacccttccaaagcacattatcataatcaaaatataatgcaaaagtactttgtgaagtgtacattaaaatgcacaattactcctacaaagtaatctctcattacatggcactactgttttttaaccttgcattataattattgagacaatgcattgtgaataaaacatggattatggtttcccaggtttgaattaaagctccatgaggtattttgcaactctgggtaaaataacttctctaaatctattaatttcttcattggcacccattagtattagatctttcagaaatactgaactattttcaatatgataaacacaaccatttgggcaaggatagatggaaaagacagctttcctgagcctgctcttctctcactttaatggctataaattccttctgaaatttattgcatagctattgtcctggaacttctctttaccattatccaattctcttaggctatcccctatatttgattcctaactttttgggtaagacattatttaccactctttcatatttacttctcattttgatgaaacacattatccagcagctacaaagaaagagtacacaggaggtaaactattcaaaaaccttcaatgaatatcattaatctgcccttgactgatagtttgaccagatacagcattctagggttgaatttttttcttctgagttattaaaggtagagctccaatgtctgctgctgagaagtctgataaaattctgatttaggattatttgtacatgattttctgtttctctgttaagttttaggatccctgtattatgaaatttcatggtgatatacttacgcatatacttcattgtgctgggcatttggtggatccctgagtagtccttcagttacacaaaaagtatgtttttgatgtttgtgataatttgtttctttttaaatcttctattctataagaatcttgaacttcctgaatttaatttctaataattttgtcattttgttcttactttccacgtgtatttttgtttcatactctgtgagatttcctaaattttatcatcttacattttcatcacaaacatcattgcatttctatatcaatttcaatttccaggccaggcacggtggctcatgcctataatcctagcactttgggaggccaaggtaggaggatcacttgaggccaggagtttgagaccagcctggccaacatggtgaaaccctgtctctactaaacaaaaatacaaaaattagccaaatgtggtggagtgcacctgtaaccccagctacttaggaggctgagacacgagaattgcttgaacctgggaggtgaaggctgcagtgagcagtgatcacgcctgtatcacgcttgtactccagcctggctacagagcaagactctctcaaaaaaaaaaaaaagaaaaaaaaatcaatttccagattttcaacaattttcattgttatgtttaaaagttctgttttttcatagttaattttctcatagttatctttctgaataaattattttttcagtttatactattctgtatcttaattggaagctttcctcagagattttgtgatctttgattctacatatttacaagaacagcaccaaaaatcagattgaatttttttttttttttttttatgtgggctggggttagtgactggtggattaactataaggtaatttggggacatggttattttgttagaagactcctaagtaagatatttctccttctgggaacattgagtttttccagataattctctgatcttctaagctcatccttgccagccttcccagatatgaccataggaggggcctgtataactatatacattcactcactcctgctctctgctatgcctattggctctgag

SEQ ID NO: 421 - DNA, 4747 bp, Homo sapiens
aatggatgtggattagagatggagatcatagacaaggaattagaaatgcaagagcaacatattcttttaaaattccaggctgaatatcatcttggagatatgatacttgaaaaaccatttgtttgtattctattaggagtattaggacaatttaataagcagaccgtggaatgtttatattttgtgtgttttaaatttattaattcatctcattaatagtttttttgttgtttttgttattctgctacagcttttattagttttcaggatttatatccttgattttcacaaggtcatttccaaaatggaacttcagtattttaggaggctcagactcctttgatgttttaagaactatctatcaggaaaagtttgttaacaattgattatctttaatagtaagactgcaatccagctgtgactagtggatttgctaatagctattactggaagataatctataaactagttgctatcattatccctttttcctgatgagaaaataggcacaaaagaagctaagtaacttgtccatggtcacacagtcatttagtggcagagctatgattcagaacaaagcttgatggctttagaatatttaattaacagggttgttgtgaagattcttagttaataaatataagccacttaaagcagtacttgactccttttgtatagtaattgttaggtatcattaatggtattattgccattatcattatttcagggagaacttctggtagtgcacagaaatctcttcccccataaaggaagaagtcccaccaaatcttttgatggatagattacaatgaggctatgtgttttaaaacatacatcttaaaacattaatttgggggctttttgagatagcaaatctgtcttactattacagttttgagatggcaaaccccaaaatcctcatgaaaacaatttcatgtgcttgagtagctaaggtttacgttttctattgagaatgtaagataaatgaattttaactcccctgatttctgttgtaacagaatttaagcagaacggtgggaagccctatttgtctgtgattacggggagaggaaaccacagccagggaggagttgctcgcatcaaaccagctgtcattaagtacctcataagccatagcttcaggtgagtgtagatttctgttattaataatggcaactgcccatatagatctttatcagatatttctgtgagtatagatttctgttattgataatagcaatagccctaatatagctaggtaaataaacactaatagcgtactcagaacaatctgttaaaatagttaactaaatttaatcatctgatttcagccacagattcatgcttaaattatgatataactttccctgctggatttatgttgtctggtaaaccagaaataaggaaaaatgtgtttgttgccaataatcatctgataaaactttctatcataaatttaaagttctaaaagaaagtaaatatatttgtttctttgataatatgcaaaataattaggtaatatgtatcatactttaagatttgctattattcttttgaaaggaaatcagtatttgtggattttggatggaattgggtggcttctattgaaatatagttataatttaggtacgtttaaactttagcagaaatgttcagttaatatgaatttatttgtgttttcataagttaaatgccattaatgacctgtgttgacaaacatgaaatgttctttttcattaagtgataattatttaataacagaaaatgacaagaaagtcaaagatgaaatatctgttgatggatagatttcctgcagatgtgtatcattaactcctacccaccaatttcagtgtagcatatttattttatgccatgtaataagatgttatttggctacattatcgaaaatgatagcataagttatgagcataaaacaggtgacatcagggttatttttataaaaggagtagttagaccagaacattatgttgagattaattatctattttagagactagtcttcctttaaattctctccggatagagttgaaagcattgcatggccagattaatcagacttacctgatatatcagagatttcttcttggtgctttcatgatgcaccaaggactttattcttcctacagcatactctttttcataaaggtaaaattcaggcctcacaggttttgacaaatcttaagttatactaagtcaagagcaacctccagctttaagattgtatttgttttgaccgtagataaaaggaacacaaacctagatgttggtcttggatattgacttaataagggtcaatactttggtagtaaatattatattaagcgtaggtacttggaattgattacaaggtatattccttagctaatttgaaattttcatctttaaaataactcttttctcatttctgcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaaaaaaaaaaaagaaaaaaaagagaaaatattttggttataatcataagaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataatgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctccca

SEQ ID NO: 422 - DNA, 4972 bp, Homo sapiens
atttcctagttgtctaactgtgagtcactcttacaagtcatgtgttctaattaggtcctctgtacagcataggtccctagtggtcttaacccatggtatacacaaaaacaatatttgcttctttaaaaagtttttctcattattcaaatatagtcactttttcttatgcgctcttaaccttccattagatgacatctggggttcatatcacaggattgtttctctaagctgatctctgctgcttcccatgccccacattaattttaggttctaatctcagcatcatggcatcaagtgaactactggctgtgaagctggttccaaacctaactaaatcgttgaagtgtttaaatgtttttgctacaaattagagcagattcagttatccttaccatattggtattctctcttcctttcaattcaaatatgcctttgagtgggagaaaagggagggagtctacaaataattcaagaattcttcacagccccagatttctcacaaatatgccagcatgtaagactcagtcatttgatagacattccctgagtgtctgctatgtgttctgctccaagcccctggatagaaccatgaagataatggacaaagtcctgatagacttagtaaacaaggaaataatttcttctgatagaaagtcataagtggcatggagaaaaagtctagaaggaggaacacagagtgagtggtgagaagggttgcagctttaaacggggtggtaggggaaggtctcaatgagcagatgatgccctttgagctaaaagtggataaggaagtatgatgattaattattttttttttttttgagacagagtttcgctcttgttgcccaagctggagtgcaatggcacaatctcggctcaccacaacctccgcctcccagtttcaagtgattctcctgccttagcctcctgagtagctgggattacaggcaggcgccaccacgcccggctaattttgtatttttagtagagacggggtttctccatgttggtcaggctggtctcaaactcccgacctcaggtaatccgcccgcctcagcctcccaaactgctgggattataggcatgagccaccgcatctagcccaattaattttgtttgtcagtctggctaggctatggtgcccagttgttggatcaaacatgaatttaaatgttgctatcaagatattctttagacgtgaataacatttacaatcagtaaattcagtaaatcggatcaccctcctacatctgtaggtaggtctcattcactcagctgaaggatttatgaccaaaggcgaaggtttcctaaagaagcagcaattttgcctcaagactaaaacacagaaaccctgtctgagtttctcacctgccagtccgccctacagatttcagacttaagactgtaacatcaaccctcacctgaatttccagcctgcctacttgtcctatggattctggacttgccagtgcccacagccgtgggagccaattccttgaacgcaatcaatctctctctctctctctccctgccctcccacacacacacacatatatatacacacataacatgtatgtatgcataacatctactttttaatattatatacatatttattatatctacctagatattggtctagatatatgaaaatacagatataatctcctattggctctgtctctctggagaacctgactacagcagggagaaagccatgtaaatgtcagtggaagttcgctgcaggtgaagagtcagggccaagaccctgtggcaaggaaaggcaaggaggccaccatcgccaaagtggattgagcaagggcaagagtttagtggaggataaagtcagaggggtaaaaaagaccagatcacacaggactggggtaacaaagaccagatcacacaggactttgcaggccattttaggaacttttctttttttctcagcaacatagggaatcatcacagatttagtgcagaacatcactggctgttgtgttaatgaggacaggggtagaatccaggagactggctaaaaggacagaacaatgatccagacaagagacaaagatgaatggaccacagtggaaagggaaggatggtaacaactgtcacattctggaaatactgtgaaggtaaagataaaggatttcctgataagttttgcatgaggtatgagaaaaaggagtcaaagatgattccaagttttttggcctgaatatctggaaggattgtactatcaagaactggcctgccctgaccacttgactgaaaactgtaaccacccaccacctctctcctacactcctcatcccactttttctgatctattttctaagtaacaatgatcaccttccataattcaattacacggcatgtttactccttattgtggggctatcgcaaataaaatgtaagctccaccagggcctggcagaaatatttttgtctcattttatcccaatgtatcccaagtagctaagactgcacctggctgtatagttggtgttcaataaatatttggtcaattaatttgtggatagaaaaaatgaggctcgaaagtgttaagtaacgtgcctactattatgtttagaaaatagctatcatgaatttggtcacaggtctttctggccctgtacacattttgttcactacttcctaattacctcttggctgaagtactaaagtcaacatgtctcttgaaacagagattttgccctgtagtttcactgttattatattgtgttgttctgtgaagtgtgggagggggtgttcctgaatgccaactaatagctgtttattaaccactcttctggaatgatcagattgcagaggcagcaggatgttaagagagcgagcccaggctctggaagcaaggccaggatttgaggcctgcctcagccacttatttgttatgtaatcatggtgaaataaataatcttgtctaagcctcaatttcctcttctataaaattgacttcatgatatcatctgcccttacaaggtttgtaggattattgtcagaaaataattcagcaaggtcagtcaattgttattaggcttaaaaatatttcattaagacggcttcactttggtgaacttgaagtggaaagcaattaaacctgctcaatctatgtcaatattttcatcaaaaggtatcctatttttagaggtatattttgctttccaaccccatcagctttacttctttctccatgttttttccactctatcaacatctctgatgaaaccattagggttctctcaaggagaagcctttgtgtgttcatcactaaccctttcttctgactcagcccaggagtttatgaacacaccttcttctcagtcatgaacctgagaatacgtctgagtctcttcttccagtcccataactctctagaaaatcacttaaactttattctaaagcattacatatgacaatgtgcccagtctcaggtacaatctatatacaagtaggtaattttcaaatgctgaacacagatccactgtccctcctgctgctgtcaggcacatctctccaggttctttattagctttaggtctcagaaaagcaatttcttttccagccaggctcaatacaggataggacttggcattaaaatatttttctttctaaaggtttcaatagcctcaagttgcttgctttctactctacaaaatccacattcaaatctctagaatgaaataccacctttctagaaacccagaggacaaaaataaggcatgctatcctttcaatcactgccctctgtgcaaatgtaactctttggcccctaatttatagcacactgtatcttcattcatctagagattcttcctcatgatctaattcctgcttggttcttacaacttactgtcattcttgttacccaattatctacatttttctctattttattatttatttctaatttctcaactttccctctactttttaataaacacttaaacagtgttagcattttaaaaacattatgtattaatatttacaaatacacattttctttgcagaagtaaaaaaataattgttaaaattagtatgggatataacttcttgaatgctggaagagttcattatcttgatctgggaggtggctacacaggatgtatgcgtaaacattcattaaactgtaaaatgaagatgtgtgcagtttattgtatacatgttacgagagagagaaatagagagggagactatccatcaaatattggaagtttttgctaagcagaaaggaaagggagagaatcttatgttcagagcaatcaacagcactataactgcaagtccattgaaaagaactaaaattttcatatcattgaagtaagttaataaattcactaaagaatgatttagacaattgggttccattctctctaaaaaccttaagtactagaaaaaactcatgccttttgtctgaaatttatctctattcacgatacacagtgatcacacaaataaaataagtacaatatgatgaatttcttgtatcaagcacacttcatctgccagattgcatactagatacttaaaataatattttttcatgcatttagtcattcaattaaatgttagtcagaaccactatgtgccaataactttactgtatacttaggaatgtattatatgattttgcggggaggagttttttctccctggttatattttgcttagtaaaacattaaaactcttctagatctggcagtttgagaaactcatgcattgctttaagagaagtctataaaagttatcattaaaattaaacagttcacatattaaggatgagtacgtaaaatgaataatatgcttcatttagataacatgctttcagatatttgggattaagaggtctatgtgtagaggagaaaatgttaaaattatgctggctcttttttttttaacctatacaaaacactttttcagctcacagaaatctaggtaaagaaaggaatgt

SEQ ID NO: 423 - DNA, 5012 bp, Homo sapiens
acaactgaatgactgttagacatcactaaatttaatggggcataaaattctgcggaaacccaggtgcttcggtctatggtactgtgtgtgtgtgtgtgtgtgtgtgtgtgtgtgtgtgtgtgtgtgtgtgacagggtcttactctatcacccaggctggagtgcagtggcaggatcatggctcactgcagcctcaacttcctaggttcaagctatcctctcccctcagccacctgagtagctaggactacaggcatgtgccaccatgtccggctaatatttgtaatttttttagaactagggtctcgctatgttgcccaggctgatcttgaactcctggcctcaagcaatcctcctgcctcaacctactgaagtgctggggttagagatgtgagccattgtgtcaggctcttacacctttgttaaatatttagcggtgctttcctggccacgtaccctctttttccaactgcccatgtacctagtcttctctgccctctggcttctcttctcttaaccccttctttttcacactgttggtcactgccttattcttgagatattttacatcctgggcttgcaagacacctgatttcctgcctacttccaacttctctgactcatactttctcaaactcctaaataaaagtattttctagaattctgtagtcttccttatatctcattttagtgtatctccagcatgacttcaaccacttgcatggtttcacattctttttttttttttttctcttgagacggagtctcgctctgtcgcccaggctggagtgccgtggcgcgatctctgttcactgcaagctccgcctcccgggttcacgccattctcctgcctcagcctcccgcgtagctgggactacaggcacccgccatcatgcccggctaattttttttgtatttttagtagagacggggtttcactgtgttagccaggatggtcttgatctcctgacctcgtgatccgccggactcggcctcccaaagtgctgagattacaggcgcgagccaccgcacccggccggtttcacaatcatttaaaatgattcctagatgtgaatttctatcccagtcttctcagtccaaacccaaatattcagctacttataggacatctttatttggatgtgttctacaagcacttcaaatccgcttgtccaaaattgagctttcttcttccttataaacctgggctttctcttccgtcctaattctcagtgaatcgtattatcacctactaggatcttaggaggcattcttgacctctgcacctcctttctgtctcacattcagtgtgccacaaaaccctatcagttttacattttaaaagagtatttcctggaagagagaacatgatgtgattgaagacaataaaatgggcatgagaatagcatacaggggagaccagcctgacaggagaaaggttttactgaggaatattggaaaagataattgaattattaagtggcagagtaacttggaagataacttaaaggccatatagagtatttcagagcttgtgtggccatagaaaccaccaaacattaggcaaatgaatgaaatgattatttcaggccatatttttaaagtcagttatacaaaaaaaatggatggagagatgagtagaacaactattactttcataactagaaacaaccatttctaagcagattttattgatgacacgaggaaaaaaacttacaagttccagctagaagctcagaaagtctgaccttgaatttcaatttaagtgtgctaataaaaaataaaaataataaattctcattgaagaaggcagatagaaagtatgcattggtgatacagctaggagtaaactgtgttggcaataattgcaggaataatatcatctgattgaaaagtttttataaggccaggtacaggggctcaacgcctgtaatctcagcactttgaaaggccaagccaggaacatcacttgagcccaggagttcgagatcagcctgggcagcgcagcaagaccttgtctctacaaaaaatttaaaagtttgccgggtatggtagtctgtgtctgtagtcctgactacttgggaggctgaggcaggaggatcccttgagcccaggagttgaaagctgcagtgagctatgattatgccactacaatccagcctgggtgacagagcaagatcctgtctttaaacacacacacacacacacgtttgtataagccattccttaactatagatgatctttaaattgaatatatattttaatcacctaattgaactgtgatgatgatttcctaaaacatttggatttccatatgcctcaatgaaaaattaggtttaataaactacactatagtatagcacactatatgtcgcatttatatattgataaacatgataatttcctttttatttgacttagatactaattaacttggagtaaatgcacccaccccaatcatgtgatcagtcaatagttaaataactgagggaaaagaagtacaaatcaggcagctctacatgccatgtttcaaaagggaaggaaacaaaatagttaaactttgcatgttttggaaataaactgtatttatgaaacagagatctcaaaaagtaaaaggaaccccactttatctgatgaaagtgccaggaatctggagaaaagagttcaatttcaactttcagtttggagatgcagaaagaccctgaattttggcacagtaactgagaagcaagtagcagccacagaatgactaaactgagttagcagtaaaaaagtctttaaaaatgatggatttgatagatttaaaaccaaagctttcctcttcctctttgtaattttcctttttcccccctttttttctgattgcaatttcaataataaagctctattgaattccgaattacttacatgaggtccttgaaagcatgactccctctgcagataaccataggtttccatcccgaagcacgagctctgtaccctagtgtggtttgaaataatgagcagagcagctgttttcttggtttagctgccacggagcagtcaccaataggcatctgaattccagactaaatcgtaagccccacctctctgaaaaggaagaaaaaaaatgtggctctgaattcttctcatattcctggacagtagctcgaaagtaggtggtcagtcagcgtctgagtgttacttccctgttttggatttcccattccatccaataattttactttccactagaaaaagttttcttctgagtttcttaaaatctacaaaagtcttttttgtagttcaaaaatctacaaaagtcttttttcacattgttttcacacatacgtaattctaattctaaactttttttttctattcttttcttttttttttttttttttttttttttttttttgagatggagtcttgctcgtgtcttgcttttggtgcttagggactctcacagccagattggtagcaagggatactgaccaatgatctacttatcaaacaactctccatttcactggtaaatgctcatttgaccactggaacagcctagccttatctaccacacaacttcacattccactcaagagaaactatactaaaaggtatcccccacaggcacagaaattcttagttaaccattgtatgtttatagattttgaagtcaaccatggtctgaagtctattttattttatttgaaagagactgggtctcactatgttgctcaggcccatctcgaactcctgggttcaagcaatcctatcacctcggcctcccaaagtgctgggaatacaggtgtgagccaccatgctaaaataactcatttttttcttatatttttctttatttttttttcttcttgagacagtgtcttgctcttgtcgcccaggctggagtgcagtggcacaatctcagctcactacaacctttgcctccagggttcaagcaattctccagcctcagcctcccgagtagctgggattacaggtgtgtgccaccacgcccagctagtttttgtattttttagtagagacagggttttgccatgttggccaggctggtcttgaactgttgacctcaggtgatccacccgccttggcctcccagagtgctgggattacaggcatgagccaccactcctggcccttatatttttcaaatatgttaaaggtatacataaccctcaacaacattttttgttaaatctctgctctttgctctttcttcccatctgtttcctcacatccagtctgctcttttttctctcttaactaaaaactctgttaaaaaaaaaaaaaaaagttgtcttctccgcttcctccgtctttatagagaggcaggagagaacacttctaagtgtgccagggcaggaccttcttttttcaggcagataaaggagtggatccatggatagtattttttagaggtggggtcttgctgtattgtccaggctagacctggactcaagtgatcctcctgcctcagcctcccaagtagctggaactaaaagtgtgcaccacttggccagttttcatggatgattgttatgctttttcacttcctcttggttaatcttgacagacatcccctcctcccaataaaaatatccaggcatggtggctcacacctatagtcccagcactttggaaggccaaggcaggtggatcacttgaggccaggaattcaagaccagcctgggcaacatatttagatacccatctctacaaaaagaatttttttttaattagctggtcttggtggcacatgcttatagtcccagctgctcaggaggctgaactgggaggactgctttgagtccaggagtttgaggctgcaatgaactgtgatcttgccactgctctgcagcctgggccacacggcaagacactgtctcaagaaataaataaacaaaaatatccagtatttaatatactgtccatagactgcctataggacctcacttgagagcttacaaatcagcaatgggagagaaaaagctgtccaatagaaaaaattg

SEQ ID NO: 424 - DNA, 5102 bp, Homo sapiens
ccacctgacgtttctaaagagtgtttttggtttcccgagatttaaacttaaagaaaatcaccgccaggactctggtcgacggcctaccgtgcagtgcggccgctgagtgggggacacgccgcccggaacccaccactggccccagacgctggcaggggtggggggctctgaggtgaccccgggtccttgggtaaaagcgtcccagagacgggaagaaatatggtataagcgagaaggcctcataaatctgggctgttaaaaatctaagttaaaaatatgttttaagtcagaaatgcattctttttccttatgaaacatcgccgaagcagccagttttgtgacaggatcgtaaaatgagcgtgagtttgcgggggtggaggtgcacggggacgcgggtccttgctgggtctcgccgctcctccggaagcggcgcaagactgggtccccaaacacccttcccgtttggcagccaagcccccgccccctgcccaattggctgcagtgttctgggtggattcgaatcgcgaatagtggtgtggcgcggccgaaataaatcaaccctggggacaggccgcgcccgggagccagccctctgtgagggtaagggggacgacttgcccaggaggggccgctcattgggtcgaaacagtccggagagaacagtttcgttcaagattagcaaatcccgaaagaggagacatgcgagggtgaaagaaaaaaaaaaaggaaaggaaggaaaagaaaaaatatatatccccacgaagaaaacaataacttttaagagctgtccgcgtactttggacactagtgggggccttctccccagctcttgggtttctccctagtttggggtgcacctcttccctccaaacttcctaatttgccggccttccagaccagctggggcgcgcccaggaagctccacgcgcgggtctggggctcatgggagtggctttgaaaacatgcttgtcttccccagagcggtccctagcgccaaagatgcattggggaaaaggcacattggagacgtcaggcagcctggttttctgtctgaatcaactgtacgagttaaacagttttatttcgaaattaaccaacataaacaacaacaacaacaacaacattcactacccattccctcgttaggttggaaaaccagtctgaaaaaataaatacaatctgtgaccatgaaaaggagcaatcacttatttttcccatatgttttgaacattatttttaaaaatagattgggaatctggagggtaaaatgccgggtcccttcccgagcccttagagcccgaacgttgtcgaatcggtcaatgtccaccccgctgctcacctctgtcccagcagcgccggggccagcgcgccctcccgccgcgtctgcggagctgcgggaaaagcaggtccccggggggtatcgagtgtccagggatatccacgcagacatccttgtacttgcaaatacaaagaaacacacaggacagagatcaggctcgcgccagggctcgatctcctcggggctcagggttggaggccgtacacagcctggacacaaactgagccaaagagtttatttttagcaaataagatatgagtttttagaaaattgcttcgaatagcaaatccgagaaacattatttcaaaacgttggaatcaaaggaaatcaaatgcccacaacccatttccgtcagtgcttacaaatgagcttctgcaaaacccagtccacttaaacatttggtcggaactcacgaaaagaaccaaaagcaaggcattccgagtcctggcgggggttgagcggccgggcggacgcctggctatctcttctgggagtcgcgcattcgatcgcattcaggttaaaatttaaagcccctggatcctgctccagtcgccagcctctccattccagagttttctaccttcagccttttccaaatgcggccacgctgaaactgggagccgccgcagtgattgggggaggcaaagtggaacgtaataaaagtgactaaattggatgagaacggtttctggaccttctcggtagcaatttaaaattcagaagtgtttagaagcaatttacaacgaagaatgaaaaacgaagaattctcgccaacttcctgaattccttgccccctcccccgcactgccaggccctgtcccgctcccccaggagccacaagttcacaactcacagttacgtgcagaggaaacaacgcttagctacgaggtctcaccatctctggaaaccatactttacaaggcacctctccaccccagttcaactctgcacaggctcctcttccttccctaactgggaaaacacgaaaatagaaacaaaacaaaaaaccagagcctaaacgctttctaggagaccgaccttcagaaaatcatttacttggatttacctgggcggggggtagggggtggggtcggggtaaagtataaaaattcattctcacaaaaacaacgcctcttgtcctaaagtctccctcggcagccttctggggtcacgtctgtcggaagaaatcctttctgtaagcgaaagggagcgagacatatatcacggctcctgcagcggacgagcctgcggccgcgcgagttgccgctgacagatcggcgctgataaccccgcgacgttcatttccagtcccttttgcccgctagggaccgtatcagtttgtacagagttgtgataactgtttggagggagcgaagagggggtgtgtatatgaacgtgggggtggggaagcagcatttagcgctgggtccagggaaggtgacaccccctcttcgcagtgacttatctgtgacttacctgaaactctccagggaaatatcagaaactctccagggacatcaaaagttggagagcgtcctcggacacgactgatgtggaagcccttttccattctgcgtaccccatagactacctttccgtacatgacgacccgagttaaagttcccaaaggtcagctggggaatgttgtcttgaggttcccgaaaccaccacgacctgagccgtagcatcccgagatagggtcggagaaagtttaaggtcggtctcacacaacttcagggcaaaaagcgcatttgctgtgaaggggctaggcgggggttggggggcgggggggcgcagagcacgttcccccttccttctgggggcgtgctgacccaaggtctggagcgcccctcccgccgcggcggcggcgcgggactgtgcactgccaactcctcccgtgccaaggctccctccccctccctcgtgtgggtgtgtgtgtgcgactgcgggagcgggagggtgcaccgccgctggatgggtgcgggtcgctagccaggtcaggcgttctgtggcctccgcccctcccccggggtccctgggctcggtgccccccgggtggactcgcccccactccggggacagggcttgcggctcagcccacgcccgcaggcagcgcggctctcattgtctgcctgggcggcgcgctcccctcccccctcgccgtcccctccccaccctcttttctctcctcccctcgatccctcctcctcctcttcacctccagcgcccagctgctcgctgagcgcagttccgacccacagcctggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggttcggctgcttcctcctcgcgcgatctccccgctttcctcccctccacccctactcgtcgcgggcccctggcctccggctctccggccctctccaggccgcggtcggctccgacggtgtttccctccttccctccgggcgggctgaggcggctcccaggctcccgggacaccgcggaccaacttctagtctctttttctctcctcgaagcgcttatctgcgcgcagccttatctccgagttatctcggcgcaaaggggcgggagccggtagttaggcaggcagagaaacttctttcttgctatctagccaggtctgtgtgtgggcattaattttagtgtggtaatctccgatgagccgaggcgatttggaagagcagcctggaggaggccagcccggctgcatttcacctccctcccccactcgctccgagtctccctgtcattcttcctgctctcccatttggggtcgcctcggctctggggcggtctcacgctcccccctccccagcccgttgcgttccccctccttttctctgctctccgctccaccccgctacgtccgattccggaacggtccggcgtttctgctgctggagatgaccgcggggtgggccgggtggcccggccggcgtgagcgcgcacgctggtggctgcaggcgcgggccgtgtctaaggtgtgcggcgccgcggggacgccggtggggctggcgattcccgccccacaagctctccgcattgcctctgctgggaaggacccagactgctgcccccgccctggcgtcccactttccctgggccgagttgcatttctctctggggctcgcgttcgggctggtcagcgcagtccgggaagctctgggagagccaatataggagaacgcggcggtttcgttttcggggacaggttgccttccttacgcgaagggttttcccgtggggaaccctcaccccgaggcatttcgggagaggggcatccgcagagaggcgggatgcggcggtgccgacacgcacagctacttaaattcttttgtgtgtcatcagcccgggggagacactttagggcggaaggaaagcctcagccagcttctgcagatcacccctgggatctggcgcgcgcacggagaaaggatgcggccgagggggtgggcggggaggacgcggggaccggagcggtgcctttgagggagggctggtatcccagcccttccagggccctgtggcggctgcgcaggctcccttcccctcccttattgatctccacgcccggggc

SEQ ID NO: 425 - DNA, 5174 bp, Homo sapiens
tcggtttgcttcatgagtccttgtgtcgaatactattctgggcaatgattattcattaatacaaataaacattagattataggaagagtaagcttcccatgataaccgaagttattatcagatcctaaaagcaataattaaaaaccctgttcccaggtagaattgtaaagtggatgactcctgcatccagcattctcccattcatttttagagccatccaactccctcagtcacttcactgccattccctttcccaagccccggctgccgtctagatagtcagagcttcttggcccattgcaagcactcatcatgatgtttagccaccaacccagcattgtttggcatctttctaaatttcttggttttcactcaaacctcccataatccaaatgatgactgctatagaattccatcagaagacttatgaagacaagtgatttgacagcaaagagtcagaattcttaggttacagtggcaaaatcctgtaggctccatgtctgtcatatattgctatttgttcagtcttactttgatctactcactaaacaattcatcctctatagaactgagggtgcaaaggtggttggtagtgggttaaagaggaaagtcaaatcagaaatgaagaagaggttgaagagaccacatgtagattaaaaataaacttttttggggcattgattttcatttagtcacaatatttttattttcaaataacattaaagaaaaacaaacagtctttatgttttttaaaggagaagcagagaaatattacactattcctagtcaaaagtaatgttagcaggaatgtctagactatttctatgtgtttatttctctttattttagttaaatgatagatttactcacttgcaactaactcttgctatatttctcccatttcaaaattcttaaactattgtagctaaaaattgtatctattttacttagctgcctttggtagcatttgaaagtgaatgcaaaatttctggacaaaatagaaacaggtacatgggctaatataggaatatacacaatactgttaactgtcccaagatttttcattgattatgtcttccatggtgagatttcaggcataaaattggtttgggttagtacaaagtctggcccaacatatgcttacttgtagttcttcctaataagtcaaacaagctcacatttatggtgctgaatatattctagattcattgtatctgtagttgctaaaaatttagttccatgccttaggatggtattagaatgtccatgataagaaaaataagtgcagcaaaataaaagaaatgccacgcctatctttctgtattattttttccactggagaaggacagattttactcattaaaactacaaaagtctgagaccaactgctccatattcttttgtgttcgttaaatgttgttatttggaggtgacttaattagactaaagctagaagagaaaacaatagaatgtcaaagatgcttttcaagttgtaaactaatgttttaagttataaactacttgatactattttcttaattaaaaagatatttctgaatcgaaaagatcaaagcttctgagtaaatttagaaagcatttttttgtcatttacagaaaagggctttaagagcctatgttcctttggctttaagagctcttcactgtgacttcaaagtaatcattttcagattaataaactggagctcgtctttggaattatcagtttttcttttattacagaatctgaggttagccagaatccatctgcagaacatgaggcagaagggagaaacacctaacaaggtgaggccttccttaactattttaacacaagcaattaaccatttatactcacttaaaagcagacagctgggatgatggtgtctgctaaaaaaaaaaagtgtaatgaaatgttctttagttttttgatctttagtaaaatttcatcttcgtataaaattttattaaccattccactaacttgttacttctccactccacctccccactccctttagaatccttagtttgaagacataattctttaaatgatctgtctcagggaggggggatcttgttacttttaaggactgcaaatagcattataaactttgtttttatttttaaatacgaatatcgactgaagctctcaaatcaatcaatattgttgccaaattttgtaaaacgcactgtcttagctctctaacgatagagttctaatataaatgtaaaaaccaacctatcaacatgttttcaaaaatactttttgtaaagaacagtacaattttgtggtgtccaaatattcctttctttcttacaaaatattattggatctgtccagttcataaatattcctgccctctcttcctccctccctgcctctctctccctgcagtttttttgatgtttgttcttttctttccattttctagttattaattggttcaatggatgacctttgtgcgacactgttataccttatcagcctcgccagggcccccgcgccgcccaatcccagcaactctggttctcctgtgaccccaagccttccagatccctgggtttccccccacgggactgtcacattcttccccgccggagacgccagtcgcggggcctcctccctggggtgtgagcaggtcggcgcgccacacttctctaggtggccggacgcgcgcccagggaggagctggcggcggggcccaggctgttccggctgcggcacgccaggggatgtggttagccctgagcctggaggccgaaggtgggcaggcaacactcccaccatgtttcggaggagaatacactaggctagcctaacgacactcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggtctggaaagtcctggggaactcgcagggcacgggccgctgtcgcggttgggaggcgagggcgcagcgctggggttgtagattccaagacccctgagggtggctgtgttggtttctcgcaggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcaggtagagtatggggtgtggtctgcctatacagaatggcagcccacctgctttcatacccttttttttttctttaggataattcgtaactaatattttgggtgagtgaagtgtgcatgttaagagtacaaaatagttttatgattctatgctggtttaacaactgtctcctcccttcaggcacgtagtttcagaaaacttttatgaaatctctgcttcctaccattttgagacagggacagttttactgctattggttccttcagtgagtgcaagaacacacagagaacttggtcacttctaaattttatcagctctgacaaaatggtgaataggaaagttatctgacttcattgtgacacgtctacctacctctaattgtactttatcagggatgactacatttgcagaagagatatgtttaaaggaaggtacctgaattcctttcttcatgtctgctcttattttatactgtctgcaagctaggacttgcctagcaaggttgcgctcccacctgtgagccagaacgtgggctcttggcagactctaggagcctttctgtttcttcttcttatccttccatgcatccttttctttttttgactaagttctacccttcctcctccccctgccttggagttaggacatcttaggctacacgtattttcactgaactgtaaagaaaagcctggggtttagtggctaattagtaaagaagctaggaagatgggttgcttaatgaaatagaagtgaaatatgaaaaatgatacttatttggtgtaatctaaatggtttatgcagagtcttcttcaatggggaaggaaggtgcggaaagaggaagatccattgcaaggaccataatgaaaatatttaagtattttagattaatagatacataccaataccttgtataaagtttttaaactcacagaacaatatggaaaaatatatttataccctggtgatctctaaggtatagaacttttcaaataacctttatgatataatatttgtatatcaaaccaaagtgagttaggcagtatatggaaaatgggctagcccttcaaggctat

SEQ ID NO: 426 - DNA, 5364 bp, Homo sapiens
aaaaggaatgactggtcattgaataattccatttcacccttgattttagaaggaaagtgccaggaagggtagcaatgagatgaaaaaaaaagtattcctaggtttttcttttcactgattgaaaagaaagtgtcccgtgccttccctttctcatcatcctacaatagggtgacttagggtatcttcccatcaaaatcagtaattcctcacatatctcttccccctgtatttcactcttgtgaaacagattttcagttttacagatgagaacaattaagctttgaaatggtaacaccatttgctatatttgtgcagtggcaattttttagctcagaatttatcaaaagcatgacacttaatgatacagaattaaaaccagctatcccagaccattgaaggagaccggggtcggggagggagaggcggtgcaaacggtgttgcttttgtctttctgacctgcttctctcgtgatgtgttctgcaactggtaagaacattggatgaattataagattttaatcagtagaataaagtcagggcggtcctttcattttaagcagcagctcaaacatttgatgaggaaattagaatccttagaataagagtttagtgtgtaaacatcaagaattcatccagaaatgagtatattagagtctgtgaaatgccttcgcctcacactgccccttcccctgttttcttcttcttttctgtgataagatgatcatggatttgttttgtttttcttttgagacggagtctcactctgtcacccagcctggagagcagtggcgctatctgggctcactgcaacctccgcctcctgggttcaagcgatcctcctgcctcagcctcccgaatagctgggattacaggcatgcaccaccacacccggctaatttttgtatttttagtagagatggggtttctccatgttggccaggctggtctcgaactcctgacctcaggtgagctgcctgcctcggcctcccaaagtgctgggattacaggtgtgagccaccgtgcctggccaagattatcatgttttaagtgttacaggacacttgaatgatggacgatgtcattggaacagcctatgttattaatgatgccggcagcctcccctcccacctttccctgccttcacactctgtgcccccttcagtgctttgaccccttactcctcgcacttgaccatgaattgcattttgtatttaaagacctccctgcacaatatcctcttatctacgtaagcagcccatagcctcagcgccctgcaccctggttggagttcaccttctgatttggtggtatatttctaaaaccagtttgatttttcctgttgcactggggcttgtgtttttcttccagtgccctgtacatagcatgccttgactggtctccacatcgttcttcatcagactggtttggattttacaaggtgttagagtttttaaattagctcatgaggtctctcgcacctgagtttatgccagagaagttgtggagtgatgaacttaatgggtgcccttatccccaaagatgcccagctttgttcctgcttaagctgaatgttggtggataacacatcattctttgtaaatcgtgattgcagaatcctgctattttatggctttgtttttccttttgtcgtataaatgattgggtagctcgttaacttcactctgttatagtaagggactgctacagaggacactgagcaggaggagagaaggaatgattaggcctcagaaagaacgaggggttgtttaagagaaaacgaagtaagcctagcagatctgatcgtacaatcattttccccttattgttcctttttccactccagagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtaggaccatccgccgtccctgccatttgcccagtgtgcgaggttctggatcaagtttcaggaggaagaaaatgaggcctccaatgtattaaaataagacgttgccagggagaaaaggaggcaagatgaaattcatttgaaagtcctgaaaattgtcatggttgcatacactaagtggtaaactaagaccttcagattgtaagagatctgatttgcttttggtgggaaaaatcagctttgcattgtttgacagaatcgtagccatttaaagaaaagacacaaaggcacaaaatatcgaggcaggggcaggagaccgagggaggccacagcacaaggtacagaaatgagacgtaatgaggcctcataatttccctgtgacactttcgagtttttgcctcctcttcagagaaatcctgacttctgctttgaagcagcccactgaggggattgtgaggaacgctgcagtcttgcctttctagccaacaagtgcgatttcgaattgttacaaatgctcaggaagagatgtaggatcgtgcttacaagctgttgctcagctacacttgggatcactttatttttaaatgtcatttctaaattctttctcccttccgaggaaagcgtttgggtgaagtaacttacggtttactcatcattggtgaataagccagggctcatacaaacatgtagtgaaagaaagacgtggcggtttaattttttatttttatcaaaagtaggagtggtgcacacgacctcactggtcctttacagacttatcgtgactccggccctgggcttcatttggccgccgttgctagtcttgctgaagctccggagcaactactaaactgtggggatttagattttacttgttcagttcgcagactgccagtcccctgggtacccaaacacggtcatggctgggtttctgggcctcagaaggcctctgtctctctggagtctccccttgcaccctctaccctctcttcttttcacctttcccagtttctcccgtgtccttccatgctctcccaccctcaatctcaccacctcgttgggaaggtattaacttcatgtggtacttttcccaagaagagtttaaattttaagattacatggaataggtcaggcactgtggctcacacctgtaatcccagagctttgggaggccacagcaagagaagcacttgaggctaggagttcaagaccagcctgggtaacatagcaagaccctgtctctacaaaaaatttaaaagtcagctgggcacagtggcagatgcctgtagtcccagctactcaggaggctaaggagggaggatcacttgagcccaggagttagaggctgcagtgagcaatgatcgtgccactgcactctagcctgggccacagagtgtctctattttttgaaaacttacattgaacagagcagtgcctcctctgaggggaagcatccagtcctggagctttccttggtggtgggcagggcagacagttttcagctgagggctttcccaggcccagcagcaaagtaagacccaaggaggcagggaagtggcctgggctgtctacagggcctgccccagcatcactggacatggaagcaggtggaaaaaacagtgtggaccaggactcctgtccaggagaggactcagtgggtgggagcccccgaggaggggccgtggtacgccacaggggcacacgggtgtgatcgtggatggttgattcgctgccttctaaggagggtgggtccaagtaactgctgggatcttctattcttttttacattttttatttttaattgtggtaagatacaggtaacataaaatgtaccatctgaactgcttttaagtgtacatgggctcttgttttgcaaagagggatttggaacttcagtgccggagctgaactgctctggacacagtgaaatcaagctgtcagtgcagtgaccttcccctcctgtactctaagccagttctcttctgaataagtgtgagcaaatgtttaagtggtatctccttgaaaaggtgccagatgatcagccagcctggggtgctcatgtaccccaataccgccctgtccagggcacctcaaaatgaagcacatcagaaaccgtcctcctgcacctacagtactggccttgtctgtggttcctacaagggttgatgtggatgcatcttcaggtggctccgacctctccccctctatccctaatgacctccctggaattctgagacaaggacatcagggtgccaaggccagggaccaaaacagcagaaagagtgtcccagccagcaggatgacccagcactgacacaaaaatagtttagagggcaaaggacactggtccaatcttgatttcatgatgtaccatatgtagtgaccacagataaggggccttacaatgaggagttatgcttgttagtaaactaaagtttgcatttcacacttttttaaaaaaattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttctggggcatgggtaacagtgagggggaggaagtgacagttggagagaatgtgtaccatgattggaacaagaagttggctgggcgcggtggctcacgcctgtaatccaagcactttgggaggccgaggcgggcggatcacgaggtcaggggttcgagaccagcctgaccaacatggtgaaaccccgtctctactaaaaatacaaaaattagccaagcttggcggcacgtacctgtaatcccagctactcaggaggctgaggcaggagaatcgcttgaacctgggaggcagaggttgcagtgagcagagatcgcgccactgtactccagccttgacgacagagcgagactccatctcaataaaaaagaaaaagaaaaagaaaaacgagaagttgccaagaccctgcctcttcctgcacagagcatctggttcttccatttcagcaggctcttactctgccctaccatatggtgccaaactgcctgacctcagcgaaggcccatcctcccagactcctgctctctccacctccacggatatctcaccatcattaggaacagcagttctttatacccatgtggaaaaatttccatcaatttatctgttgcataatttatattttaatatcaccaagaaatacagtggagtttaatatagaacataaataattggcgctatatataaatcggcaggtttga

SEQ ID NO: 427 - DNA, 5394 bp, Homo sapiens
aaatgtctgaattgatggaaaatagtaaatcaagcccacttaatccagatgatcctcagggaccttgtaagacaaagcatggcaatgaagacacatggtcctttttgtgcctaacttgcagtgtgtaaagaggctttttttttttttttaagacagagtcttgctctgtcaccgggatggagtacagtggtgcaatctcagctcactgcaacctccgcctcccagtttcaagcgattcccctgcatcagcctcccgaatagctgaggctacaggcgcatgccaccacagccagctagttttttgtattttagtagacatggggtttcaccatgttggccaggatagtctcgatctcctgacctcgtgatccaccagcctcggcctcccaaagtgctgggattacaggcatgagccaccgcgctcagccgtaaagaggctttttaaagacaatttttctctctttcctttttttttttttttttcctctgagacagtgtcttactctgccatccaggctggtgtacagtgatgtgattacagctcactgcagtcttttttttttttttgcataaacattctgatttaataaatggtatgaatatatattttgcatactttacaataaagaaaattttgaaagaaaattgatctaaaactgtttccctccaatttccatggtaaagtcaactgcatacagttctttccatgtataagttttacatttgtattttctacaattaaataaatctaaatgttaaattttagcacatatatccaattatgtacaaaattacaatgtcaatttataagtcaagcttacttaaaaatcataaattacaaaaaacacattatgaataattttgttctggaagtatcataccaactcatacgatctaggtgaacccaaaagtaaaaaacaatgattataaattacagtagtgtctgtaaaaccctgttataaaggaggtattcttttaaaatatgtaccttatatataaaagctcctgactccttttaaggaccaaaattattttcagtttaaccattttcattaaaatgcttatttaaaagtatcgccttataaaactgagtatataaaatacaatgcagcccttgataactaagaatctttataaatgctaattatttagtgacctgtttatcaaactatttctgtggatggggtgattttttttcttcctctaaattaagtggccctagactaatatatttatatagttattctgttttcttccgtactgtcatttcacatctctatcagtgagttcctcaggatttgcctttattttacaactatgaaagtcttcaatccaattccctgcttccacacataggacacagaaagcctaaactttccttttttctgggctccaatgggaagcagcatttacaacgtgtctggcttggtaggaggaagattgtcaattgaggtatcatgtgtgttcacctgcctatcttgccctatttctttggttgctgtaaatttcctgcttctcaaatatctggatttttggctacctatttggcttccgtctttggtgtttatatctgtctggttttagcaggtctctctgattcctgactcacagctcctctccttcactaatattcaagtgtgctgcttgcctaactcctcattccttctccttgaatttcactttacaattgcactaggttctatcatcgttggccacagattaccacaaaacataatttcttaaattctgcacatttctaatgcttctaatcttggtttcctacaagatctaacactaagcttgtgttatcctgattacagtgtatgtaaaacaatgcttgtggaaaactaacctaggagaaagcttataggggaaacctgataatgaattttattaaattaataacccttataaaaatttcaaatgtaatactacctggatttgaacttcaatacttttcttaagtaaaattcttaaccacggtagaagttatgtttgttgatgttcactcatctataccctccatattctcagcaaagttggcataaatctgacctgaataaatagggttataacattatcaggcttgtaaaatactttatcaaatcaatgcatcagttaaagcaggggtccccaaccctgggctgtgtgtggcctgttaggaatcgggccacacaataggtgagctgagaggcaggtgagtgagcattctgcctgagctccgcctcttgtcagatcagtagtagcattagattctcataggagtgcaaaccccattgggaactgcacatgcaagggatcaggctcactgcagtcttgacctccccgagttcaggccaggtgatcctcccacatcagccttctgaatagctgagacgagatgataggcgtgtgccaccacgcgcagctaatttttgtattttttgtagagacaggtctcgccatgttgtccaggctggtctcgaactcctgagctcaagtggtccacctgtttaggcctcccaaagtgctgggattacaggcatgagccactgcgcccagccaacaggattttcttaagagggttctaaatgcaaacatcagccttgagattagaaacggggcaaaagaggtaacacacctaattattgtgtgcattaggtactatccattttaataaaaataagataacacctggagtcactatataatggaattggggctccattggttgacagctcttctgtgttcctctctatgtgcctagaactgtgccagattgtaggacagaagacactttacaaaggattccctcagggtcagcccagtgcagtggaaggagcctgccctttggggcttaagagaagcagtttcacatcctgattctaggacttttcatagcacagaaaagtctcatgatgtctctcagcccaatattggtttttaaattgagatgataatattttccttgaaagttaaaaaggagattaaattaggaagtatgtgtaacagcacagcatggtaactgaaacagtgggtactaaacgaattggatctttttccgaaacacaagtgtacaaagctgaacaggtaataaatatgctttaccatcattgtttataatgatgaaaatttttccaatacctaaatgacggataacaggggattggccacagaagtgatgtacatgcatagcatggaatatggcagcagccactggcaatcatgacattcactgacttgaacgaacattcacaccttattttattaaaaaaagagagcaaaatctattagcccggcgtggtggtgggtgcctgtagtcccagctactcgggagggtgaggcaggagaatggcgtgtacccaggagatggagcttgcagtgagctgagatcgcgtcactgcactccagcctgggcaacagagtgagactccatcaaaataaaaaaaaaaagcaaaatctgtgaatccttcaatcacatttgtgaaaggataaacaccagtagttccttagtggagatttcaagcccttctctccctacttcaccttcccctgccagtgagagtgcctctgattgcaggtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtaaggacctctctggataatccatctccctctgcttggggctggactcacggggctgtgcagccaggcgatcactgtgaatgatgcaaatgcagcctcttagagacctgctggctgagagtcaggacctctgagctccaatgccagatctgcttctaatccacagagggtctttggacagttcccttccccccaggcctctccatgtgcagaggagggggtggatggaggagctctgaggatccttcccctctaaaacctatcctgaaaatggctcctgaagttctgggggtcatcaggagaatctgggccaacccaggacaatgacaggtcctgcaaccccccaaagagtactcaggcaagggacgctcagggtccgtggacctgtgtaagagctcaaggacatttgtgtgtaagatctgggcacagcctccatcccttgccccttcacagtctttcacatttgttgccccaaaacactcaactaataagtggcagaaccgggatttgaaccccagctgtccctttctagagtctctgcctgtgatgcctactcagggcccctggcctgcgtgactgaatggttgggggcccttgatgagagagggatggtggcaggagtagaggctttgcggagggaaatccagagtttggcgtggcatgtgatgtctgaggtgccccattagaggcccaggtggagataaggcatggagtttaggctgaagtacagctggagatggaagtttccaggctgcagttgggaatagtacacagtgaccccagggcacgcatatggccatggcctccctaagtctcccctcagcttctgccacagccctccctgtgcaaaggtgtagctcagggaggacccagactgcaaaatagtccccagtctggcccctggagctctgaccctaggaagcgaggcacaaaccttcttccttgccccaaatcagaacaaatgtcctcacttggaagctctctcaaaaggacctcatgggcccattctcaggacaagcccagacaagtcgaacaccaagaagtggtcacagcccagaaaatggagtccctggggatacaaccaacggcttctctgggagaggattctgagccagccagctgggagagaagagaggagatgccaggccttaggggaggcaggagagaggggagagggagaggagttccaggcccttgggagggagaaagtgccagcctggcttgccgtgaacgctcaacaaaagctgcttgctttgcaggtggaaaaggccaaggttgaagttggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgcccct

SEQ ID NO: 428 - DNA, 5525 bp, Homo sapiens
aattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgcaaggtggatgcactctataagaggaaactgaggcacatggcttatgagcgggaaaggcaagaggcaaggccaggcaggcagctccagagcgcatgccgtcaaccaccctgacagctgtgtctgccttctgcacataccttgttagatttagaccttagtggggtttttttttttttttttttggtgctattgtaaatgttattgtttttcttattacaaaatccagttgttcaattggtacataggacagcaatggacttttgtatactgaccttgtatcctgagacttagctaaacctgcatgtaaatgctttgggatttttctaaacaatcatatcatctgcaaataaaggcagttttatgtctccctttccaatctgcgtgccatttgtttctttttcatgccgtttagcactagctagaacttccagtacattttttttttgtttttgtttttgtttttgtttttgagatggagtcttgctctgtcacccaggcctggggtgcaatggcatgatctcggctcactgcaacctctgcctcctgggttcaagtgattctcctgtctcagcctcctgagtaactgggattatagacacctgtcaccatgcctggctaatttttttgtatttttagtagagacggagtttcaacatgtttgccaggcctgccttgaactcctgacctcaggtgatccacccgcctcggcctcccaaagtgctgggattacagtccagtacagttttaaataggacagatgagaaaggacatccttgccttgttcatgattttacggggggaatgttcaggtctttcaccattaagtatgatgtcagctgttggttttttatacatatcctttgctaggtaaaagaggttcccttctcttcctagtttgttgagagttaccacctataaaaactatcttgattgtggaattttgtgtaatgctttttcttcatctgttgatttgatcatatggtttttcttgttcagttagttaatgtgacgaattacatcagtttacaaatgttgaaccagccttgtgttcctgggatgaacctcacttgatcatgatgtattatacttttataggttaatagattgtgtattcatgagaaattggcatgtagatttcctgtaatgtttatgtctagttttggtatcaggataatgttgggatcctggaatgagttgggaattattctctcctcttccattttttgaagagattgtgtagaattggtattatttcttccttaagtatttgatagaattcacaagtgaaatcatctgggtctggtatcttttggagggtcttaactactaattcaaacaaatgtcatgcactataagattgttactaatgcagcatactctgtcttctgaaatgtataacatcttttcacaaattctcaaatatgttaacaatgtactaaatatttttagttcagttatgaagttcaagcatgtaagattgtctgctcaaaactgaatattgattggacttcggagtcctctctgagattaaagacacaccctttccataatacagaggaaagtgtgcagtgtgccatctctcttgtgtttgtaggtatcccttcttttcccagagctcatctatgtccaaattgcatgcccaattcttcatcagttcctttctgtaagtcatgttagcaacactccttggtacggattttaggttgccaggcctcagtctgtgtgcagtcatgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgcatgctcattacaagcttacttgcaaaatgaacaaaaataaatcagtcagtaaaaaccagcaaattagcaaaagtaaaataaaaataagccaaaaaatcaccaaactgtattaaataacaaacaaacaaaaaaacacattaagtagtaacaatgctggtaaaataaatggttgcatttgaaattggttcaaggcttttgtgataatcccactcagtaatttatcttgagggactagttcgacagaaggaaacaatactgcacaaagatgctgattgcagagtctgtggtggtcacgaggtgagcgtacactggatgccatgtcccttgtggacagcagtttccctggtgagtgcacattcactagaatggcagcccgcacagtggcacagcagcacggggacccgggtgtgaaatgctcagcccacgtaatggcacagcccacgtaatagcgcgtgcagtgtgctgggagtctggggaattagaggtggattcaaatgtaatttagaaacttggaaatcattttaatagtgaaattatgggtgatttttgctttttaaaacttgtttaaatgctgtcatatggttaaaagataaaagcagtgggaggtcatgttttccgtttttggaaagggacagtatctcctgaataagtgggaggaaaagtcctttaactcatcgctttcagcaccacctgtgctggccttcacgttctgtctgtgtaagtggagggtttccaggcagtgtaagccctaacctggactgaagtccttgaggggaaggggtctgtgatgtcctgccttgtgatctgtcccccattcccttcccctgcaggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaacgtgcgtgcgcactcagccttttggggaaaaatgggagttctaggtaacaatgttaacacctggaacttgattcacttttagctctcaccatcccttatttgatttattgtagcaaaaggaaagcctgtgagaatgcaagggagcccctggctgctttgctggagtccctgggaggtgccccacacctctgccaccaaagtctgtgtgctcctgagcagctcgcggctttcacagtagggaaaccgcagtcctcgtcacctgcgcctttgtcctcccattcgtttaccctcccgttcacatccacacaggcttgtaccccacagaacttgacaggaggtcacatgtgtgaatggcctgtgtctgctttacagggttgagcaggctgagggtgtgtgcctctggggatgctgggctgacagcaaatcccaacagtatttcggctctggactgatttggcctttagtgcttccccaggcctctttcatcggcatgggaaaagcccttaggggtgggcggtgagggcacatttataactaacaaagaagaatgcagttgccccagcatcctactggtcaccttaagtggcagcagagccctccccagcggtgccccagtccctcagaagtgctcagtccggcccgagtgcccatctggtggctctgccgtgttcttctgggcggatctgtgtgcactacacagcgagtgagggcgtggctcacacagttgtttgagggaaatgggtaatgcccatcccttgctgttttaagtgccaaatagcgtgttagcgcccctccaacaaaggatcatccttccagtgagtcaccgagaatgacagtgactgccattactattcaaagtacatctctgattgctgatctgagccactggttcagagccaggttctagaggctgcaggtccagccccttaccattcctggagaggtaggagctcagtcccttcctccaagccagacctttgcagaggtggcaactgggctgcacgggtcagcagatccctgattctcaagccaccttgagacaagaactccgcccccctgttagtgcatcccagctgcagctctgcatcagaacctacagtggacccttttgaaaacactcttggctgccctagttggttaacttcagaatgtctggaatgggaccagagatgcagttcacatgttttgtaagttctttaggcgactgaagcacagctgcttggagaaccactgaggggtggacaccttcccctggcagccacaaggcaggcagcctgcgggagctcctgagcagctgttgggcgatggtcattacatcacccatgcctttgtattta

SEQ ID NO: 429 - DNA, 5564 bp, Homo sapiens
ccaacccctgtttaaacactaggtgtcttctgtagtttttttgattatcgtcatagtctttgcatcaagatacatagcaatgatggcaggtttccatttggggcaaattgtgagaccctgcctctagaaaagaagaaaataatacacttctactgttcttgattatcagctttaaacactagtacactttaaaaaaaaaataaacatttaggctgggtgcagtggctcacacctataatctgagcactttgagatgccaagacaggaggattagttgagcccaggagttcaagaccagcctgggcaacataatgagactccatctctacaaaaaatttaaaaattagccaagtacagtagcatgtgcctatagtcccagctacttgggaggctgaggtgggaggatcgattgaatcgaggaggttgagactgtagtgagctgtgattatatcactgtgcccggcctatttttatttttatttcttatttatattttgagacggagtctcactctgtcgcccaggctggaatgcagtggcgcaatcttggctcactgaagcctctccctccccagttcaagcaattctcctacctcagcctcccgagtacctgggactataggcacgcaccgccatgcccggctaattttttgtattttttagtagcgacgaggtttcaccgtgtcagccaggctggtctcgaactcctgacctcgagtgatctgccagtctcggcctcgcaaagtgctgggattacaggcatgaggcaccgcacctggcctacaatacatgtttttacaatatttagtatgtttgtaacattcatatatgctaatcatatataccatattactcatgaaatatacaatataatttatattaaatatgcttacatatttgtataaaattattatatagcatatgttctattgtatgcatagttcagattgctgcattttatgtggtacaaaatataaaatatatgtaaatacaaaatgtataagaagtatagacataatattttctttatagtggctctcctgttatgtatataggtcagaatcctacatttgaaatgtttgtatcataagagattgtccatgtagttaataagattaaattattaagtgcttatcatgtagtaagtgccatataaatggtagctattattactattagttattatcactaaaagactattgaatgttccgtgtcagatgtcactctctgtgctttaggtgcactgtttcattgaatggttgtgttagtcctaggtgtaggtattttattatttttttgagacagaatctcgctgtcacctaggctggagtgcagtggcgtgatctcagctcattgcagcctccgccccccacctcccccaccataggttcaagcaattcctctgcctcagccgccctagtagctgtgattacaggcgtgcactaccaagcccagctaatttttatatttctagtagagacggggtttcgccctgttggccaggctggctcgaactcctgacctcaagtgatccactcgcttctgcctcccaaagtgctaagattacaggcttgagccactgcgcccggccctggtgtaggtatttttgttgttcccattttcctgatgaaccaaccgaggcctagaaaaattaaggccccacgtttgtggcatgagttcactatggagtgccctgtgcatgtaggaaatcgaatccttctccatttcttgggggttttacttctttctggaatccttgcatttattcttacgatgtccggtcggttttctgagcattttttgcagctctggaggtgagtggggcgcgtgcgttggctctcgcagctctgcagctcacgcaagggcgtttctacccttcttcccacagaaggacttactcctcagtgatattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgagcctcgcccgcagcggcctcgctgcctgggccacgcgtgggtccacctcatcggggacggccccttcgcagaggcctggtgcacaaaccagggttgtgcttgcttgcaagccgcagaacctcctagagctcccatcagccaaagggcggtgtagggatggatagtgcggagcccgaggacgggtattgcagggcctcagggcgcaggaccaaacccgtggatgttaactgaactcgatgaactctctgtgaatcggctttattcccccttctctataggccccttcccctttcctctgtgttctctggagggaacggctctgcccgcagtttataacagagagatgagcctccaccctgagtcccaccacagagggagaacctgattggctgaacttgggtcagttgtttaccgcttggccaatcaggcatggtggggcggtccagcatgcaaaccgggctgcccagggctccatccctggatggtgtcggcgccaggtcccaaagaaagggagtgtgctcagcccatgcactaggcggacgtcctagaaagcagccactacacggggtaagagatttttttggacatgagaagtagccgtggcttccatggtaaaaggtaatcaagagactactgcttgatcttttttttttttctttttgagacagagtctccttctgtcgcccaggctggagtgcagtggtgctatctccaaccttcgcctcccgggttcaagtaattctcttgcctcagcctcccgagtatcttgaattacaggcatcagccgctctgtccggccttgcttggtctttctaaggacaaactctccactgcctgggaggacccttagaaatcatctagcagagtgattttcaagtggtgttgggcacagaggggctccttgagaatactcaggaattgctgttggcagcaagaggggttgggggaggtgcaggcccccacctgtgactcggaccagacacccacttttgacttctctcagttactgtattgggttctctggaaagggtttggtagctggaaaaaatcttcaataaccactgctgtagcccaagcctcccattttacagaagggcaagtgaagggccacagacgagaagatgaggccacagaacttgtttttgtcagagctctctggactcccagttcagccttatgtccatcgtcttgcgctgtcacgtggcaggagctggaggcttcagtctttgttctcagcctttgctagcacaggtgtcccccaagtgtccatgtgccccgatgttcagtcattcattccgcagttgtacactggggccaggggacacatctgttcgggaacaaggcagacccaggtccacgctcctggaactcatggacattgcatagtaattgtctttgtggtgagcgccaggacagtgtatgatgaggaccccaccctgttgaccttcctgaggaaggggggtttaagcacacgaagagcaatccaggcagaaggaacaccctgcaaatggcctgagctgagagagagctcagcacgttcaagggcctggaagaaggtccgaagggctagaacacaacacatggggcacagtggcttgtgttgggtgtgtcgaggaaggagttgtccaatgatagaaggctttgtaggcacagtaaggatttttgcagagccactaaggtttttttttttttttttttttttttaacagaatctcactctttcacccaggctacagtgtagtggtgcaatctcggctcactgcaacctccactttccaggttcaagcaattctcctgcctcagcctcccgagtagctgagattgcaggtgtgtgccaccacacccagctaatttttgtatttttagtagagatggggtttcactatgttggccaagctggtctcgaactcctgacctcaggtgatccacctgccttggcctctcaaagtgctgggattatgggcctgagccactgtgcccagcctcactaaggtttttaagcagaggtaggacataatcagttttatattctaaaaagttctgtctccttcaaccaattattctttcagtaagactttcattcttttattcattccattattttgttcagtgtgtcacttaaggtgcaggtgaaactgctataacaaggagactgcaaaatgcagtggtttaaataagatagatgtttattctctttagtgtaacagtttgaatttacgcagtccagtgttaatgtggcagtgccacagtattggggacccaggctccttctatgttgtttgtttgctatccttaccatgtggcttccatgtcagggtctaagatggctgctgttgctcaggccatcacacctgcaatccagccagtgaaagagggttaaaaggaaaaggtggacacactccctttcttttaaagatataacctggaaatgcatcactttttctcacataatagagagcagaacttagctacatggccacgcctagctccaaggaaatgcggtctttagattggcaaatatttattgggcatctactgtgaagatttatctcaagaagtaacatgtgacctgggccttgaaggatgagacgtttgccacgtaaaataaaggggatagggcactttaggtgtaagaagaggtaggagatggccttagctcttagtacatcacaaccaagctgggaagatgaaagaacagctgggtcagggactggaagataataagcaggcctgggtttgatggtcacctttgccatttactgtactggctgggtggctttaggcagggaacttaacttttctgatcttttaattttttatttataaaaattcatgcattgtgtatgaaatggatacattagtggccgggtgcggtggctcacgcctgtaatctcagcactttgggaggccgaggcgggcggatcacgaggtcaggagatcgagaccatcttggctaacatggtgaaaccctgtctctactaaaaatacaaaaaattagccaggcgcggtggcgggcacctgttgtcccagctactcagaaggctgaggcaggagaatggcgtgaacccgggaggcagagcttgcagtgaaccgagatacgcccctgcagtccggcctgggcgaaagagcgagactctgtctcaaaaaaaaaaaaaaaaaaaagaaagaaagaaatggatacattagtatactgaattttttgcaaggcactgaggagatgagatttgttattgttattacgggtataagggtatgtatgtgtgctctgtgtgtgtgtgtgtgtgtgtgtgtgtgtgtgtgtgtgaagaagaaacattccttccttgcttccgtctaattttcctaacctccctaaccacaaaaaccttccagggcaacatctatattatttgtgcttttttgattgaaagtgttaggaacttaaactcttacacacacacacgtgcacgcacacacacacagacatagggag

SEQ ID NO: 430 - DNA, 5601 bp, Homo sapiens
ttctaagtatactgatattaccaaagacactgacaatcttcttttcctacctctccccagtgactaggtttgcagcaggagctctataagtcctagtatacagcagaagctccataaatgtgtgctgacctaagcattaggcaaaaatgagtaggagagaagctctagacctaagggtctttggctggcccttgcctgccacagcctagctgtgtggcactgggcagtctgcatacctctgggtctcagacttctaatctggaactgggagtgccaggaacttcaaggccacaaggtcaagggaaggactgcaagaagtaactgcacacatcacagtatctaataccaatgcctggtaatcgaaaggctggagttgaaaaagaagggaatagtacagctattaaagctgtactgaagggaatagtacagctattaaagacaatcctcaggcttcacattagccagtggtcgacatccccagaccttcgagtctcactcaggacagctatcatgaagcccagcgggttgactggaatgtcacttcctttgctggaaaatcaaataaaaaacagggagtgtgttccactccagaacgtcatacaggctggacggaagggctcctgcattctggaggaatgttcaaagaacaaatgcaaaatcacagtggctggtacagggcaggggatggggcaagaggcagggccccttcaaaccatcggtccctggcagccacccaaaattgggcaaaaatgcacttgcagaatgagaagctgcgatcacctcagcttgaaagactctgtcctatttcaactggaatgacctccccctctccttggccaacactgaggcctttacagggaaaaaaacaaaaacaaaaacaccacaatgataatttttaaaagataaacaaggaaccttaggacaccagccaggacagagcttcccaagacagcacaggtcccttctcctccaggcagcctaccctgcttgccaggcctgcctgtctcccaccctggacaggagccccaggggcacgggtggtcaggtccacgaaccacaaagtcaaagcaagctgcatccagtccccgttctactgcctagctttatgtgaccctggacaatccccttagccacaccgagtccttacctctgaaacggtgataaaaattctcacctcctagagttactatgaagattaactgagatcatgcacacacagcaacgtagaatgaaactagcacatggtaaactctcaatctacgttagctaattattatcgtaaaattctgtggcacagtccgtactaaatacatatttatttttctttaataatatgtgaatggattcctaagattcattcctagaggcttttgtcttgttcatctcaagaagtcttgttcttcaagatgctcagcatcttgaccaaagcctggcacaagttatgtacccagctaatactcattaatccaagcaatgcttctccaagctgcctcagggacctgtgtcccagtgctttccctggcttagacagcttggtggtatttaagtcttctgaatggcaaacggctgaggtcatgtgtactgttctaagtaaagcagagggaactggagtgggcagtagagggtagtggaggagtgggtaaagagagagctcgtagctccagggatcccccaggcagaggctgtgtgcacctgtccctcttcttgcagggatcccgccggcctgacaggcccccacctcaccttggaggcggcccagtccatccagccttccgcacaagggttcacgttgataaggacaaggccctccaccatctcagggttgtttagctgcaattcaagacacaaagtgagacagacatcccagcaatctgaaacactaggaactttccaaggcaaaccaaagcttgagagaagtacccagaaaaaggcagtgtgggcagcagagcaggctgctgctccccggccccaccccatgcaaaactgaggttccagcacagcagacacggtatcgggtcctagagagagtgggaaggagaaagaggaagtgcaggagaagtaggaagcccgctgctttgcaggcctgccttgggcaagtcacttcaacccacggaggctcagcttctccagctatcaaatgggtgtaacacaccatcgacctcatcaatcaaacaaggcgcacagcacaaatgctctctagttgtggcagtaacaactgtattacttacttccaggataaacacatgcatacacacacacacacacacacacacacacacacacagagagagagacagagttatgcatcgctgaataacagggatactttctgagaaaattcatcattaggagattttgtcattgtgtgaagatctcagagtatacttacacacacctagacagtatagtctacaactcaccaaggctgtatagaacagccctttgctcctaggtttgctgtacaaacctgtacagcatatgacgctacccaatactgcagggaattgcaacacaatgctaagtattgatgtatctaagcaaatctaaacataaaaatggtacagtaaaaatgaaccattataatcttatggaaccactgtcaaatgtgcagtctgtcattgaccaaaatgtcattatgtgatgcagatacatacagatatagatatgtacacctggggtacagttgagaccatttttaatttgctgagagcctatatggccagaccattttgtattcatgtcagcattcctttcttttttttgtaagatggatgttgtagaatcatgtcagtattcccaacctccagcaaagcccagcaaataataggtagtcaaaataccaatggatgtacaaaatgagtattgttgcattcttacacaattgctcggtgaggatacaaaggaacagtggctcttgacctgagcccagagaaataacaatgacaactgtcatgaaaacttcccgtgtctgattctagtttagaatcagttatgacccaggagtgccctgactacaaaaacctgtacagctgttacaaagcagtgtcatagcagagtactcagtgagtgaggagcgtcctcactagatggctaagcggacaaagcccatgacaaaggaatgtgtccagtatcatccttgagtggaggaagagaaaaggctgtgagtatatatatatacgagtacccatgcaccacacacacacacacacacaactgtggagaatacgggtcatttctttttcccttttgggtttttgatgcttttccaatgtcttccttcatcttaaaatgttatttaaaatgcgattttcaaaaaatgccaaagcactcacagcaaatcgagttaggatgtaggcgcctgctcctgttcccatgccaataatgcttttcagcctggaagcaaaaatacaaatgcatgtcacacaaggacagagtgacgggagcctccaaggacccacttagaacttcctgagggtgaccgcctggctaggcaatgcgggagcatgctgccgtaactgcctgcacagctctgaggtcaccatgctttaggactggacagagacctcgaccttggagagccgcgccccttctcctcacttccctcctggccgccacccaggctctgagagaccgtctgacatttacgggaaggcccgttacggcatcatttcttcccactcttaagctttattttggattctaaaacttggaatgaaaacaaattgagcaagaaccatgaagttatcattctttgaagagctcaagacagagaggaacactggaaaaatgagggtgtggagagaaaagctaaggactcaggcaactccattccagaacattccatgggaaagagaagggaatggaagaacaggaggcaagagcaaatgggtggggcagctgccatcatgcaatataacattcacgcaagaggaaaactgaagttagaggagacagactagagctcagagactgtgtgaagaacagtgttcacagagtgacgagctaatttcttgcctcatctctaaattgcaaccttaattttagtggtcagtccagatcaaagccaaggggcaggaagatgctagaaaccaggcttctctgcagacagagaaggagctgatccttcgctcttacccaaactgttgaaggactccaggaagcatttcagccagctgatccatggaggggtacatgtacctggggatgacacagagaagccattagtgagcgcccggacagaaacgggtaatccaaacagggacacgcttgaagggtggggaccatgcagcagcctgccccatgcacccagacccccccacccccaagtctagtcccttcgcatcctccttccaagacccctgcagcacactctatcaattgcttcctacgctccaggtcccatggacacattctgggaattagctcattcaattttcacaataactctaggaggctgctaggatttcccctcatagcaagattataaacatcactgaggctgagagatgagacacttggcctcacaagagcagtagatggttagccagaaacatgtcctcactgtgtttgtctggttttgggtctagggtgttgcagaaactgactagaaggcatttcacaattccaatgtcagggagaaggaattaaaacaggcatgaatgagttccatccgcaaagcagtgattgatcctcacacatgccgggctcttggtgaggcaatggcaggggtctgtgagcaaagcagatgcaaaccaggacaggagccagccctcgagtcaacagaaacagggggtgttactcataacaaagcctatcgaaacagagacctgccgtgctcagatgatcagggagggcttcttggaagaagtgacgctgaaggggtcatgggaacctgatgagtaaagcgtgtgggcagggaagcagtgtatgcggacgccctgggaagagccagaaagagcccgtatggtgtggctccacatcaacagagccactgagctgagaagccgcagggcagaagtgcggcaaagacatgaagctcctctgaaatggccatggctcaatttggagccagcagctcctaaggtgtgacactggagaagccacttaattgcagggccctctgtttcttccctgttccccagggctggtgtgaggcgaggaagcagcagaattctacttccaaggtccctcctgtgtaggtggtggacaccggggccaggaggagcccagccagggatcccctaccctgctctgctgtctcggcttcagaatacagggggctcacccttaaagggcctgggagatgctccctcacccctcccaagccccacactctcctctgccctactccaggaggaagaaacaagtcaggtcccactctgacagtgggtcccaccagatgcacacgaaaaccacatagtaaactagggggaaaatgcgctgtaatacccagaccaacggaataaaaattcctgggggtggggctcaggcctcagaatatttgtaaaacttcaccagggggaactaagagtctctgctttcccccaagtctttcacacaactggtccaaccaaagatttacggacacacctctggctttat

SEQ ID NO: 431 - DNA, 5730 bp, Homo sapiens
agtaagtaaactattttccttaagccataatgttttgaaaaaaataaaatctaagaaagtaatgttaattatcagcattttgccatttattttttatcttctacacgtacacgtttcctgcccacccctgccagattattttaaaacaaatctgaagaccatcatatcatttcacccataccttcttcaatatttatctctatctgataaggacttttaaaaaagcataactataatatcgtaatcagacccaacagagttaacaaccagcctaagcagcatagcgagaccttgtctctacaaataataaaaaaaaaaagtagctaggtgtggtggtgtatgcctgtagtcccagctactctggaagttgatgtgggaggttcacttgagcctagaaggttgaggctgcagtgagctgtgattgggccactgcactccagcctgggtgacagagtgagatcccatctccaaaaaaaaagatctattaactatatttcttcatataatctcatacacagtctaatgtcaattttctgttgtttcaaatgatttgttcaaatctggatccaaacaaggttcatatcttacatttgattcagttctcttaactttcttttaatctcgctaacaattcactcacctttcttttcatgtcattaatttgttgaagaatctgagtcatttgtcatgaaattcttcacattctggatttgtctgctgattatatcctcatggtgtcagttagtatagtcctcttccctatatttcttgtaaactggcagttagatctatgggccttattagattcaggttctgttctgggtctggcatacatatacaggtggcctgtgtacttcctatgacatcatagcagattatcccttgtagattacaaaatgataattttataattctcttttttgcatttattagaattttaaaaggaagcactattcctcatcaactctttggatgctttggaatacagtttataggcaccagaaatgcttcattcattcctttatttattagtacttagagtgatggtgtcctagcaaccttgacagttgaccagtgagtttttgtgtagtttaattttttaagtattattatgaactcatggatttttatatatataatatgtttcacctctttgtgtttattatttctttgttgctttggagattttctcactggttttaagtaatttgattatgatgtgccttggtgtacttctcttcatgtttcttgtgcttgggatttgttgagtttcttgcatatatgagtttatagttgggaagatcaaagttgataaaatttcaaccagtatttcttaaaatattttttctgtcctccccttttcctttggcaactccagttattattataggtattttagaccacttgaaattgtctcctggcacactgatgctttgttcaatttttcagtctttttcctctttttgtttcagtttggttagttgttattactattcaagtttacacatcttttctgtagtatctagtatgctgtcactgctataagtatagttttcatttctagaagtttgatttgggtcctttttatatcttctgtgtttctacttaccatgtgcccagtctttcctgtaggtttttgaacatatggaatacagttataacaactgttttaatggtcttggttattaattctatcatctgtgtaatttttgtttttttgaaacggagtctcgcacttgtcgcccaggctggagtgcagtggcacaatcttggctcgctgcaacctccacctcccaggttcaagcaattctcctgcctcagcctcccgagtagctgggattataggcaaccgccaccacgcccagctaatgtttttgtatttttaatagagacagggtttgaccatattggccaggctggtctcaaactcctgacctcaggtgatccaccccccatggcctcccaaagtgctgagattacaggcatcagccaccacgcctggcccatctgtgtcatttctgagttgttttttcaattgattgattattccctctttcattatggattgtatttttctgattctttggatgcctgataattctgattgcatgtcagactttgtagagtttgccttcttgggtgctggatatttatgtattcctgactgttcttttttttctaaatttatcaatcctgcactttttgtacctataactgttcgttaactttcttctgtgatgtggttaagttagttgggaaaagtttatcttcaggtcttgtgtatgtgtttgtttttgagacagtctcaatctgttgccaaggctggagtggagtggcacgattatggttccctgccacctcgaagtgggcttgggcaatcccccaaccttagccttttgagtagctaggactacagaccaccgcactcagctaattaaaagaaatttttttttgtagagggggtcttgctgtgttgtcaggctagtctcaaactcctggcctccagcagtcttcctgccttggcctcccgtagtgctaggattacaagtgtgagccgtcaccacgcccagctttttcaggtcttttaaactgtagtaggcaaaaaagtagcagcatttagtctagggctaattttgccccactccttaggcaaaacctttctgagtgcttcaatattccattagttatgtttgccagtctacctgatgggaagacgaatcattcacagctctctgtgagcctcagagattgtttcctctgatctttcactgatgagtactcaattttagacttgagagggactctgcaaatttccagagctttgcccagctgtttcttctgtattcttccccacatctctgtctgcttggcctcctcaggtttctttttctttttttttttcttttttctttttttttttctttttttgagacggagtctcacactgttgcctgggctagagtgcagtggtgcgatcttggtgcactgcaagctctgcctcccaggttcaagtgatcttcctgcctcagcctcttaagtagctgggattacaggcgctcgccatcacgcacagctaatttttttgtatttttagtagagacagggtttcactatgttggccaggctggtctcaaattcctgaccttgtgatctgcccgcctcggtctcccagagtgctgggattacaggcatgagctactgcacccagccaacctcctcaggtttctagtgcagtctcaactcagaaaacatggattgactttcccctcactatggaaattttctcagggcaataggctgggcaatcctagtgttcaccttatttgtttttatatctcagagattactgtccattgttgcatcatgacaaaagtcttgaaaagtgttatttcatatattatgtccagttttcttgttcttatttatgatgggaggataaatccagtgccagttctataccttgactagaagcagaatcccatcttattttcttttggtgctcatatttttccatctttgactagcaaggaactattttaattggtttgtgtccttttgacattaccccagcaatagttgatattttacttgctttctggcatgtcaggatgtcccagacctacagttagctgtttctgcaagaaggtagttcttttggtgtgaaatttctttttcttttttttttttttttgagacggagtcttgctctgtcacgaggctggagtgcagtggtgtgatcttggctcactgcaacctccgtctcccaggttcaagtgattctcatgcctcagcctcctgagtagctgagactacaggtgtgcgccaccatgcctggctaatatttgtgtttttagtagagacacggtttcaccatgttggctaggctggtctcgaactcctaacctcaggtgatccatctgccttggattcttgaagtgctgggattacaggcgtgagccactgtgcctggccaatttttttagaaagaatatattgatatagtttagccagctactcacagagtatcttaaaataaaaattgcctttttttttttttttttgaaaagacggggtcttcctctgttgccaaggttggattgcagtgatgcaatcatagctcattgcaaacttgaactcctgggctcagatgatcctcctgctttagcctcccagagtgctgggattgcaggtatgtgccactgcacttggctaagcatgtatttttaaaaccagtctttgggccgggtacagtgggtcatgcctgtaatcccagcactatgggaggctgaggcaggtggatcacaaggtcaggagttcaagaccagcctggccaacatggtgaaatgccatctctactaaaaatagaaaaattagccaggtgtggtggtgcacacctgtaatcccagctacttgggagactgaggcaggagaattgcttgaacttgggaggtggaggttacagtgagctgagattgtgccactgcactccagcctgggcgacagtgtgagactccgtctcagaaaaaataaataaataaaaccagtctttggactggtattcatacatgatcaagcagtccttggtctatatcaaaataagaaaaataaggacaaaggccaggcacggtggctcatgcctgtaatcccagcactttgggaggctgaggtgggcggatcacgaggtcaggagattgagaccatcctggccaatatgttgaaatcccgtctctactaaaaatacaaaaattagctgggcatggtggcgtgtgcttgtaatcccagctactcgggaggctgaggcaggagaattacttgaacccggaaggcagaggttgcagtgagctgagattgtgtcactgcactccagcctggtgacagagtgagactccatctcaaaagaaacaaaaaaaaaaaaaaaaagaggaaaaaatggtgttttttataaattgatatctgttcaactatttatttatttatttatttatttatttatttatttatttgagatggagtcttggtctgtcgcccaggcagcagtgcagtggagcgatctcagctcactgcaacctccacctcccaggttcaagtgattctcctgcctcagcctcccgagtagctgggattacaggcacctgccaccatccccagctaatttttgtatttttagtagagacacggtttcaccatgttggccaggctggtctcaaacttctgaccttgtgatctgcctgccttggccccccaaagtgctgagattacaggcgtgagccactgtgccctgccaaatatttttatattttaagatattgcatctcttacctgtggtgttgaaatgttctatatttttgaaatgatggtcatgtctgtgacagcttttttaacctcgagattttcagtaagcttattgaacacctctaatatacaagggctatgataagatctatggagatagagggtagaaaaaaagaataggacacagatatggaactgtgatcatgagatggtatgtgaggaagatcctgttctgaggccatacagtaattaggatttgtaaggactaaatccaggtacctagaggggaagagaggatgtattatgtggaaaaatgccatggggcttttggagaatagaggtgaactatttattttttaacttcgtatctatcttccaaagcatctctaaaaatacattttattggcttgcaatattaatttactgcaggtctaaatt

SEQ ID NO: 432 - DNA, 5775 bp, Homo sapiens
caatgccagttatcacaacatgcctatagttctatgtatataaatgctttgtaaatggcattaaatggtacaaaaatgtaactatcagggaagaaaacaaacagtttaaattataactttttttttacaactattttggaagagtacttaaggtaaacaatcattcaacaaaatatttattgagcacctacaatgagtcttgctctgttgcccaggctggagtgcagtggtgcaatctcagctcactgcaacctctgcctcccgggttcaagcaaattcttatgcctcagcctcctaaaaagctggaattacgcccagctaatttttgtgtttttttgtagagatggggttttgccacattggccaggctggtctcgaactcctggcctcgagtgatgtgtctgccttggcctcccaaagtgctggaattataggcatgggccaccgtgcccagcctgaaaacagaaactttttaaatgcttttttttttttggtaaattacttcttccatgattagagggactatcttcaaagtagtacaaatatttcgtaaataatatctgaccattttctaaccaattgagtaatttgttgcacaataagccatctcacatctttcagcaagaaatacattaaatttgaatagtaaagacattacacaattaggcttaggacaaaattaaaatttgcctgaagtatttctttgggggagaggacaccacacttctactcaaggaagagaaacatttttacagtccagaggtcttttatttttatctttattttttatttttttgagatggagtctcgctctgtcgcccaggctggagtgcagtggcacaatctctactcactgcaagctccacttcccaggttcacgccattctcctgcctcagcctcccaagtagctgagactacaggtgcccaccaccacacacagctaactttttgtatttttagtagagatggggtttcaccacgttagccaggatggtctcgatctcctaacctcatgatctgcccgcctcggcctcccaaagtgctgggattacaggtgtgagccaccgcgcctggctattttttttaaacactattatgcatgaattcacagagaagaggttccagcagctcagacttctttcccttggttttcacacagcgcgcttctctgggtggaacaggctggcacttcagctaaatgcaggtacctttctctttggcttccttctttttctgatcattttccttcatgtgtttcaggaagctatctcggctcttagagtgcttaatgtgctcaatatgcacattaattctcttggtaagaatcttgcccttgtttgtttacaacaatgccattagccacgcgtggtggcgtgcacctgtaatcccagccactcagtggggctgaggcaggagaatcgcttgaacctgggaggcggaggttgcagtgagccgagatcacaccactgcactcctgcctgggcgacagagcgagactctgtctcaaaaaaacaaaaacaaaaacaaaaacaaaaaaacagcaatgccaacagcctgctgggtaacactgtagactcttccagtttagccacggtaacacttgtggggcattcctttttgaacagtacccattcccttaatgtctacagtatcacctctcttttagatttgcatatacgtggccaaaggaacaactccatgttttctaaaagacctagaaaacatctatcgggtatctctcctcctttcctttggattagtcattttggcgaattactagaagattggtagttcaggccaaaaggcaatgctgactattctttataagaatacaagataatatattccctctatcagtcttgacagtatagttgtacattttcaacttacataacataaaagcatacttattctaaaaacataaaaaaaaggcttcttaccttgaggcgccaaatgctgtacatgtgaaataaagctgtctagtttcaaatggtattagaaaaggacatttgctggttaattgttcacaccagtctggcagagccccacttgccagtgccaatggttcctgcgaattaacaaataataatgtcttagtgctataaggcattcatgcatgcatgcattcattcattcgttcatttttttttttgagacagagtctcactctgttgcccaggctggtgtgcagtggtacgatctcggctcactgcagcctctgcctcctgggttcaagcgattctcctgccctagccacccaagtagctgggattataggcatgtgccaccgtgcccagctaatttttgtatttttagtagagactgggtttcgccatattggccaggctggtctcgaactcctagcctctaacgatacacccaccttggcccccaaaatgctggaattacaggcatgagccaccacacctgaccctataaggcaattattaaaaattaccaagtcaattataaacctgtaattaggaaataaatgcaaaggaccatatagctcaaattaccaatcagagggaagggaaagatggtgagaggtagaaaagaaagtaaagggaatattaggaaaagtccaacagtaatagaatgaagagttcagctgtctgattttattacctcaatctgctgtaatatttttgttgtaatttttttgctagtgaattcatctggtggaaaagtaaactgaagctgttcatcaccatctataaaattaattaataaaattaataaaaatataaactgacttgctttaaaactgctatagaaatgaaacaaggcttcttacagaccttcctgggatattcttgaataagggtcacttgcaactatatatagaatacgcagaagctgaaggacatcttctactccacaagagttctgtccattgcctgctttggcctgaggttgttcttttgttaaattaagaatatcactactttgaagagtagaaatggccccctggtttaacccagactttgttccatgctcacaaaaatcctatagaaacaattagaaaaactggccattaatcacattttcaagaaaaacagtgtatcattgtatcaataccactatgaaagggttggaattttttaaagtgccttctttttaaataaaaacataacacaagacataaatcaaggcattctaaaccattaaaattcccaaataaaatataaccactctaagccatggtcaaagtctgcattcagatccaatgctaccagccatatttgaaattttagaatttgtgcattaacagtgttaattcaacctcatttttaaaattatgtctcaatgaactgctgttccttaagaagcttccaaagctgcaaaacaaagcacgaagccatttgcaatcaaaatagtgttttgatgccaatatataccttatatgcagctatgagctgagaacaatttctgtttttcctaatacttttattagtgccagttaatttccagtggcgcaggaaagcagcgtctgcattcttctgcaggtaggttatcaagtcattctttggtaattcatcagtgccaaggtactgctccacatgctctatagaccagcaaccctacaacaggaaaaaccaaatgttggcctttcccaattataaagtctatgatatttcacatgcattacatgaggtagctttaagatcatgcacttggtctaatctaaagaattccatgttagtcattattcccttcaacgttcaactgcaatactgtgttagttttactatctttcttcttttaactaaatagccaagagtaaaccaatgttctaaaataacttaccatttttccattttccttttctttatcagaatccttcatttctctgtacatgattctaaacatgaagatattcaagttaattcatatataatttgtgattatttccaataaggcttcaattctttaaaaaaaaaagtgaatgtcattcactagacatatgcctgcactgaacactgaactcaaggaggattctttttttctatattttttgtagagataaggttttgctatgttgtccaggctagtttcaaactcctggtttcaagcgatgctcctgccttggcctcccaaagtgctgggattaaggtgtgtcacgacacccagcctcaaggagtatttttaagaaaaaatgttaatttgttaaacataaggcaaagtagcagaaaccatattcctgaattatgatttataaatttatcattattacaaagaaagcatgtatcaaatctagaacttttaaagatatgactgtatcaagtgttatgcagcattaggtgatctggtggttgtgaaacatcactgagtacattacacaaaacaaaatggtatagcctactatctacgtaggctatgtgttatagcctatttttcctaggccacgaaccttaacagcatatcactgtactgaataggcaactgtaacacaatggtatttgtgtatctaaacataaaaaaggtacagtaaaaatgtggttttataatcttatgggacccctgtcatacatggtccatcactgactgaaaagttgttacatagcacatggctataactgttgtaaaaatacaatgggataagaaacaggttctctgtgtctagatggaaagaaggatagaaataacaatgatcaggagtgcttatgttcaaataaggcagttgagatcaatttttaaactgtaataaaaattgaagggaggttttcctagctcttgggaacttggggaaaaaaaactgaagggcgggagaataccgttatgattttctgttctatttcaaaaggacctacattacttttattggccattacataagattatcagtgatgttaagagaacatcagaaaacatactaatagaagtgaagttacagtaagaatgatgatataatttattattattaaataacaattactttatagataacatttactgagcacttaatatatcctagggggtattgaaaacactttgcaggccaagcacagaggctcaacacctgtaatcccagcactttgggaggctgaggtggacggatcacttgagctcagaagttcgacaccagcatgggcaacatggtaaaaaccccatccctacaaaaaatacaaaaattagctaggcctcgtggtgcacacctgtagtcccagctactcaggggactgaggtgggaaaatcacctgagcctgtggagtttgaggctgcagtgagccatgatcgcaccactgcactccactgcactccatcctgggcaacagagagagaccttgtctcagaaaaaaagaaaagtaaagaaaacactttatacatgttaattcattaattccttaaaaccactctcattttatagattaggaatgtgaggcacaaaaatgttaaataaatttaccctaagtcattgatgattatttgtacaaagaaaggcaggtgttaacccacacacccccaaaatcaagaacagaaagaagatagttagtactcatacacgatcttagacaaagaattcaaatgacgctcttttcaacaattacgtaagaagctagtatagactgtaaatgtccttctacttctaaaacttaatcattctacaccaagagtcccaaacactattatctgttcctgtaagccaacagaataaaaacaaaatcttttctgttcctataatccaaaataaatgcaatgcttcttggctctacactaggacattatctaccaaaacattaagttaaaatttcttacgtgtatgtgggctc

SEQ ID NO: 433 - DNA, 5819 bp, Homo sapiens
gggatcttctttacatgacaatgttgaagccaattgatacacaatttatttgttagcgtgttagtggttctatttgttttatattttgaagtgaactatggccttcttttaggactgaaaaataacttcgtggtgtacagatattttagattaaccaagggtacttgttaacaaaagctattattttatagctgcatctccgtgtttgatttgataaatttgggaattaaatttacaatgcaaatttcattagtggaattacatagccaatttggagaggttctatttaatgtgctaccttgatttagaatgagcgatttagaaatatgaagagttgactgggcatggtgtctcatgcctgtaatcctaggactttgggaggctgaggtgtgattgcttgagctcaggagtttgagaccagcctgggcaacatggcaaaatcctgttctacttaaaaaaaaaaaaaattagctgggcatagtgacttgcccctgtggtcccagctagttggtgggctgaggcaggagaatcgcttgagtccaggaggttgaggcttcagtgagctgtgtttgtgccactatactccagcctgggtgacaaagtgagaccctgtctgaaaaaacaaaaacaaaaacaaaagcaacaaaaaaaggagaaatatgaagagttagataaatgatacgataatagcccacgttttcttgttgattgtggaaaaggaaataattaacagtatctattataaccacataggatgtattgatttaagaattacagtagaaaataattcaaggaattggaaaagtgaggcatgttgttctatgaagattttgcatccttaattatttataagtatttgagttatgtgtaacttcattttctccattaatttttgataatgatatccaaaacaaatctgcagttatttgttagtttgacctgtgttatctttgcttcataaattcctcaattatctagtttaatctagttcttatttcacaaatgatggaagtcagattaagcagtttgtttaaatgacccgcaatgaattatagagataggtcaccattttatgctaacgggttggcaagaaaaattcatgaaattttacaggcttcatgttgcagttgtctacaaatacacttccataaatgaaaataaacaagtttgttcattgcatcattataaatgtaatttaaaaattaattttctaaattgttttatgcaagtaagtaagcaagcaaaataaataagaactcatatactttcctgtcttttttttctcccctgcccaataggaccagacatactatcaatcatttcaggtttcagaatatggtaagagttcctcaatctattttggaagaaaaaaacatttgttactttcagcagagattagagaaatttttaagagatgtattatttgaagtaaaaatctcaatggagttaaaattctggtgttttttaaaggcctaaccatattttttttcctttgtaaaaattctaaaatctcattatacagaaaaaagtagaaaaaaatcacctatagttgcattgtgctagtctttttcttatccacaacatgatttttctatttttctactttgttgtgataaaaaaatatttaaagtgttgcacttaaaaatacttaacaaattctcttccatatttttcatttgattgacattggtaaagatggtctgtttctcaggtaaatcctcttcttgcaggtgccatacttacaatatctgttagaaacccatagataaaaacagtgggacccatctattttgttggtgaatggagaggaatgagagatgagactgaaagcataggatcttagtattagttataatttgaatagttattttgaggttgcacatgcagtttttcatttgatttgagcttcttttttgagattgggttttatttaggcagtagaaattataatatacaggtagtaatacctcaggctctgtgggccatatgtctctgttgttactactcaattttgccgtggtagcatgagagcagccaaagataatatgtacatgaatgttgctgtggttcaataaactttattttatgggcatgaaaatttgaatttcatataattttcatatgtcatgaaatattcttcttcttttgatttttttcaaccagttaaaaattgtaaaaaatgttcttggttcatgctggtcatagtttgctgaactctgatctgtaactgtgctctccagtagcggggccacttgccatgtgtggctgttgagcacttcaaatgtggctagtccagatggagacagcagatgtcaaagacttagtacaagaaaaatgaaagaaagaaaaatagttcattaataaccatttttaaatttttattatttgttgaaaagatactattttagatatatagggttaagtaaaatataaaaattaatttcacctgcttatttttactttaaaaatttgactactagaaatgaaaaattacacatatggctcccattttatgtcttttagacagccctgatctagaagaataagtcataggggaccaacatttttataggctatctttatatcccattgtgatggtatgctgggtggttgtatgttgttgaatgaggtatagtggaggtggggaattgattgcaaacctatgatgtttgaggaagaggcatttggattttcttggtggtgggggttgcgggggcggggtcatagttgactcacgtgactttttggtctccctgtcctagactgatctagagtctaggagtgtcttggtacattcagggccattagccttgattggagctgaaggtctgccctatattgttgactatttggcttttttgatacttctcttatgttaattgaatggtgaggtgccttgttatgagagtggcctgtttctttggtcagagaactatagaaaaaaagttttatcgactgtaaagaaacacacattttttactctggtggagtgctttatatcaattatagtattagtacttataaaatagtttataccttaattattattattatttttcgagacggagtctcactgtgtcactcaggctggagtgcagtggcatgatctcgggtcactgcaaccactgcctcctgggttcaagcgattctcctgcctcagcctcctgagtagctgggattacaggcatgcaccaccatgcccaacaatttttgtatttttagtagagataggattcaccatgctggccaggctggtcttgaactcctgacctcaggtgatccacctgcctctgcctcccgagttctagaattacaggcgtgagccactactcccagcctcataccttaattatataaagctgaccaaattagggatttctagttttgggtgaaacaaagggcttttcatctgtcttaatatgtatttggattctaataaatttaagttcaaatagtacaaattattaactccttcacaacaattttatttttcattttattcagtggaagatgatagtgaagtagattctttaaaagatttacccttgcttcttcgtctcaaaaagaaaaaaagatttacccttgcttttcttttccagtattaccaaaatttgaagtgactttgcagacaccattatattgttctatgaattctaagcatttaaatggtaccatcacggcaaagtaagtgtcatttttcttttgatatgactcaaaaccattataaaactgtgtgaccaaaagctgattgtatacttcagaatattagggcaatttttgcttattaaaataccttagtggacagtaaatgactatttataataaataattaagcatgggacagagctccacatttcactgcatctatcactctgcttgcaagccgacccagtcttaaaatatttcccatatttcttagacttattaagggatttatattatagatagcactgtttttttttcagatgacatggacttgaagccaccacgcctggctaattttttttcctttatagagatggggtcttgccattttctccaggctggtcttgaactcctggcctcacatgatactcctgccttggtctcctaaagtgctgagactacaggcatgttccaccactcctgggctgatttgctttttaaaaattagtcaagcttttattttctgagtgattaacttatcccaaatgcttcccggttctatttgggacaataattgtatctttgtttcacaattattataaccagcttggtgtttggaaaactaaatctgcttcacattaaagtcaaaattaaaaatttttatgtctgagagtactttaaattatatttggattttaaagatccttttactaccatgtgatataactctgttaaaatacaatatcctggcattctagttttgcttttatttaatctttagcacgatacaagtagagtcaggtttcgaagactcttgaatgagtgaatttgatgctcaggttgctaaccagggtttccactgactttactgtttttgtttggaagtgtggtgcatttgaacttggatttttttttttttcttcttagtttggaatatgctatattttaagatttgcttttgagttgagttgatccagatgaggggctgtttctgtgttcagttaatggattcaggaagccgccgtttactgctgtgatttatagactgcaaagcaaaattgacttccatgtctggctcagcatttcacaatagagatagaagcaacccaggaaatgtacttaaaaaaggctttctgggccgggcgcagtggctcacgcctgtaatcccagcactttgggaggccgaggcgggcgggtcacaaggtcaggagatcgagaccatcttggctaacacggtgaaaccccgtctctactgaaaatacaaaaaattagccgggcgcggtggcgggcgcctgtagtcccagctactcgggaggctgaggcaggagaatggcgtgaacctgggaggcggagcttgcagtgagccgagattgtgccactgcagtccggcctgggctaaagagcgggaccccgtctcaaaaaaaaaaaaaaaaaaaaaaaaaaaaaagcctttctggcagtaaaatgtattgcctcttcttcacatgaagagactttcctataatgagagaggataaaattaatacatagaaagaaaagtagcagagaatatttgacttacgaagctaagtttgggccaggtgaggtggctcgtgcctataatcccagcactttggggggccaaactgggtggatcacttgaggtcaggagtttgagaccagcctggccaatatggtgaaactccatttctactgaaaatacaaaaattagctgggtgtagtggcagacgcctataatcccagctattcgggaggctgaagcagagaattgattgaacctgggaggcagaggttgcagtgaccctagatcgcaccactgcactccagcctgggtgacagagcgagactctgtctcaaaaaataaaataaaataaaattcgctggacgtggtggtgtgcgcttgtcatcccagctactcaggaggctgaggcaggagaatctcttgaacccctgaggtggaggttgcagtgagccgagatcatgccactgcatccagcctgggtgacagagtgagactgtgtctaaacacacacacacacacacacacacacacacacacacacacacacacacacacacacaaacccagaaactaagtttggtactacagattttaaaaattattcttattttaaattttttggcaaaaaatcaatttttgacagccatgagca

SEQ ID NO: 434 - DNA, 6020 bp, Homo sapiens
taccttcataccagtgatacttaatggcactaggaaccaaatcatgaaagcaaattagcaaattctacagttgggaggggttaaacaggaggtagcttggaaggtggagaagggaagggatgggagaggaagcgggtggagtcaggagacggtggctctggttctggctccgtccttgattttatgaaagcctggaagccggtcactttctctctcaggatttgtttctctcttcatttgtagacttaggagggtggcctgggtcaggtcatcacaaagagtgcactgggactactagaggtacccaggattttaggtgtttccaggacacagaaaaatcatgttgagtcacatggtgagaaagttactctttcaggttttgggttttttttcattgttgttgttactgttttgagatagtgtctcactctgtcgtccaggtgggagtgcaaaggcatgatcacagcctcgtgatcacagcctcactgcagcctcgacctcctgggttcaagtgatcctcctgccgcagcccccttagtagctgggactacaggcacgcaccaccacacccagttaactttttttaagacagggtctcactctgtcgcctaggctggagtgcagtggcatgatctcagctcactgcagcctcaacagcccagaatcaagcgatcctcccacctcagcttcctgagtagctgggattacaggtgcacgccactgagctcagctattttttttttttgtatagacggcgttttgctatgttgctcaggctggtctccaactccttggctcaagcaatccacccaccttggcctcccaaagtgctagggttataggcatgagccatggcacccagccctcggttaacttaaaaaaaatttttttgtagtgatgcggtctccttatgttgcccaggctggcctcgaactcctggcctcaagtgctcctcctgcttcagcctcccaaagtgctgggactacaggtgcgattcactgcacctggcctcttttccagttctgaccatctttctcttttcattcctctcaaaaagacagtttcgggtcagtgccaattctttgacactcacacatctttctccttttaacaagaagccagcaaagcctcagctcaggggctttggccagcaacatcatctgggaagaacttaacaactgttaacgctgggagcagtggctcacgcctgtaatcccagcacttttggaagccaacgcaagcagattgcttgagcccaggagtttgagacgatcctggacaatatgatgaaacactgtctctacagaaaatacaaaaaaatttagctgggcatggtggcatgtgcttgtagtcccagctactcgggaggctgaggcaggagaattgcttgagcctgggaggcggaggttgcagtgagacaagatcacgccactgcgctccagcctaggtaaccgagccaaaccgtgtctcaaaaaaaaaaaagaaaagaaaagaaaaacagcaacaacaacaaacagaaaccaaaaaacaccaactgttcactgttcagctttcattttctttttgtgcgtatcatgactttatggaaatgatactgggtttccacttatggttctgatgtgcaatcttttaaattaaaaaaaaaagagagttagttttaaaacattatgtagaaaaaaaagcaaaagaaaaaaaaaaagaataaaacccattatgtaaatggagtataggtgataggtggatatagcagaaaacatgaaggttatacaggaatagctgacattttggaaacactggttcccttgcagctctggatataaggactcccggcagtaaggccacagtgctccttccctgcccttggccaggaggctgccaggcccccactctctgcctcttggtcaccctccaatcctgtgtgcccactggatgaagaactgcctgggaaataggattaagccccctttcccgagcccagttacctgaggggacttgccacttcctcctgactgtctagggagggtcagcaggaccccctcaaacagctggttggtttcctggttgtctttggtgatgtctgcgttctcatggaggccgaacacttctgggtgggctgtgatggggagattcctgagatagtcgatataggactggaagggaaatcttcagttgaaatcaacgagggaccccagaatcccacagatgactccaggcttagcagaacccaatcagaacaggaatcatactgtatcagtagcacaggacacacacacacacacacacacacacgctgggagaacacaaccctagccctccctcatacagttttctggggagtgggcatgaaagcagatgagactgaattacctctcgcccaccctggcttcctctctgctcccccagtgggcctggctttggacccaaacagaactgagtttggatcctagctccatcccaaactgtcagaggcattcgaaccagagcaactccatcttgtatagggactgggtaaaataaggctgacacctagtgggctgcattcttaggaggtgagggcattctaagtcacaggatgagacaggagtcagcacaagatacaggtcacaaagaccttgctgataaaacaggttgtggtaaagaagccagtcaaatatccccaaaccaagatggccacggaagtgacctctagttgacctcactgctcattacacactaattataatgcattagcatgctatgagacactcccaccagcgccatgactgtttacagatgtcatgacaatgtcaggaagttgccctatatagtctagaaaggggaggaaccctcacttcttggaattgcccacccctttcccggaaaactcatgaataatccaccccttgtttagcatataatcaagaaataactgtaagtataatcagttgagcagcaacccatgtcattgctctgtctatgaagtagccattctttattcctttacttttttttttttttgagacagattcttgctgtctgccaggctggagtgcagtggtactatcttggctcactgtaacctccgcctcctggattcaagcaattctactgcctcagcctccctagtagctgggattataggcatatgccatcatgcccggctaattttttgtatttttagtagcgacggggtttcactgcgttagccaggatggtctcgatctcttaaccttgtgatccgacctctttggcctcccaaggtactgggattacaggcatgagccactgcgcccggcctcctttactttcttaattaacttgcttttgttgtactctatagactcgccccgaattctttcttgtgcaagatccaagaaccatccctttgggtctggatctggacccccttccgataataaaactatgtacccttgaacttgtcatctgaaaccccagtttccttatctgtaaatagaaaaacaagtgtagttatgaagtataaaccaaaagtaaaatcttaagaccctccaaccatctgaatggacttcctccttgtccggggcactctaaaatttaacctgaaagcctggttcaggccatgacgggaagtgggggtcagacatgcctcattatgcccctccagcattaccatcaacacagaccttaagtctgataagaaacatttacaatctattctctctgaagcctgctgcctggaggtttcatctgcatgataaaacttgggtctgcacaacctcttatcataacccaggcattcctttctattgataactctttcaaccaattgccaatcagaaaacgtttaaatctacctataacctgctggcctccacttcgagttttcccgtctttctggactgaaccaatggatatcctaaatgtatttgactgatgcctcgcgtctccctaaaatgtataaaatcaagccctgaccacctggggcacatgctctcaggatctcctgagggctgtgtcacgggccatggtcactcatatttggctcagtataaatctcttcaaatattttacagggtaagaaagagactcttttcatccacagaaggaatcaggccttggcatgtgacaggttgtggtgtaatatacatatatatctactggttttcatccatggttcctggcttctaactcccctagcccttgttacagtcacctgttataatgttgggtgtgttaggccttaggggcaggccgcaggaaacagaatctctctgaccttctctttccctccttttacctgcccccaagcaagactcaaatcttcccctgcctttctgattgtgagtcctttttttttttttttttttttttttgagacagggtcactctgtggcccaggctggagtgcagtggtgggaccttggttcactgcaacctatgcctcctgggctcaagcgatcttcccacctccgcctcctgagtagttgggactacaagtgcatgccatcacacccggctaatttttgtatttttagtagagacagaatttcaccacattggccaggctggtctcaaactcctgaccccaagccatccaccagcctcagcctcccaaagtgctgggattacaggcatgagccactgcacctgacctgattgtgagtcttaagactccacctagagagagagggtgctgccctatactctggggaatgtcatacagctttcataaaaacccaagaagactgggtgcggggagcttctggatagctgaccacgtggaggttcctggagggtatttcacccagggagggcatggaagttctcactccttccgccatacttcaccctatgcatctcttcatctatatcttttgtaatattcctttaataaaccaataaacctaagtatttctctgagttctgtgagctgctccagcaaattaattgaattaatttcaattaaagggggagtggtgagaaccccaacgtgaagctggttggtcagttcttgaggctgggacttgtgactggtgtctgggttgggggaaagaattggggactgagccctcaacccgtgggatctgacactatcaccaggtagatggtattggaattgaattagaggacacccagttggtgtccactgcttaatgtgtggggaaggggtaacctccacacatttggtcacagaagtcttcttctgtattgatggtggtggtggttgtggtgagacagtagtagaaaaatacaatttcagagtttttctgttccacaggtcatcaataaaagtaagtggttttttttgtttgtttgtttgtttttttgagacagtttcactgtcactcaggctggagtgcagtggcatggtctcagctcaccacaacctccacctcccagttcaagcaattcccctgcctcagcctcccaagtagttgggattacaggcaggcgccaccacacctggttaatttttatatttttagaagagatggggtttcaccatgttggtcaggctggtctcaaactcctgagcttaagtgatccacccgcctcagcctcccaaagtgctgagattacaggcgtgagccacagcatccaacctgtaagctcttttctatccctcagattgttttcatcttccttttgtcattccctgcccagtttttctgttcctccctttttgccaccttctgaatcttcgtcttcaagtagcaatttccatcttgctcacttccaaggctccatcttaatcatcgttctctctccttcctccacccagatggatcctatattttgaaacaccttgtctaccaaataccgaccccctccttaaacagtagccatgtctctcttgcaggcttttgggaatattgggaatagcttatggattcaattcaggaagcccaaggtcacccctgggatccctggctacactgcagccctgtagccatatagagatgacggagccctgtgggggaaagaggtaggcctccctgcccaccccttacctggtaggagccatgaggagggatgtagtaagtgtctccaggagcgaggga

SEQ ID NO: 435 - DNA, 6069 bp, Homo sapiens
ttactcttgtgatcctagttctactctttgatcacagtctgtgtttttggatctcatgatcctgcagaatcaactttatgtgtggaattctcttgagaatttaatcctgggaggaaagagtgctgtcttggaagcctgaggctgcccctgtctatctgtgataagaagtccgtgagcagctcactcctgagccttggccttggcagataggaagctcagtgcgagagttaaagcttgtcacagccctttcttgtaggcatttggcctcctttgcctcatcctgcctttggtgttctatttttatttcactagctctctggtgtgccagcctgaatgagtgggcgttgcgtctttctagctagcagggagcaggtttggagggatgaggacagaggccattttctccatcttcatgtttggacagtgggacaggcatgcatgggcctgcctgtccacccagctcagaccatgccggcagctccagggtggagatgagggcggttcatgtttatacgcaccatttattgcttgcattttaaagacatctaaaaactcaaagcttgagaagatgggggtttcacaggaaaccagaacttcttgttggggctgacatggggctctgttggcttacatccgtggctggtgtgacctggtgcctcttgtgtgggagggtggatgttagccccaagtgtgctgacaggtctggtcacaggtagccctgccgacaccgcccctccccatctgttcctcactcctgctcacttccaaatgccctgtggtgccaggtggggccaccgcatgtcactgcagaaggaacaagaaaaagaaagagaaaagctggactctctttaggatgaaaacataatgacattttttatcttccccacgggtggagcccacagaggtcggccacaaatgggttggtggccttgatgttcctgccaaatgtgttttgacagagaggcaaagatttgtgctgaacaaaacattaccctgaataggacactggactgggagcagtggctcaggcctgtaatcccagcactttgggaggacaaggtgggaggatcactggggcctaggagtttgagcccaggctgggcaacatagtgagatgctgtctctacacaaaattaaaaattagctgggcgtggtgttgcctgtaatcccagcggcatgggaggctaagagaggaggatagcttgagctcaggagtttgaggctgcagtgagctgtgatcacaccactgcatagcctgggtgacagagcaacaccctgtctcaaaaaaaaaaaaaaggaacaggacactgaagttaagtaaggctgtaagtatcaccctcatccccgttttactgtgatgagaacaatgaggctcagccaggcaggcctccgacaaggagaaggtgcctcatttgctgggatcatgggcggttctgggtgtaggtgagacctttagggagcattttatactgttgcgggcctggcctctgcaggaggtcactgttgggaagtgacttcagcgagcccagccggccctgagccaggggagccactgctgcccttttgacacagatgtcacaaggatgacaagcctttccaggagcataagccccacttgaggcagtttgaggagggagggtggagggagagaggcagtctctccctgccagagaggggaggctgggaaagatgaggactgggagtggcggggggtagccttccaagggagcacaggcagagctttcacttctgtgcaccctgggagcgacagctctgttccagacccgtgcttgaatcagcactcaccccgacattgttcattgtcattctgtacaagggactggttttctgttgttgttgttttttgagacagagtcttgctctattgcccaggctggagtgcagtggcacaatcttagcacactgcagcctccgcctcccaggttcaagcgattctcctgcttcagcctcctgagtagctgggactacaggtgtgcaccaccacgcctggctaatttttgtatttttagtagagacggggtttcgccatgttggccaggctggtccagaactcctgaccacaggtgatctgccctccttggcctcccaaagtgctgggattataggtgtgaaccactgtgcccggcctagggactgtttattctcctcctgggcctgtggaaggcagtgggatgccatgaggcagacagtgatcctgtgattcctgcaggcaaggcccttgttggagagaaactggcttctagactccgagtttcagccacaaaggccttggcctgatggcaatcaggatgggggggtgtggcctatagaaccactgaagtgcccgtggagcccaggttgggagagaagtgcatgttctctgggtgcccttacgtcagtggttctgggaggagaccccgccttcctgcctcagtgctgcctgcctccctgtttcccttgggcaggtcttgttccccgctgagcctcagcttcctgacttgagatctccagggttgtggggagggtgcttgaattgaacgtatcaatacacaacgtggacattcgttggtgaaaaacagaagtgaggtggatctgaatctcatgaagggctgattcatcgtctgctcactggagccagaggggtccccagggcaaacgctactcacactagcttggaagactcagttctcgtcattactttagctagcttgctaactgattttttttaaaagaagtatactttactgtgtaaataatgcataatgattttgttgaaaaattctatgatatgaataaatcacaaagaaaaaaaccccacaatataaaacaggccaggcgcggtggctcatgtctgtaatcccagcactttgggaggccgaggcaggttgatcacttgaggtcaggagttcaagaccagcctggccaacatggtgaaaccccatctctactaaaaatacagaaaaaaaaaattagctggatgtggtgttgcaaacctgtaatcccagctactcaggaggctgaggcaggagaatcgcttgaatccaggaggcagaggttgcagtgagccgagattcctccactgtactctagcctgggcaacagagtaagactctgtctcaaaaaaaaaaaaaagaaaaagaaaaagaaaactaaaagactctcatcctactcttcttatcctcaatatgtggactatttaagagataaccaatattttaagactataaccaccacagaaataaaggtcccatattttgagctaagcagtgtctccattagtcttcataaaagttgtccaaaggagggccgggcatggtggctcacacctgtaatcccagcactttgggaggctgaagagggcggatcatgaggtcaggagatcgagaccatcctggctaacacgctgaaaccctgtctctactaaaaatacaaaaaattagccgggtgtggtggtgggcgcctatagtcccagctactcgggaggctgaggcagaagaatggcgtgaacctgggaggcggagcttgtagtgagccgagattgtgccactgcactctagcctgggcgacagagtgagactccgtctcaaaaaaaaaaaaaaattatttaaaatatcagtgacagtaaagaaaacacaaggaagaagccactcaggccgggcgcagtggctcacgcctgtaatcccagcactttgggaggctgaggagggcggatcatgacgtcaggagatcgagaccatcctggctaacacagtgaaaccctgtctctactaaaaatagaaaaaattagccgggcgtgctggtgggcgcctgtagtcccagctacacgggaggctgaggcaggagaatggcgtgagcccgagaatcggagcttgcagtgagccaagatcacaccactgcactccagcctgggcgacagagcgagactccgtctcaaaaaacaaaacaaaacaaaacaaaacgaaaatttatttaaaatgtcagtgacagtaaagaaaacacaaggacgaagccactcatcaccccccgacattcagccttgttgttatttttgtgcattcccgatgtctccccaactcctcccaccctggggaagtcagtgatcacccctttgttcctgtttgtctggggattggggcgtctgcccctgggggaattggggctggtggtggcagtgatggcagtggtgtttcaatagttctgccctagctgggtgggagacagtgaaaccagtcccaggtttgactgttgttggctgttttacttgacacaagtcatttcacttatctgagcctcaatatactcaaaaataaaatgcagataaacctatgaactaccagagattgttgtgaaaattaaataaatatgcacggtgccataccagtgtggtgctatgcaaatttaggtcctattattttagttcaaaagcttgggtttgaaaagtgaggtcccagggtaacaattggttttgtttagagaggcacagttgaccagttcaaagaaatgttgctggagatgttttgtcccagccctacctgggacatctgttgtgacatcccctgtgtcatgctttatgtcatgctctgtgtgacatcaagcgagtcagcagcccttcctgggacttcagtgccccagtttttgtcattctcaaacatgagtctatcccaaaccaccagagaatgagggacttgaatgcagggctatagcatcaggttttatctgggaggcaatggggagacagaaagattcaggctaaggagtgtggacattatctaggcaatggggagccccataaaggcttcaagcagggaagtgacgaggccagatgtatactttggtaagaagtagcctggcaagggtgtggaggctgcctgagctggcggcagggcccagccagaagggataagatcagggcccagtggaggaggggagaggaagctgtttcacagagcagctctgagaagctggctggaagctgaggttgacacaccctcgaagcacctttggggtttcccaagttgatgtaaaaaggaaatgattaccctcgagaaggcaggggagttcttcggccagtcctgcgtgcctttggcatgtgatcttagcaagtcatttaacctgctcaggcctcagtttcctcatctctgaacagggatgagaagcagagatgttgtgaggattcatgtctgtgcagctgggcctgggcctggtacagcccgtcctcagtggccatggctgctgttttaggattctcatccatcaagtgggaaggatgcgtttgtctccactgcgtgaaagggaggttgtaggacagccagaactttgatccctaggggctggagtgggagcttagagggatggtgtctttgacccgctcacgtgttcagggaaatgtgcagtctacagcgcccattcccatctctactctcctttcccacatgacaccccagcgggaggcaaacggacgccattatcacctccgttttataggtgagggaagggagaccgagaggaggaaggtgacttgttggaggtcacacagctggttgggtggaagcaggtgtatgtgacttagcacgtcagagctccaccttcaccaggactgccatgttcagccactgctctttttttttttttttttttttgagacagagtcttgctctgtcgctcaggctggagtgtagtggtgcgatcttggctcactgcaagctccgcctccccggttcaagtgattctcctgcctcagcctcccaagtagctgagactacagccgtgtgccaccatgcccaactaatttttgtatttttagtagagatggggtttcaccatgttggccaggctggtctcgaactcctgacctcaggcagtccacccacctcggcctcccaaagtgctgggattacaggtgtgagccaccgcgcctggtctaccgcattttacagatggggaggccggggccagaaagggaaagaccctcccgccctgcaacaccatgcatttgtggcagagccagaattagaacccaggtctctgacttccagaaccagtctctcaatggctaccccacttcatgga

SEQ ID NO: 436 - DNA, 6179 bp, Homo sapiens
ctggttcatacaacattggagtgtgtgaaaaaaaatatgcccgtggaaggtaaaaattaatgtgcctagaattcagttgctgaatgtactatgtaaggatcccaaatcaatatttccagtaagattcccaggtagatcatactgaaaagttgagtctcacaataatttaagctacaaatgtacaaatatctaggacatgctgggcatggtggctcacacctgtaatcccagcactttgggaggctgaggcgtgtggatcacaaggtcaacagatcgagaccatcctagccaaaatggtgaaaccccgtctccactaaaagcacaaaaattagctaggcatggtggtacacacctgtaatcccagctactcgggaggctgaggcaggagagtcgcttgaacccgggaggcagaggttgcagtgagccgaggttgtgccactgcactccacctggcgacggagcaagattccgcctcaaaaaaacccaaaagacaaaaaaacaaatatataggacataaaattcttttgttgttgtttttttgagacagggtctcactttgttgcccaggctagagtgcagtagtgcgaacatggctcactacagcctcgacctcccgggctcaagtgatcctcccatttctgcctcctgagtagctgagactacaagcacacgccactacactcagctaatttttgtattttttgtagagatggagtttcaccatgttgcccaggctgatcttgaactcctaagcttaagtgatgtggctgtctcagcttcttgaagggctgggattataggcgtgagccacggtgcctggtcctaaaattcgtatatgtactcatatatctttaatttgtctatggaaaaaaatagaagcttaattgtgaaaaaggttacattgcttttagacttcttcgacctttgcttctttcggaactttctatacacatttgctctttttttcacatatcagttaaaaccatgtgatgaaaatgtgatgatgatttttttatggatgtgaattatttaaattatttaaattaatagattattgttattattattattatttttgagataggatctcactctgttttccaggctggaattcagtagtgtgaccacagctcacagtagccttgatctcctgggttccaagtaatcctccacctcagcctcccagtagctgggatcaaaggtgcccactaccacacttggccaattttatttttattttttgaatttttgtagagagaaggtcttgccatgttgccaggctgttcttgaattcctggcttcaagcaatcctcccacctcagcctccccgtgctgggattacaggagtgagctaccatgcccggccaataggttatttttaagaacagttttatatttacagaaaaattgagcagataatgcaaagagatctcatttttcccttgctctgcacacatgctctcccctattgttaacatcttacatgaatatagtatacttcttacaactaatcaactaatattggtatattattaattaaaattcacaattttcaggtttccttagtgttcacctcattttcttttctgtaataggatccccatccagaacaccacgttacattgaattctcatgtctctttaggcacgtcttggctgtggtagtttctcagattttcctcatatttgatgaccctgacagttttgagcaatactggtcaggtatattatagaatgtccatctatcagaatttgtctgatgtttttctaataattagactgggattattggtttttgggaggaagatcacagatgtaaaatgctattttcattacatcatatcaagggcatatattatcaaaatgattcttgactattgatgttgaccttgatcacttggttaaggtagtgtttgtcaagtttctccactgtgaagttactctttccctccccacccctttccatactacactctttggaaggttcagtccacacttaaggactggggagttatgctctccattcatgagggtggattatggtatcagtcatggtcagcaggctggagactcaggaaggagtaagagttgcagtttgagtccaaagaccatctgctgcagaaccttgaagagccagtgctgcagatgaagtgcaaaggcagtccactgagtttcctcttgctcagaggaggtccctctttttgttccattcagatcttcaattgattagatgaaatctacttacattattgagggcaatctgctttactcaaagtccagcaatttaaatgtaaatctcatccaaaagcattttcacagaaacatccagaatgtttggccaaatatctgggcactgtggcctagataagttgacacataaaattaaccatcacaagtatctatataatttatttgaaattttgtccaggtgatatttgtctcttttattccatttatttatttatataatcatttagttatatctgcatgtactcatggagatatatatatctatatatatatatatctcttcaacttttaagttctggggtacatgtgcaggatgtgcaggtttgtttcatgggtaaatgtgtgctatggtggtttgctacatagaccaacccatcacccaggtattaagcccagcatccattagctgttcttcctgatgctctccctccccggcttgctccctccaccacaggccccagtgtgtgttgttccccactgtgtgtccaactcatggatatttattttaaattttggtttataatccaatactgctctattttgtagttccagctttggacattgggaactttttcatttgactcctgtgaccctttaacatatcaccacgtgttttttcttttgttttggtttagcacttcctcactttctgggactgcaaaatgcttgagactcacattgtacatttcatgtccctatcctggaatcagatatttctttgaggagccctagttcctttgattggagaatagtgtcctatgaaatttgataatttgtattgtcattttcattcagttcaatgtatttttaaaaatttccctttagacatctcctttgactcgtggattatttaaaagtgtgttgtttagtttcaagcgtatggagattttcctgtgttatttcttttattaatttctggtttcttttcactgtggttggagaaaacgatatgatttcagcaattttaaattagtcgatgttatttaatgtcccgagatatggtttgtttcagcatatgttccagaggcactggaaaagaatgggtattctgttgttgggtggagcgttctataaatgtggattggatccttgtaattgatgatgtttataagttctatgttcttgctgattttctgtgtagttctgtcaatggttgagagagaggtgttgatgtatccacctataattgtatatttgtcaattcctctttcaattgtatcagttttgctttatacattttgcagctttgtttggtgtatacacatttggggtcactttacaaggctctgtttatttttttttctgtctagtttttttgtttctttgtgggtttttttgtttgtttttgttttttttttgtttttgtttttcagacgaagtctcgctctgttgcccaggctggagtgcagtggtgcgatctcagctcactgcaacctctgcctcctgggttcaagcgattctcttgcctcagcctcctgagtagctgggattacaggtgtgcgccaccatgccctgctaatttttgtatttttagtagatatggggtttcaccatgttggtcaggctggtctcaaacttctcatctcaggtgatccatccacctcggcctcccaaagtgcagggattacaggtgtgagccaccacgcccagcctttttttggtatttttagtagagacagggtttcgccatgttggccaggctggtctagaactcccgaccacaggtgatccgcccgcctcagcctcctaaagtgctgggtttacaggcgtgagccactgtgcccagccttttctgtctagtttgtttctgttgctcagttgacattttctgttgttttgtcttccaattcactaatctctctatccccttcattctgctgagtccatccactgagctttttattttggttattatattattcaattataaaatttccattttttttttttttgtctatctactgtgttgaggcttctttatttaagaaaaaagtgatacatgatgtgggattaaaatcaagaacatcattgaacttcaccttccctccaaccagttgccccaaactcccctgcccccaccctttgtgttcccaattccttccttagtgaatgaagaacttaatcccaaaagccctggcacaaactccaggtgctctttccctagctcctcccctccccctgtcccccattcctagaagggcaggcacctcagtttgaatgcatgggagagcccagagtggtgacggagacagggggaaaggcttccccctcagggaaagggaccgaggagtacagtgcagtgaagtgagggctcccatagcctggggtaccaaaatggggccctggggccagaggaaaggacactggtccccctgagaaaggagacccaacagcctcaaaatcctctcgttgtgcatagccactgcttgatcgcttgcccttctggcgccggttacagaaccacactcggaccacatccttctccagcccaagctgctgggcgatgtggctgatctgctgcagtgtgggtttcgggcaccgcaggaacaaattctccaggttgcctctcacttggttctcgatactggttcgctttctctttcgggcctgcacgagggtttctgctttgcatatctcctgaagattttcattgttgtcagcttcctccacccacttctgcagcaagggccgcagctcacacatgttcttgaagctaagctgcagagcctcaaagcggcagatggtcgtttggctgaacaccttcccaaatagaacccccagggtgagccacatcggcctgtgtatatcccagggtgatcctcttctgcttcaggagcttggcaaattgctcgagttctttctgcagagctttgatgtcctgggactcctccgggttttgctccagcttctccttctccagcttcacggcaccagaggggacggtgcagggctccggggaggccccatcggagttgctctccaccccgactcctgcttcgccctcaggctgagaggtctccaagccgtcttggggcactagccccactccagtctgaggcccacagtacgccatccccccgcagaactcatacggcgggggacatgggggaatcccccactcctcagagcctggcccaaaccccggcccgattcctggccctccaggagggccttggaagcttagccaggtccgaggatcaacccagcccggctccggcccccctggcccatcacctccaccgcctggagggggtgagaaggcgaaatccgaagccaggtgtcccgccatggggaaggaaggcgccccaagcatggtgaaatcttggtttttctttatatcttctagttctttgctgaaactttctagtttttcatttgtttcaagcatgtctgtatcttcttgttgaagcgtttttgttttttgtttttttttaatcatggctgcttttaaatctttgtcagataattctaacaattttattatcttttttttttttttttttttttgagacaggttctcgctgtgttgcccaggctggtcttgaacttctgggatcaagcgattcttctgcctcagcctcccaaagtgctgggattacagatgtgagccaccgtgcccggccccatttttgttgtcttgattgtaggcatctattgattattatattttattaaatttgaaaacttactggttcttagcataatgacttattttctattgaactctggatatttttgcattatattctcagagtctggatcttatttaaacatgttttcgtaatagctgggcttttcagatggcacttcagcaggagaaaaggggccctgcctcattactgcctgattgaggtagacttggcttccttgacacctgaggggcaggggctcctggttgcatctgagtgtggaggggagttccagcttcca

SEQ ID NO: 437 - DNA, 6203 bp, Homo sapiens
acctctctgatgtttagaatacttagcatcactcagaggagacttttggattgtttgatgaagctgaatcgttgatgaccagaaagcatgctgtggtaactctccctttttggacacatgggagaatggtactttcctcctccatttgaagttaggcatagccatgatacttgcattagtcaccagacaaaacggtagctgacactttcagtcacacacatgtttttggtgtttttttaaaattgatttttttaattctctactactgtgacattcaaggaaggcacatgcttttaaaagccagtgccttattattattattattttttttttttttttgagacagagtctcgctctgtcgcccaggctggagtgcagctgtgtgatctcggctcaccgcaagctctgcctcccgggttcacgccattctcctgcctcagcctcccgagtggctgggaccacaggcgcccgccaccacgcccagctaatttttttgtattttagtagagatggggtttcaccgtgttagctaggatggtctcgatctcctgaccttatgatccgcccgccttggcctcccaagtgctgggattacaggcatgagccacttcgcccagccaaccagtgccttattaaccatgttgccctttgactgctccaacaactactgaagcatgtgtggagagaaagccccattagcctgggtccctgagaaaatctgatgaacagagtccctttattaatccatgttgaacatgtagggttaatgagaaatactcatatgttacatcactgagatttttttttttttttttgagatgggagttttgctcttgttgcccaggctggagtgcaatggtgcaatcttggctcactgcaacctccgcttccgaggcacaagtgattctcctgcctcaacctcccacgtagcttggattacatgcatgcgccaccatgcccggctaatttttttgtatttagtagagacagggtttcaccatgtcagtcaggctggtcgtgaactcctgacttcaagtgatccacccacctcggcctcccaaagtgctgggattacaggcatgcaccaccatgcccagtctgagatcttaatagttgtaacttgggtgctctttacattcttccacaaatcagtatgatataattggataaaataccatttcccagtaaaagaaaaaaaaaaacaggacttcttggcaaaagtgctggtttgaggtctagagcaagaagtgtacaaactgaacctagaacattctgtaataaagcaaggaagactactgaaggtcttataaaaaggtgacaggagccaatttaaagaggtttccaatggccagatatggaacaatttgagaactgaaaaaaaaaaaaaaaattcaggaaacaactccttctgcaaaccagtaaataaattgggagaagggtcaaggaaagcatttattctgtcttttctgtatagaagtcccacatggtaaccagttgatgtggaaagatctatacagaaaagtcttggcgatcaaatgcagaaataatattagaattacagtacaatcattttgtaaaccttaataaaatattgaatctaggcaatgattatcagtagctgctaaaaattaccattatgtgaaaggctgatgggaactttataatgaaagaaagatacaacacttgaacccactgatcaatcttaatatcacaaaaagatattgtgtgcttcctgatgtgatacaatagaaaatacagaataccacctatactgttgccaaaaacttgaatctgaacctgataaagctactagatctatttaacagcttacaagaaatataggtgactgaagaacacattaaaggaaacaaggctttaaccagtaaaactgagattgtgggaaattctacagctaaaataatctggttttaagcaacaagaaaaaaagaaagaaactgacagattgaaagatgtagggctgggcacggtggctcatgcctgtaatcccaccactttggaaggccgaggcaggcagatcaccagagtttaggagttatagaccagcctggacaacatggatcaccagaggtcaggagtttgagaccagcctggacaacatggtgaaaccccatctctactaaaactacaaaaaacttagctgggcgtggtggtgggcacctgtaatcccagctacttgggaggcagaggcaggagaatcacttgaatccaggaggcagaggttacagtgagctgaagattgcaccactgcactccaggctgggcaaaagagtgagactccatctccaaaacaaacaaacaaaacaaacaaacaaacaaaacagatgtggaccttatttgggtcagaattcaaatgaactgtaaaaaaagatttatgagacaactgggtaaatttgaacattcactggatgtttttgttttgttttgttttgttttaggtgtgataacaatattgtggttattcttttgaggacgtgagtgtccttatcttttagaagggtcaacaaactaatgctggtgagccacctgtatttgtatacctaacaaactaagaatgttttttacgtattgaagtaattgagagaaaaacaatcaaaggcaatcttctaacgtgaaaattatatgaaattcaaatttcagtgttcacaaatgaagatttattgaaacacagacatgctcattcatttatttactgtctatagctgctgtgcactacaactgcagagttgagcagttatgagagcaaccatatggcctgaaaagcagaaaatttatttactatctgatcctttacagaaaaagtttgccaacccctgttttagagccacataatgaaggatgtatttataaatgaaacagcagaatatcagaaattttaaaatgatgtagtggaaggaggggggaagatgaaacaaaaataagatatctctacttctgtgtacatttgatttctatataaaattttaaaaatctgtatccctctgtattgaagacttctcacacaaacacacatacaggcacacaaacatttaaaaaattctttctgtttttggtcgggcacagtggctcatgcctataaacccagaactttgggagactgaggcgggtggatcacctgaggtcaagagttcgagaccagcctggccaacatggtgaaatcccatccctactaaaaacacaaaaatgggccaggcacggtggctcaggcctgtaatcccagcactttgggaagtcaagttgggcagatcacaaggtcaagagatcgacaccatcctggccaacatggtaaaaccctgtctctactaaaaatacaaaaattagctgggtgtggtggcgcgcgcctgtagtcccagatactcagaaggctgaggcaggagaactgcttgaacccgggaggcagacgttgcagtgagccaagatcacgccactgcactccagcctggtgaaagagcaagactctgtctaaaaaaaaaaaaaccataaaaaagctgcgcatggtggtgggcacctgtaatcccagctactctggaggctgaggcaggagaatcgcttcaacccgggaggcagtcctggcagaggctatagtgagccgagatcacaagatcacaccactgcactccagcctggtgacagaccgagactccgtctcaaaataaattaaaattaaaattaaaaaataatttaaaataaaaaattatttttgttggccaggcgcagtggctcacgcctgtaatcccagcaatatggaaggccgaggggggcaaatcacaaggtcaggagatcgagatcatcctggctaacatggtaaaaccctgtctctactaaaaatacaaaaaaattagccgggcgtggtagcaggcgcctgtagtcccagctactcggcaggctgaggcaggagaatggcgtgagcccgggaggcagagcttgcagtgagccgagatcacgccactgcattccagcctgggcgacagagcgagactctgcctcaaaaaaaaaaaaaaaaaaaaaaaaattttttgtttttagagacagggtctcactctatcacccaggctggagtgtggtggtgtgatcacagctcactgcagcctccaactcctgggctaaagcaattttctcacctcaacttactgagtagctgggactacaagcatgcaccaccatgtccagctaattttttaattttttgtagagatggagtcttcctatgttgctcaggctggtctcaaactccttgcctctagcaatcctcccgtcttagcctcccaaagtgttgggattacacatatgagccatggtgcctggcacattatacaaattgtttaaaggaatttaagtgtttatgaaacatgttccaaactatttcatttatatttttaaaaaagtacacttactgcaccgattaagcatgtcattctacaataaagaactgttaagccacacagaaatccagaattatcacagaatcaggaatatacacaaatcacagaaaataatattcaaatatattaaatactcctcaataataccagagccctaaacacactgctctgggtcttcaattaaatacttttagttttctgaataaatgcattcattgcatgaaatagttaaaaaccagactcatgaagtatattcaaattatatagcctcttttattactgaacactttactttttttttttttttttttttttgagacagtctccactctgtcacccaggctggagtgcagtggcaggatctcggctcattgtaacctctgcctgccaggttctagccattctcgtgcttcagcctcctgagtagctgggattactggtgggcatcaccacacctggataatttttgtatttttagtagaggcggggttttgcaatgttttccaggctggtccgaactcctggcctcaagtgatctgcctgtctcaccctcccaaagtgctgggattacaggtgtgagccaccgctcccggccaataactgaacagattactttttacatatataagcatatcaacctttactgatcacaacaaatttgtaacagaatttttacggaactaagatagcccaaaagcgtttccattaccaaaccacagatataggtaaaacaaaatataataaaaacttgagaaaatggatatgtaaattttactttcaaagggataaaacttcaaatagaaaaacaccaaagcattattatactcaccagtatttttgtggccttttagaatataaagtggcattggactgtccagtgagaaaatgcatatattgtggtcatttccaccggtggcaattaggccatgagggtagatgtcacttgagggtatgatgcatacacaagatacaaaattggaatggccactcatacagtgcatttctgtaaagctcctgtttggactggaaagacaagataattaatagatacatattcgtaccctgacttagcctaggacataaactgtcaaagcactcattttcatttagtgtctagacaaactttagagtatatactatcttaagaatctattgttttaaaattgaaccttacataattcatatgaactactatagagaattacatgagataaagagaagtttgtttagtgtttctttgataagaatacgttaacatagagaacaaggaaaaaagaaagggcaataaataatcatgactgggttttttctcaatctccatcttcacttctacacattagtgactgttaccctaagaaatccctggttaaacgaaacatacatgcaattaagataatgaaatttattattaagaagacctaaatatactgaggactttttcacattatgaagcattgacttagagcccagtagtatagtacagcatgtgtttctacatagctagaacaggggtgtcaaatcttttgccttccctgggccacactgaagaagaagaattgtcttgagccacgcataaaatatactaacactaatgataactgataagctaaaacaaataaacaaaaaaaccccacctaatacagaaatatataaatggctagagtaatattatataatatataatgttatatataattatatatatcaatgaacacagtacattaataattgcactgggattaaaatgattaccagtttgtgacatgtatcaatcacttagcatcactgccttacttaacaagt

SEQ ID NO: 438 - DNA, 6266 bp, Homo sapiens
aggaagaatgagcaaattagaaaaagaaagcctagagaaaagaatgaagaacatgaatctcatgttaaataacaaacacatcacacccggccctccaccccagcttccacctccagccctgccaactgaaaactgtcatttcctggcagtgcttaaaacaaagactctagataattccccagggactcaccggcaagctgctggtcccacttaccctgccgcacagcagacatcagctgtactccctcttctgccccgtgaagacctttggctgcagtgccgccgctcattcaagtgaccgagatcctctctaaggcgccctcccccacaccccccgccccgcacagccctctggacgccttgaagtacggagccgcagccttatcctaaagaaaggcacagctctgacaagaaaaggcaatccgggagcctttccctagccgtttaaaatgaaactcaccgttcttgctcccgtgagctgttgcaaataatcttgaatctcgttagtgtggttggtggctgtgatatcgacaaattccagaagcccttgtttgatgggcaattgactgaggatctcttgggccctcctgcagtacgggcaggtgggcttgatgaacacaaccaccttcccaggctggattttgcagttcacaaactcttgagccatgccgatgggctgcggtctccccgggaagaatcctcagttgcaggtattgcttggggtattgagccccgacccagccagttggctcctatttaataaggaacctccctggaggcggagtttgcctggtagcttgctcgagttttaaagggacagcttcgaagacatttccatctggtatacttcactagttagcaatgcccaggaatgcaatacttgctatttaatcattggtagctatgaaagacactctgggtatctttgttgtccttggacatttggggagtgcctgcccattggcaatgatcagagtttagtcacctctggggaagcataaagtgcttactcacaaaggggctgaggaggcagtgacttcttagagcaaattcttgttttccctctaggagatacagttgtattttaaaatgcaaacagaatcacttaagaaacagaacacttggaaatctctttagaagaagtgaaattgaaactgtgactttgcactcctcatgaaggttgctctcacagcattttgcttggactgtatggtgggtgtttgttgttgtgatctttttaatggaattcattctcagtatttaaaaatctggaggtctcacaaaacaattcggacttaaaacttctctctgaaaagtcaggtcgggcaatacagagcttgcaccttttagtggaagctgctggggctgacagctgttgccccctttgtatagggcaagtagtggctttggtttgccacaggtcccaacgacaggcccatgcctgagacaccggcttcaccccataaccatttgagttggtaacccttgaacagcagtttaatatggaggcaaattccaacacaatccttgatacaaaactacagatgaaatgagaatctttttttctggttgagcctatgtttgtgaccctctgcttttaactgtttgtgaggggaagtagtgttgtaactcagacaccacattcacttcaagtgttataagacacgggttgtaacagtaggaaatctttcgctcttccccagggtgcccattctccttatcccgcaaagcaaagtcctctactcctgggtctagttccggccccctctagtgtatggtagcttaaataaacaaatcaaggaaaaactatgtcctttaaacgtgaatcatcctttccccaggaagttttatggtgaaaccagagtatcttcaaagaggcggggccaaggccagagctggacaccacgactgccacgtaagaggaatcccaagcatactgcgatcaagggaagggaagaaaatccactcccagaagcagctttttactgtgactctcatcgttactagaattaaaatggcaaaatgagaaagccagattctgagtcacggagggggagctaagtgacagctctgtccagagaaaaggatgtggcagggctgggaggcccctcacgtggtcagggctccggacttcccacttcccacttccctccaaagtaggctctgccacagagtctgagcctcctctcttttttcattcttttacctcagaaccctgtggccaggctccttccagaggcccctgccaggaggtccagggtctgtttcagggccctcaggctgttgccttaagttccctcagcctgaggtttatccacacgacttgcacctgctactcactcagagcctttctcttctccggtctgttgttggctcctcccttcctggtgcctcagcctgccactgtgttcaagttaaaagccaccaccaccaccaccactccccatttcctgctttcctgcctctgccctttcatgaaatttactgtctgtacctttctcacctccattctctcattttgttgttatctgaccttgtcaaccattctgctgaattgttggcagacactaatcatggcctctatgtcaccaaatgaccatttagctaggtatcctgaccttttgcaaattagtcacctgccccaagaggctgggatccagggagactattgtctgcctctcactcagtcccggggactgcctggtgtctgaagccttaggacagatggccataaggcacaagctaaaggcaatttttttgtgaggcaccatgtggaaaatgggagacaaagagatggcaaagaacgggtgtcctctccatttctcagaaaatgctgtggcttcaactcagtgaaaaatgacaagcatagaagcctctgctgcattgtacagcaggagctgaaacccagcatggaccttagggcatctcaatggaaagccgccatggggactgcagatgcgtcaagtgctgtggatggaaagagggtgtgcgtgtggactaacacgtgtggactctcctttggcttgtgtgagacactcccaggcactctcagaaaatacaccttggagggtgggaagtgagggcattttttaggggagaatcagtcctgctttacagatggttggcaacaagctagtgaaatatgtgtggttactctttttttttttttttttttttttgagacggagtctcactctgttgcccaggctggagtgcagtggcacgatctctgctcactgcaagctccgcctcccgggttcacaccattctcctgcctcagcctcctgagtagctgagactacaggcacccgccaccatacccggctaattttttgtatttttagtagagacggggtttcaccgtgttagccaggatggtctcgatctcctgacctcgtgatctgcccacctcagcctcccaaagtgctgggattataggcgtgagccaccgtgcccggccaatgtgacttcatttgtactcacaggctgatgagggctgcaaaaaatgtggccacaaacgaacattcttcagggtttttccttacccactgtgcagggtttgaccttgtagatcactgcaggcctctggaagttctcttcccactgcccattgcagcatgatctttttgctctttctattggatattgtctcagtgtctttgttaagaattttgcctacacatatggtctatcttggggcttgatcttctcattgtgtacacacccactccttgagaggtcgtagctccacacatgactccagctgtcagctttttactgatgagcatcacgtttttccttatctggacctctctcctaagcttcagggaaggctatctcattgcctactgaaaagacccacctggggattccttaggcctctcagcctctaggcagccaaaactgaatctcccctgaagccaccctctttcctccatacctgctcattgagcctgcatgcaccttcatgtaccttttcggccagggcggaaacctggcaggcatctgtgctggcctctgctttcacttatgcatagtggccaaaccctaccaagtttgcctcctgagtgcctccctggtctgaacacctgactgctcctgctgctctagccctcattagttcttcactccctcttgtagcacctccaccctcgcctcactgcctactccacactgctgctggggcaatctttaaaaatacagaacctatcttgttccctcttaaaactagtccatgggctgggcgtggtggctcatgcctgtaatcccagcactttgggaggctgaggcgagcagatcatgaggtcaggagtttgagaccagcctggccaatatggtgaaaccccatctctactaaaaatttaaaaattagctgggcgtggtggcgtgtgcctgtagtcccagctctttgggaggctgaaacaggagactctcttgaacccgggaggcagaggttgcagtgaatggagattgtgccactgcactccagcctgggtgacagagcaagactccaactcaaaaaacaaacaaacaaacaaacaaacaaaaaactagtccatgtttccccaggacaaaatccagatttccctgtggggatgtggccctgtgtgatgggtcctccctaccttgttcatcgtatcccagcctccccaccaacattttagagacaggaggcagccaagggtccctggtgaaaccctgcctccaagtctaaaacaacctgaaggctgaaaaactggactgctgtcctagtactttgggaggccaaggcaggtggatcacctgaggtcagcagttcaagaccagcctggccaacatggtgaaaccctatctctactaaaaatacaaaaaaaattagctgggcatggtgacaggcgcctgtaatcccagctacttgggaggctgaggcaggagaatcacttgaacccaggaggcgaaggttgcagtgagccaagatcgtgccattgcactccagcctgggcaacaagggcaaaattctgtctcaaaaaataccagaaacaaagacaaaaattggactgctggtcctggatgaggcccaccttttcctgactgattctttctgaataatgcccacctgtgcactgggaaggcggaatggaactttgggaagtttgcaccgtttgcagcgaggaggagcctggcctctcctgttcctgtgtgctgacctggaactcaatctgtgagccgggaaacctgctatcaggactctctcttgctttgctgagaattatttttcctttttccttttcatccaataaattccattttcctcacccttctgtgtgtccgcaagcctaatctttcctggtcgtgtgacaagagcccagttttaccggaactaaggggaaagttctgcaacaatttctcctttgctccaactgtgtggactctgagccatttcgtcattgctgccactcacactttggacctgctgctccctgtgcccagggtgcccttcctcttatttctgtgtggctgactcctgctggcccaaagggactcagatcaggatggtgtgttagcacctctaggaagtaccccaaaacacacacctctttcccccatgggatgggtgcctctccatggagctcacatgtcatactgcgccctgactcatcacatgtcattgttcctttgtattaattttctgtcatctacagtgagttccttgagggcagggaaagggctttttatctctgcattaccagagcccaacagatacacactggttcttatccatccacccattcatccaacaaacatttattaatcaactactctcagccaaacacaaacatccatcatacagccccaggtcttaggagtttatagtttagtgggcaatataaacaaggaaaatggacacaagtgttagaaagtgttctagttaacagaagtgtgtatgggcattaggttaaccaaagggagtagtcactcccacctggagggtgactggggaaagggcccacatcaaaggagagctaggctgaatcttgagggataagaagaagcttctgagtgtacaaggaagggaggggcattgcaggcagaaggagtaggaaaaggaagaacaacataaacggtgctcgacattgaacatggatagagcattaggggtttgcgtggggagaggagagacaactggagagcaggcagagaataggggaactttaccacactgcagagggaggagttcacacacaggcaccaaggagctggaacaggcatactttatatatggatag

SEQ ID NO: 439 - DNA, 6432 bp, Homo sapiens
tttctgcagataacttttctcagatcgaattttttggctacattgatactcttcggctctgtccttgccagaagttcggaaggattccagcgccccacaccttgcttgattcaccctcatcccctcccctaactggagaagccgctgggtcccgcgccaggctcgcggtggcttcagagtagcaggggagcaggcggctgatccggaggccagtgtggggccggcaagcggtgactgtctccagaggagcaaaggagccgagtcttgtttttcttggatcaggtttgggacttttattctgtctgaccatttccaccacttgcctcacaagagtctctgtctcgaagcacaggaccgaagcaaaatgcctaatgaagcgtgcctgaggaaggggcaggggcttgcaagtgacttgggaagaaggactggggcgaagggagaaaggaggttacgagttcgcacgttctcacaaaaccatttgaaaacatgagctggagacgccaaattctgggacccacgaaaggctttggagctcgctcgggctcctcgaagttgggcgtgcgtcgcagaacagtgctgggcgctctctttcagcattttcggcttttttcaagcccttgcgtagggtcgggaaggccgtgggtgggctcagtcaggctttaggtcgccaggaacccggctggtcctctctcgacttcttagcgtggggtcccgccggccctgccgcccgtggccgccgaagttcccgccctcgccgagggccctcgctccggagtggggcgcagacgcggccgccggcccgcagtcccccgcaggtgccgcccaggactagctgcccggcggaggccgagcacgcttggcggcagctgagcctccaccccaagccccagccggaggggcgcgtcccctgtcctcctcccgagcgagacgaacgctcagcagctcgttccctgggcgccaagaccgatttccaagtcgcccactttccccctcgagggagctgttggcgcttctccagaagcctcctcggctcccagctccagcccctaaaataaaagcaccttgccagagagcgggggaggggagcagctgaacgaggagaatgaaaatactgggagaacgaccccattctccaggaaaaggtaatgaggggaagtgaaacagtgtgaacttactcggaaatgcaaaccgagttcaactcacccaggagcaaacaaacgacagcaagacaaatcagccaccgcactcgcggcttcccagaaagggcctcatgaatgagaatgggttgctaggtttccttccctctctcctgacaatcgcttcccacaagacttccaccgccgaaagaatacaggccgggcctggtgactgcggagtgagggaaccgcgccaggcccacgaggccgctcgcgaccgctcccgccttcaggaccctggagagcggccgccgcgcccctgggacccacgcccaacccagaacacccgcgctcgcctcccgcgcctcaccaccccagcactttattcgctgcttcccgcctccaccttcattttttttggcaaccaccgctcttgtttttcacagacagattaaattgttttttgtttggcatgagggggtgtttggattggccgagctacattccggtttgtaactacactaaacgttagtgtaccaagaaactaagagcgtctcaaagatgacagtctgaacgtggcaggtgaccttaaaaagccactgagttcaacccctttataaatgaactcaaaaaataaagagacattcccaaggttagccattaagttagtggcaaggttgagtgtagaaccgtgggtttctgacttctaaactagtgcttccctccactttccaaaagaaaaaaaatatctcattgcttaggtctcctaagcaacaagtggaaggtggaaaggccggtgttcccgggaataagaaggacacatggagtttggaaaggaggtctgcagagggttcacttgtagtagcagccctaacatggaatcccggtgtccccagctccacgcaacatacctacagccgcactggccagtccctttttccaaccagcctgtggagggtctgaggcccttcagccaccttcagccactatctggaccttccatagacaacaatcccaatagaatctagtagccaaggccaactctgtgcctctggcaggcagagccctgggcacttagggagatgggaaagggcagggggaacaagggaagaccagagaagggaggggaagagcaacagttacaaaagtgaactaagattttcatccaaattctgaagaaccaggcgatgtgaacacagacccttctgcataccgcatgtcacattcagcgcgcatggtagtcccctgggaatgttaccatgcagattccgatgcattggctgggtggggctcaagagtctttatttctaacaagctcctaggtgttggcgaagctgctggcctacggaccacacttcaagtagcacggagttaggaaatacaggagtgggaggggaaagaatctaactataggcctttccttctgctttcaccgaccttctcttgcacccccaaagtaacgcttcaaaattctgtagtaaagagccccatctaagcggccggacaccacagtaaccgtatgctggttttgtttctctctccccaccccagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccggtgagtaccgtggtctccactacgccccacacccagcctccccaggacaccagcctctcccgattcttcctaaccccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctccagggaactaaccccgcggccccaccgggtcccactcccgaagggacgctgcgggctacggggacacgcggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattcacgaggtccgagcacgcagtccagcacactctagtctcgctcggccccgcgcgccgaggggaggcgatgacacagagggcttcgcggacgccctctacgcgcgcctggcttcgcatccacactcttgggacttgctaatgcggggctggagcagtggggctgcggccggggtggaggtcgcgccccgcgtggggcctcgggggtacccctagcacccgcggcggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgccgggagggggtctataggcgccgcgacctaccccatctccctccacgcttgtgggggagtgagtggggaaggggctttgggagaggcggcgcgcgggcactgaggtgcatcgtgagcttcccggacttgacagcatcaaaggaaaatcctggcgagcagccagggccagcgagcgaccccagcagcagggacgcggccgtgcgagagctcgcggacaggcgagggggatcccaggggagcagctgctgcccacgggccacgggcgatgcacggagtggagaagtgaacgtggtctacaggatttctgtccggaaggtggagagcgctacaggggaatctcctcgattcctgtccgtctcgtaacttggcaaaagctcgcgccactgccctccggcctgggcgacagagcaagactccgtctcaaaaaaaaaaaaaaaaaatggcaaaagcctatcgctctttgtcgaactccccacgttccccagtcacctggctggggttcgttggtgtcaaaaccccagccttggtgccctcggtgccagcaggaccctcgcccactggctagcggaattaggcacctgcacgcgggctcctcattgccccggagtgtggggaggaaggggcttctgcatcagtctccagccaccctccttgggacacaagtggcagggccctggcgtggcttggcttcatttcatccctagtggctccaaaccgtggaattgactaaacaaatgttcaaattcgcaaaacggtctgacttccgccccaaacttgacaa

SEQ ID NO: 440 - DNA, 6497 bp, Homo sapiens
gataaaagagaacaaacgagcgtggataaccagtgaatacctgagacacacaggtggatggatgggggagggagcccatgtctgtgggatgctggggccaggaagcctgctctccagccctcaccatctggcctctgtgggagtcaggaagtgtctgcacagatgttcgccagacgcaatgggaaaaccaggaggcatcaggtggagaggcagccccagggcacctgggcaacagccacaagctctcaaagagcacaggaagaaatcatgtctttatgcacacgtgtgtgcatgtgtggtatgtatgcatggtgtgtgcacgtgtgcattgtgtgcatgattgcattgtgtggtgtgtatgcatggtgtgtgcacgtgtgcattgtgtgtgcacgattgcattgtgtggtgtgtatgcatggtgtgtgcacctgtgcattgtgtgtgtgcatgcgtggtgggtatgtatggtgtgtgcacgtgtgatcatgcatgtatggtgtgtatgcatggtgtgcgcatctgtgcattgtgtgtggatgcatgtgtggtgtgtatgcatggtgtgcacgtgcattgtgcatgcgtggtgtatgcatggtaatgtgcacgtgtgcactgtgtgtggtatgtatgcatggtgtgtgcacgtgtgcactgtgtgtatgcatggtgtgtgcacgtgtgcactgtgtgtggtgtgtattcatggtgtgtgcacgtgtgcactgtgtgtatgcatggtaatgtgcacgcatgcactgtgtgtatgcacggtaatgtgcacgtgtgcactgtgtgtggtgtgtatgcatggtgtgtgcacgtgtgcactgtgtatgcatggtaatgtgcacgcgtgcactgtgtgtatgcatggtaacgtacacgtgtgcactgtgtgtggtgtgcatgcatggtgtgtgcacgtgtgcactgtgtatgcatggtaatgtgcacgtgtgcactgtgtgtggtgtgtatgcatggtgtgtgcacgtgtgcactgtgtgtggtgtgtatgcatggtgtgtgcacatgtgcactgtgtggtgtgtatgcatggtgtgtgcacgtgtgcactgtgtatgcatggtgtgtgcatgtgtgcactgtatgcatagtgtgcacgtgtgcactgtgtgtggatgcatggtaatgtgcacgtgtgcactgtgtgtggtgtgtatgcatggtgtgtgcacgtgtgcacggtgtgtggtgtgtatgcatggtgtgtgcacatgtgcactgtgtatgcatggtgtgtgcacgtgtgcactgtgtatgcatggtgtgtgcacgtgtgcactgtgtggtgtgtatgcatggtgtgtgcacatgtgcactgtgtatgcatggtaatgtgcacgcgtgcactgtgtgtatgcatggtaatgtgcacgtgtgcactgtgtgtggtgtgtatgcatggtgtgtgcacgtgtgcactgtgtatgcatggtaatgtgcacgtgtgcactgtgtggtgtgtatgcatggtgtgtgcacgtgtgcactgtgtatgcatagtgtgtgcacgtgtgcactgtgtgtggatgcatggtaatgtgcacgtgtgcactgtgtgtggtgtgtatgcatggtgtgtgcacgtgtgcacggtgtgtggtgtgtatgcatggtgtgtgcacgtgtgcactgtgtatgcatagtgtgtgcacgtgtgcactgtgtgtggatgcatggtaatgtgcacgtgtgcactgtgtgtggtgtgtatgcatggtgtgtgcacgtgtgcacggtgtgtggtgtgtatgcatggtgtgtgcacgtgtgcactgtgtgcatgcgtgtgtggtgtgtgtgcatgtatgcatggtgtgtgcatacgtgtgcagcagcacctggtcccatctccagtgcccagcagcatcacacgcactttggtgctttataaatgcatggtcagtgaggctgacagcaccaagctgtccctttaccataacacctggaatagtcacctgtgataagctatcacataggaaacatttttaaaatttcattctcattattttctgtaatcttgagaggttccaatcaacatttattgccttattctttttatctcattcctttttgaatgtgtttatctcctaagattttatctgtgatggagatgggatgcctgtgaatacaaaagttgcagtggtggcaccagggtgggggggtgcggccggggccaccatggtctcccctgagagggggtgctgtcttaggtgccccaagaggccctcgggcagcaagcgtggggtgctgccaaaatacagctccccctgggtgggcaggacacacgtggcctcctggcagacaggtgcctgggtgagcccgctgctcctgattagtcatgaatggcacctggtctgggcgacagtcacccgcaggaagccctgagctggccaccatcaccctgggcagtggctcccggggtgccaacaagacctgggcccctcgttctttggtgctgagagccccagctgaggctgtggaggaggccctggacctggtctggtgtctgtcagaggcaggtgcccagtcctttgacttgcttctctgaattgtcataattgtgctggaattgtgccagaaactggtagtgataacagctcctggaaggcctgtggctgctgagggctgcctggtccccctcaggacggccgggggagcctctccagaagcaccagctttgtctgcaggtggacgttgaaggggggcagttgggtcaggttcagactcacacctgtggtccccacgacgctggccaggacccggtgtgtgtccctgtagagggccaggagcccaggggccgcctccatgaggatgtgtgtgtatgccagcatgcctgtccccggctgcacatcctccctcttgtcgtacctgtgggatgagagctggtggtcctgcccagggcccccacatcgccctgtcccccgcccccaaggggccctcacatggcctctgggagggccgtgctgtgtgtggatcctacctccaggcgctgttgacttggagaaaccgagacacacctgtctgggcggctgccacgtcaatgtgcagaaggacgtctaggaaaaccaggcctgccgtcagagcccagccctgcagtcggagccacagcagtccccaggcagtgcccccagcacccacctgtctgggggggcaccagctggtgcagcctctgcattgcgacgccacctgggtagttgaaatgggacacatacagggccgtggctgagtaggcggcattcaccacgaggtgtccgatcacaagcagagaccccgctttgtacagccaagactttttatagttattcagcctgaaaaaagaatggttacacatcataggcagaacgtaatgacaataaaattaatctacctacaaaacatactaggagcataacctgctgttcaacttcaccaagtcataacaaagagttcaccaccaaataaaacagagtcagtaacccgtaaaagtggttaagatactgcctcaagaattgtctgtgaaattctacccaagatgccaatttaaaatttagatgagattttaaaatatatatatatttttgagacagagtctcgctgtgtcacccaggctggagtgcagtgccatgatctcggctcactgcaacctccgcctcctgggttcaagtgattctcctgcctcagcctcccaagtagctgggactacaggtgcacgccaccatgcccatctaatttctgtatttttagtagagacaggctttcactatgttggccaggctagtcttgaactcctgacctcgtgatctgcccgcctcagcctcccaaagtgctgagattacaggcatgagccactgcgcccagcctaaaaatatattttcaaacaatcccaagtgactgtgtaggtcagagtgccacccgcgcggccaagcccactcccagcaggtctgagtgaactctctgggacagggtgccgccggttctctcacaatcgactatgccaatctcaggatcctacggcagagttagcagctgccacagacagtgtggcccacgaagatgaggctctttattagctggtccttaacggaaaagcttgccaaccctggtctaaacgccctgaacccccgatcaagactcactctcttccaaacccaccaggctcctcggagccctcttctccacaggccctgccctttgctatggtttggatctgcgtccccaccaaatctcatgtccaactgtgatccccaatgctggaggtggggcctggtgggaggtgactgggtcatggaggtggagccctcaggaatggattagcgccatcccctccatgctgttctcctcataccgagtgagttctcgagaggtctgcttgtttgaaaatgggtgacacctcccccgtccctcttcgtcctgctttggccacataaaagcgtgcccgcttccctctcgccttccgccataatggaaagttttcccaggccagcctggaagctgagcagacaccagtaccacgcttcccgtacagcctgcggaaccgcgagccaatgaagcctcctctttataaattatccagtctcaggtgtttctttacatcagtgcgagagcagactagtgcacccttgaacaatctctggtgcggtttctgagctcgaggccccacctaggatgaccgcagcctcctaagtgcctgccccaaagagctcagcactgccagggcgttcgtcctttgttcccgcccaaacctggagtgggcagtcactgtggaaagctcgcaatcagaaaccttccacccccaggactgtctcaaggccctgggccctgacaccgtgggaaacggcctgctcttgctcccagggtggccgggctgaggacctgacttcggagggggccttgctctaccctgcaccccctcatttggactccccaagtttgtcctcctccggataaggccgactggcacagcaggggcccttgcatggagcagcccctcacgcccagcacaccaggcctcaaagacacagagctgggtccagttcccactggatcttcttccctgctggaaaagcctgtcaccgaatacaatccatccgcgccgctctccccgtctttcctaccctcttttccatgactctggctggggtctgctcctcctccagccctgagccgacccctgagacgagagggagccaaaggcacagaaaagcagaggcagagctcccaggagcccccactgaggcgcggctacagcagccagaggagcccccaacccaggcacggccacggcagccggaggaacccccagcgaggaacagtcacggcagccagaggagctcccaggcccgagggcagtgcggggcagtcggagctggggggcaccatcccctcccctgtaacaagtggcaccggaaagcacctgaccgctgcctgagatcagggaccgcattgtggggcttcctctccagccagagtgggcacctctcaatgccccaggccgcggccctcctggcctgtagccctgccgcccctcaatgcccagcgtggcctgagttggcctcctgttcccatcaaggcagcaaactctgaacgggcacagagctggccagcctcagccctgggttcttccgcagcacccacagggccagcagtgatggactctcctgggcctgagccccgggtccttccccagcacccacagggcccggcagtgatggactctcctggctccctgaggcttgcaacactgagtggcagccgcgctcagaccaccccaccctcagcccaggcagtgccctccccaggccctgccaggcccccagctccacctccatcacctgctgcctgcagtccctccccgcaggaagccccctgccctccacaggaccttgagcctgggccacgctgggccctctgcacccagccataggcacctccctcaccatccccctcttccagccagatgacccgccttgacaaacgccctcaagcccgaggccctgtcaggatggccacgaacgcccttcctctacctgacctgtcgccctcagagcctcccaggcctggctgcccctgccctctgccgctgctacctatgtgagtgtcactctcccatgacagagactgggaccgctggtgcatcaccatatgtggaccagtcaccaaattaacccaagacagagaccacctgagcaaagccctctgtcagcacaatgccaggccggtcccatcccatgcagccctcagggaggagagaggactggggtcaccctcctttgacataagcgcctagttcaacacaccctgtgtttatcttaaaaaacagccctggtggctcacacctgcaatcccagcacttccagaggaggaggcaggaggatggcttaaccccctaggagttgaggggtgcagtaagccccactccagctgggcgacagagcaagaccctgtttcaaaaattaaacacacacatacatccccccaacagtaaa

SEQ ID NO: 441 - DNA, 6585 bp, Homo sapiens
attaacatttgagcagagataaacactatgaggctcatttctatctcctgttctgcgagcgtggcagagcgagctcagcaggttgagcgagctccctggaagattacagagtctctggctgacaccaatggccctgagctgtctcctcccctagctgagctccagataagcacctagtgctggttgagagggccacgccttaggcaaaggccatgttcaggtcctccttatccttggaatgacaaactcccagaagcctgcctggattatccccggcctccaggagtgctttgctgctctctcacttagctcttcttacatttggcctttcgtgaaggtcagcagcgggcacacatatttactctcaaccctctgagtgtgcgactgcgtccctctcacgtctgcacccccagtggtctggagtgtttgttcagatccctgcaaggcgagctgaatgccaggaaccagcttacaggccaggtgtccttcctggggacacctgtcctattaatctatttgctcaaactcagagcctgcctcttccgctcattttatactctccctctcatctgtcccacatttcggatctacagaagacacctcataaatagcaatgatgtggctgaactacatcccaatacctgttgtaggcattgatgaacaggtgcaggttgccggggttcatgtcattcacaatgtgctggcggtaggtgtggaccacttccacgttactctgcatttcttcctgcatttagagaggtgagaagatggtcctcatcgcactgtggccctgagctggtcactactctctccattctccaggttatttggagacaaagtaaagataataatgcctaatccacaagacagcgacggacctaaaaaaaaaacctttgggaaagcaacacgcccaaccaggtgcagacaggggtttcactatccgctgggagcagaaaagacccccatcctggaaaggccacaccccacccttccaaactcattactttgggagtttcaatttgaagtcagacatcctggatctagagcttagcttcatcactgtccctttcgtaggcaaatctttcaacctctctgagcctcagatctcttaaaaaaaaaaaaaaaaaaaagggaagagagagaatgttgcctacttcactaggttgtaggacttaatggaggttgtgttctcacctctactaacagtaaaaattggaggcaaatgttagtaattgttttccaatgggaagagctgaaaagaagtttttcatgcttgaaaagcaaaatcaactcatgccacaggaagttactgaaaagaagggcaattgcaactcccaccacggccaaccagagccttggggaagtcggcctcagcctccccgtctctgggtgctttttgaatgttatttgcgacaaacaacttgtttgctctgtttctcatttgtacgagggcagacactgtaggtttcacacaagggtctgatatgaccagtggcaaccagatgagaagttggagttgggggtcaaagaaagccggtgtcaagcttgagctgcatcaaacagtccaggatcatttaggcagcaaggaggtcaactggctactaagagcaaactctggaaaaaatagtcaggaatcacgctgggatttcagatcaaaaccaactatagcgatctgggggtaccctcagacaccatggccggaccaaccagtctccaaataacttggggtataatcagatcagatgctcaacgctatgtctgacatccctcctccagtgaaacagagacagtggctgtgaatttttcccaattcctatcagtttcagattacacactcaggacagggaaaatgtgtcacacgctgtggaatgaatcgtaaaaggggaaagaggactctagtgggctaaactgtggccctcaaaagatatgtccatgtcaaatctcttgaacttgggaatgcaaacttgctgggaaaaagggtttttgcaggtgtaattaattaaggatcttgagatgagataatcctggattacatgagccgggatgaaatccaatggaaagtatccttaaaagaggaaggagagggagaaataaaacagacacagaggagaagaccatgtgaagacagaggcagagagtggtgtgagcagccactagccaaggaatgccgacagcgacctggagcagtaagaagcaaggacgaatttcccctggagcctgtggcggaggggcggccctgccagcgcttgacatcggagttctagactcagagctgtgagagaatacacttttgttttcctttttctctgtttttgagacagagtctccctctgtctcacccaggctgcagtgcatggcgcgatctcggctcactgcagcctctgcctcccaggttcaagtgattctcctgtctcagcctcccgagtagctgggattacaggcgcgtgccaccacatccggttaattttgtattttcagtagagacggggtttcaccatgttggccaggctcgtctcgaactcctgacctcaggtgatccactcgcctaagcctcccaaagtgctgggattataggtgtgagccaccctgctcatcccactttcgctgttctaagccatcctgtttgtggtaatttgttacagaagccacaggaaaccaacacaacaggcaaacctagcagttgtactcgccaactccagagtggagcctctgttcccctggtacactcgccaactccagagtggggtctctgttcccctggtacactcgccaactccggagtggggcctctgtttccctcgtacactcgccaactccggagtggggcctctgtttccctcgtacactcgccaactccagagtggggcctctgttcccctggtacacttgccaactccagagtggggcctctattcccctcgtacactcgccagctccagagtggggcctctgtttccctcgtacactcaccagctccagagtggaggctctattcccctcgtacactcgccaactccagagtggggactctattcccctcgtacactcgccaactccagagtggggcctctattgccctcgtacactcgtcaactccagagtggggcctctattcccctggtacactcgtcaactccagagtggggcgtctgttcccctggtgtactcgccagctccagagtggaggctgtgtccccaggactcatgggagtgtcagatggtcacacatgttagctcagaagcagacagtggtatgtaagcaaagcaggtcactgcaatttcaggcaaccaaggggttttccagaccctgggcttgcaaccaagcccatggcatacccttcccgagggtagctggccccagctagagacacaaaaccagtgtctggggccaggcaggctgggctgataagatgactgctcacttctagcatgctgtgaggggcttggctcaatcccctttagtggggtaactctgcagaagagcagctcatctcagagccaggcagcagcacaggcagccgccatcctgctgtggtgaccagaatgaagccagattcataggttctaataccggccccacctctccctggttgagaccctatgcaagtcactcaacctctctggtctgtttcctcttccataaactgggaatgagaacagaatttatcacacaggtcacagagcacctgggtggaatcctattcctatagttaacacttgtgaagctcttaggactgagcccagcccagcacacagctaactccacggacatgtttgctactgaccagatttataacagcccagaactgggaacaactcaaaggtcttatcaacaggtgaatggaaaaacaaactgttgcacatacataaaatggaatacttctcagcactaaaaaggaataaacttttttttaagagacagggtctctctgtcacctaggcggaatacagtgggctatcccagctcactgctcactgtagcctcaaactcctgggctcaagcaatcctcctgcctcagcctcccaagtagctaggactataggcatgcagaaccaccatgcctggccaatttttaatttttctgtagagacaaggtgtcactatgttgcccaggctggtcttgaactcctgggctcaagcaatcctcctgccatggcctcccaaagtgctgggattataggaatgagcactgcaccccgactaggaataaactattgatccactcattaacatggacaaatctcaaaatggttatgctgagggaaagaagccagaccaaaaaaaaaaaaaaaagagtacctactatataatgccatttatataaaattctaggaattgcaaagcaatctatagaggccaatgctgatcagaagttgcctgaggaggagggagaggaggactatcaaggggcacaaggaaactcttggagtgatggagacgttattctcctgattacagggatggttttacaaatgtatatgcatgtcaattgtacactttaaatatgtgcagttaattgtacttcaatcagctgtttttaaaagacacataaaaaagagagagaatgaatgacttgttgcttatgaatgaataatgtcacattatctcatgagcaccagctcggtggcccccagttgattgtgtcttgttctctccacccccacatggggccctgtgctgagcaccacacaatgccttgctcagcaggaacaacagatttgccagaccacgcaactcaccttcccaaaaaggtgggacaccaccatgtccggcagagcttgggtccatcctgagatctggaaaggagtaaagtgggtggatgagaaaccaggagctaacagtagttaacaaggtcagcaaaaccccacttccctgggtgcagggtggcattgctggactcccccctacatgcaggcctcaaggacatcccccttgatagaaactcagttcctgtctccagttccctcctggacctgatcccccaaatgcagggcctgggactatatccagttccttattttcagaggcccatgcacaagatgcacagcaaataagtgctgaataaagacccagctactgctagcttaccctgctccaaacattcaccaagtcctcagcaaagagggccatccattcacctcttctaaaaacacactgagctccccagtctataccccaagatatgcttggctcccaactatccctcctctctcatctccaagccagtttcccctttctaagtatactgatattaccaaagacactgacaatcttcttttcctacctctccccagtgactaggtttgcagcaggagctctataagtcctagtatacagcagaagctccataaatgtgtgctgacctaagcattaggcaaaaatgagtaggagagaagctctagacctaagggtctttggctggcccttgcctgccacagcctagctgtgtggcactgggcagtctgcatacctctgggtctcagacttctaatctggaactgggagtgccaggaacttcaaggccacaaggtcaagggaaggactgcaagaagtaactgcacacatcacagtatctaataccaatgcctggtaatcgaaaggctggagttgaaaaagaagggaatagtacagctattaaagctgtactgaagggaatagtacagctattaaagacaatcctcaggcttcacattagccagtggtcgacatccccagaccttcgagtctcactcaggacagctatcatgaagcccagcgggttgactggaatgtcacttcctttgctggaaaatcaaataaaaaacagggagtgtgttccactccagaacgtcatacaggctggacggaagggctcctgcattctggaggaatgttcaaagaacaaatgcaaaatcacagtggctggtacagggcaggggatggggcaagaggcagggccccttcaaaccatcggtccctggcagccacccaaaattgggcaaaaatgcacttgcagaatgagaagctgcgatcacctcagcttgaaagactctgtcctatttcaactggaatgacctccccctctccttggccaacactgaggcctttacagggaaaaaaacaaaaacaaaaacaccacaatgataatttttaaaagataaacaaggaaccttaggacaccagccaggacagagcttcccaagacagcacaggtcccttctcctccaggcagcctaccctgcttgccaggcctgcctgtctcccaccctggacaggagccccaggggcacgggtggtcaggtccacgaaccacaaagtcaaagcaagctgcatccagtccccgttctactgcctagctttatgtgaccctggacaatccccttagccacaccgagtccttacctctgaaacggtgataaaaattctcacctcctagagttactatgaagattaactgagatcatgcacacacagcaacgtagaatgaaactagcacatggtaaactctcaatctacgttagctaattattatcgtaaaattctgtggcacagtccgtactaaatacatatttatttttctttaataatatgtgaatggattccta

SEQ ID NO: 442 - DNA, 6754 bp, Homo sapiens
tggcagagaaaatccttgtttcatttccactttcaaacatacatttgcgtaacctttcacgggttcaatacctgcctgcgttttccccaagtcgcctcgcagatcctgggccttgggacgcgcttcctcccaccctggagtcttccggcattttccccttggccagggctgggatggccgtagctgtttctccagactcacgttcatgttaaaggaacaaaaacaatcatatacctttaagtcaaagagttcttctagagcgtattgtcctgtgtgctgttgctgaaatgaggaggggatgaggcctccccaggccttgaggacttgcagggatgatgctcttcatgcaggttgctgacacagagggtgctgttgccccacagctgacaaacaccgggacgatgccttgaaggcaggaatcgttttatcattctccatcctcacatgcaatgttactttgaaagcctagaacgcttttcaccatgggcacccaggttctccatatgcacaagtccctgaagggttggtgcttcttggtgtgagttccagatcccgatcctctggtggtccatggtgttaccactgactcccatgtccctccttgtccccctagtatgaaaatgagatctgcaggatgctaactttccagcccggcactggggagaagctgttgggagtccctggttccagcctttctaactaaacccatctcctcctatgccacctgcctgggcccctcctgggactttatcactgtgccacactttttggaactactggttagaaggtgagtgtccatccccctccaagacacagaggtgcctctgtcccctactggctctgtcttgaagatgcacctctcggagcctcggttggctcctctggaacagggagtagtgagaagacgaacctcacagggttcttgtagggactcaatgatctaagacacagcaaacaaaggggtccctagagcctaaaactctggaaaatctgctgggggtgctgtgattcatgtttgttacttttctcttccccctcacttgaagcagctctcagcattctgcctcaatggcctgtatcactcactgtttggaaaaacacatagaaaccaagtctgcgatggcactggtaaaggatgtctgagattccttctggctggtctttctccttgacacagacagaagaggggtcccttggtgctgaaaaaggagccacaggcccactcagacatctggagaggctcactggggttctccaaaggttggggttcactcattcaacacatacattcaaaacacctcatttgtgcatcgctcttcttggggcttggcataatttcataaacaaagcagatgacaatcccccggccttgattctactcagagtcaggcactcacagtagacagaataaacaagtcatatctacagaatgttacaggtgagaccctcatggcctcctctacgtatggtggcatcctcccagattctgactagaatgacgcagcccagcaacaaatataaactgggtggatttagggttctgaagggccttttcacccacaaaacatgggggaaaatatgtggactctggctggggagagactaaaggagctctggggctcatacttcttataattcccacgagaaggctgacatctggggacttcccccacaagaggcaaatagtgagttctgtaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgatgaggaagctgctcacaaatctgcctgcagctgcagtcttgagtgcccaggtgtacagtgctgtgctccagggcctttgggaagagaatgtctgtgggacgccagggcgcacgagggtctgtacagccctgctgtatggccaggtctgccccttccaggacagcactgatggcttacggtagggtggggctgtcctccacactggcagcaacaggccagggacccagaaccacgcaggggtgccctggagggttgtgtgggagaaggccaggcctctgactcagctgtctactccatcaccagcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatggtgagggggcttgcagtctgcaagactttccgggggtggtgttttggggctacaattcccttaaattccacccggtcatttctgtgcttggaaaacccagtgaaaaatgactggtgtggtgaccttttctccttttccagatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggtgagcagctgagctttgcaggctgtgtctctggcaccagctgtctcagaccagcctctccctgaggagcagccaatgccctcggtccaatttcagccccacttcttaccaaccgtgggatctggatgagtttcctcacccacaagccttccctgtctgcatgtggacggcagagatgggacatcaccagcgccagctgcacagagtgactgtgcagactgagtgacaggagatggacagaaagcagggcagggcaggtgctcactgtggggcaggcagggccatgggtcactcacccagctgctcaggagcctcactaccctcagcacttattaggtacctgatgcatactggattctatggtagacacccaaacagagcccatagttgcagctgccacaaggaaagtgcaccggtacggagaggagtagtagagggctgattgggatgggaggaagacgaggcctcaggatgggcaggcctgagccaccttctagttcttagagtgtggatggcctgggagaaaatgtcactctctcttcccacccttgttgggttctaggccatgatgcattcaggtccctcgggggcagaaaaccaaacccagggactcccacaagtctggagcccattttaaagctttctgagctccagcttggttcctgccagagaccgtggatgactgtgagctcagtccctgcctgggactgtgggtgactctgagctgcagtgtgctgtgtccgtgacactctcctcctcccccaaaggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggtaagctatggttgggcctggggattccctctttaaaaatggggaacttcctcttctcctccatcggctttcaggatcggcatctgtatctctggcctggaccctgcacatcccctaggctcttcttgccagagcttcactcaccttgactcccacggcccagtggtggctgctcacttccgacctggggtcttccttgggttgaactaaaatcctcctagatgagtgacatccactcggccccaggtctgccctcctgaggctccccaggcctctgcttcatccaggaggggagatctcagcagagggggctgaggctgtagtgggccaagctccaactctgaaccgcacagctcattcttccctctccaggagtgcctaagcctcaacaacttctcctcggtgcacgtcatcgtctctgctctgtgcagcaacccaataggtcagctacacaagacgtgggcaggagtgtccaggtgaggagggctctctccatggcagcatcagggttgacctagggactcacaggtctccccccatgtgccctcaatgactctgaaaggttcttggagtccagggacactggaggcagggatgggccggtggctgtggtcactaagctgccctggactcctaggcaaggatttccaactcaggactaaggttttttaaccatcaggaacagactggagccaactggaggctttcaggtgtttgtacccagcagtggaactctgtgtccagctgaaagctaactgtaaacacgcagtggctcatgtgaagtggagatggggcccaggggaggagcatgagaggtcccaccctggtcctctggagcccctgtgatcagaggactccactgaaaactctcacccagtaagctgggattcactgggttttcaaacaaaagggactggaactcacaaatctcccctgattcccaaatttacccttctttctttcctctgcccatagcaaaagcatgaaagagctaaaagaactctgcaaaaaagacactgcagtgaagagggacctactgatcaaggtacagtggagtctgggagatgcaggacaagtgtttaagggtcagagaaaagagtgagtttggaagggcattggaccaggtgtcgagtggttattttgtttggttttgacttacctactaaaagtggacttgaaaaattccctccatgcctaccttgggccaacaggaagagtggtgtgtcggtccatgggcacgtgggggcatgggggcaggaggccctggaaatgggatgtggcaatggctgctgggctgctgggctgctgagcaggggtgatgagctgcagcattagcagggctctggctcccatgctggtccatgctgctggcatggagcttcctccaggctggagggtgatcatggtaggtgggacttccttccttcctcaaaccggccagcaattcctcaggaagccaggcctctgctgctgctgctgctgctgctgctgctgctgctgctgtctgcagcacacctccatgggcagggggccttggcctgcactgggggagagggggaacaacaacagaggaagctcatgtggcagggagtccagtaactgcccagctttgggtaccaatgggcatactggggacagacgtagctgtttgctgggactccccactctgccctttgcagacacccaaaaacggtcatgtcagaggattctcaccggttagcagcgacgcatgctcatgacaagtatctgggggattcatacattgctaggggatcctccctgaccagatctcagaatcgtccatgcaaatgagaaggcaacatgtcaccccacccaggactctggaaaaccctgccattgcagtcagagatggcgcatcaggaggctacttcctcagtggagaaagagagagttccgtgcacggaactcccctgggggatcattggcgaggcgaagcctttggcatggctcaaacccagtttgcgtggcagagattccagtggggctgggataggcaggtgccacttaaccaggtctcctaaaatgccctgtccctttcccatcacgactgtatgtggctggagacctagacactcaaagactccagagaacacgaccctgatgggtggtggtgctgggatgtgagctgaaggcagccgagacggagcctccaggagcagaaggaggcgtcctctctttgggggccctggggagccactgcccgctctgggcctctgtttcctcatctggaaaatgaagggatgctgagcctgtagtgcaggcctcacagggtagaaatgaagttcaagaaaagaaagcaatttgagggtgctcgtgcctggttcttcctcagagggatgacggtgagaacaacggcaacagctacaggaaactgagccctcagaggccctgtgaggtagctgtggtttgcatcactctttacagaagaggaaacagtctcagggaggcccggctgcaagactgggtgacacacacagggagtgtggatctgggccagtggtatgagcacggtgccaggtggctcccgccactccctggggatccaagtgcggggtggctggggtgtaactgggggagaggaggagagcctcactgtccctgtcgctgacacctggcaggcggggagctttaaggtggccacccaggagaggaacccccagagagtccagatgaggctgcggaggcagaagaaggtgagtgagcctgtggcatggacgggccgcaggggatcagaggacagggctcccttccccgccagctggaggcctccatatcaagacagcgggggcttcctccccagccctgtcctcctgtggccactgggcctggaaaaccttcatttgagagaccagaggaagggtctgggaaagctggactcagactagatgtggggaagggtaaagctgggaccacaggcct

SEQ ID NO: 443 - DNA, 6759 bp, Homo sapiens
tttgtctcttaaagtaaaccacgagttggaattaactaaacactgctgtcaaactactgtaaatattattctctaacagtcacagcatcaatcctgagactttccatttctagcgatttattaaaatcaaattacataattgggtttgcaactctccaaagaaagtcaaaacaaaacaaaaaatctttataagccttcctaatatccatctttaataatatccaataaaagatgtaacttatttagttactttgggtcaggtaaattttccagacctttcatgaatattatctgtgatcttaaaacaacagcaacaaaattggcattatcatactcatcttaaagatgaggaaactgaggctcagagagattaagtaacttatgctaggtcagttgagagctaagaaatgacagaaccgtgcttcaaagctagacctactcatctcaaaagcatgcaaatttcttactatgtgttgcagcctttgagcatatgatttgacggagaacatgtttgttacaaaatcatgacactataatggaaaaaaaatcccacagtagctctataaattaaaactaccgcctatcagttgtttttataacattctaaactcctgtatctagatatcatgatacattagtggattagaatccatcattttataaatatctgaatatactgactattgatagcagagttggttcagagaagaaaactaaggaagaaagaactgaattgggacgtggagaactcaggctccacggaagaggtttcagctgagtgggacatcacagaagaaatcaatggagtgtcgacatcagctatttcttacctgttaaagcgtgggtctgcataggcatctggaatgttcaggacttcccctgttcttgctacttggccagcaattcctttctcaattgaaaatctgcatatgtaaaagagaaggacatgctaattaaaatatggactctgtagaataattcaaaaatattccattgttaataatattgaattaaaagcactgttttacttaaatgcgtgtattacttttacgtttacatattctaaatcaccttatgaagtacgtaaaaataaagcagaaaaccattacacagtaatcacctgagaaccttaaaatattaactcacaaactgagatcaaacaatcaactagtatcctcctgctctgaacaataataatcccttctatttgcgaagcaccttataatttacaagacgcttcaacataaatttttttagtggattctcaatgaggtgtgaacgaaggcctatatgggttcagtaatttgccaacattcataaaatatcagtggcacaaggaacactagaatgctggtctctaccatcgtgctttctaccacacatataaccaaactcacaggttacacgtgagcttgagatattatacagaactgaattttatggtgtttgcaattcaagcactatacagaaataacgcaatgtacaacttctagtatttttacctaatttgttaaattttaaaataatcaaaatacaaggattgtctgttttttatatctaatatcagtatttttcctttgcaaaaatattttcatacttatatttttctcattactataccatcatcacacaggcactcatttcaaaacttccttaattaacaaagatgtctacaagtcacaatatctacattttacatagttcaaaaataatttccatattattacattgtcaacattataggaaatcaccattattgaaataaagctagaggactatcagaaaaactcaaaagatagttcacacaaaagagaatctacttaaaacaccaaagagtgaaccaaacactgcataaaactcatggttgtctttttcctggttttcttgtgctttgaacaacataaacacaatgaattagattgccatgagcaaagggtatcagaatccatttgatgatttatgcttctttgcgttggtctgagagcagtctgaactataacttttgttcatgctctctgtggtttgctatctgtggtcaatggaagccataattaagaagccgcccttacataaatggctgccattaaccagtcatctgagagttacagtaaatcacactctgtttttcttacgcttataaacacaggctttaaagttgttattttcaaaattaaatcaatgccaacagtgttaggaaacactcaaatcttcagcaagagaaatgacttatctaaatgactatatccagatgctatactgaggtctaacagcaacaacaaaaaaaaccaacaacaaacagacaaaaaaattttaaaacccaagtaccaatatagtgcctataaatcagagttaatggacatggaatacacaggaagcgctgaggggcagacagtggtggggccccacggtgaggcacaccttgagtttccctgacatcagtctccttttatgatagaacgcccaaataaacagcaatccttaattaagaagacacagtgttttgccagaatggtgttattaccagagaactttacggtgttatacagaagatgagttaaacgagacacatacagcaaaagaaatgcaaatgtctaaaattattttctcagcttctgaatgttaagctcgattcttaaacgttttgtcagagtgctccttgtgtaggtttccaggtgcgatatgagcaagcccccatgcctccatcaacaaaataaactccattctgttcatttaagtgacaacggctgccacttaaaaaaacaaagacttcagtttcaagatgcaacacaggtgtgctatgtgattgattaaaacagctggtcagtcacagagtgtatttaagtcatcaaatataccagatcaatttctactactgtctggactgcgagacaggccaccggttgggaagaagtaggggccgaattgcataagcacaccttttctcttggacatgggaaaacctgcagattccaggtggagtgtacctttacctacctgggagcactagaaagtttttccaacatgatttccaaaaggaccgcctccggaagacggcatttccaggagtgacgctaaggcttcctaggcgcggtttctcgggcactgcctgcaatgtcattcccagaagtactaccttcaggaggcgggtcctggtgggaatgatatcacagtatgacaagtattgtcagcatacctgtgaataggcacagaaaaatgggtaacggaacgcctgcacatctaccgtaagaggataggacattctacttctagctgtaccttatctctttggtcttcttgaagacaggttttccttccttttcctctccaatatcaaaaaggtctgaatataactccttgttcttatggtccacctggaaaagcgcacaacgatcggcattcaccaggttttttgcatatatctaaagacaaatgacaaaataagaggaagacaatgagacattcaaagaacttgcaggtaaactttatcataaaataagtattaatttcagctgtcctatactctaattggttggtattagcattataagtaaataaatatacaagtatataaatatttcatatatatgatataaaagtcactgttacatgctaatactaacagatcccaacagaatacacagcggatatgcatccatactgctgtgctggagggaagcatatcagtcgtgtattctgacaccaactgacacttctgttttagttggtaagcagctgctggcctaacttcccagtgcccttctgccatccaaggccctcttccagaacctctcaggccttccctggtgcctagatctgagcctctgtcagcactacgaccaccactcattctgattagttgaagtctgtgatgcagcaggtgtaaaagctatgaaatataacctctaaggagatacatggctttcatatttgcattagctgagttttatttgatgtactgtctaataaaaatttgtacagattattaagtgtttactatgtgccaggaacatttatacaatttatatgaattgatttgcctgctcctcacaataacaatattaacgcaggaaaatcttttcccattgtacgtattaggaaaattgaggcactgagaagtaacttgccccattattacatgaatagtaaatggtagcagtatttgaactgatactagctgttcccatggcccatgcttttataacaaatatgcttttccatttctaaatggaaaccatgtattcatttcattactcatttgttcttccatttccttcaacaaatatgtcttcaatgcctaacatatcctactgtcctgagtgggttggggctacagctgcaccattaatacagtatttacctctattgagaattctggtaacttcaactatccagatcatagccatgaaattattcctcggagaaaaagaattcatccttacagtaaaacagccatcacaaagtctctgcaagaggaaccttgcagccagggcaaaatatagcatctcatataaaatgtatagatttaatagaaataagtctaagttaggtaactgtcttcatcctattacacgtttgtgctcactactactatagaactattacactattacatgtttgtactcactgctactatacaccaaacaaatactggctgtgcccactacgcagggactgagtatactgcctagtatcaggacctctaggttacttctcacctcccttagcctgtgagctacagaaacagcagaaaccacttctcttttcccacagtattccaaatgctcagaacaaggctgagttagggccagcgaaattttgtggtccaaaccctgctccctgcttgttaatgtaaataacatttttattgggacatagccgcgttcattcatttctttatttttatggctgctacaacagcagagttgagtagctgcaagagagtatggcccacaaagcataacaatttactatctggccctttacaaaaaaaagtttgccaacaaacccctggcttagaacatataggatctccataacccaaaactctcaataaatatttgaggaaaaatgaatgacataaaggcacagcgagagtgatggggctgagtcgttggcaaatacagaagaatcactcatctaattcacaaacccatgagattttaaattattaagtaacaagaatgatcctgcattattaaacattaaattatattcagtgaaatctgtatctgcagtgtttgaggtaatgtcagttgcttaatattttggcataaatatgttaatatttgtttaaaatctggatcaaatggacaatgtttcagaaaataaaataagcttagaaagtgctgaaaaatataaatccaaccagaatcataaagataattcaaaaactatcaaaaaatattagcaaaaaaggcaccagcctaaaatggcttcaaatattaattctttaaaaatcttcaacaaattcccgtacaatttatactgatctacattcagaaaagaacaattttttccagttgtttttacaatgtatgctgcgtcactgatactgaaaactgacaaagaaactataaaaaagaaaatcacagatttacttttgaaacagaagaaaagttataaataaaaattcaacccaatcaaatttagcaataattaaacaaatatgacaatattaaaaacagagtttattctgaactgtccagtagcataaagtctattatcataattcataatagcaataagacaaaggagaaaaatctgcgagattatcgtcatggttgtcaaaaagcatatgatgagcctgggtgtggtggctcatgcctgtaatcccagcactttgggagactgagatgggcagatctcttgagcccaggagtttgagaccagcctaggcaacatggcgagaccccttctctacaaaacaatataaaaattagtcaggcatggcagcatgcatctgaagtcccaaacactcaggaggctgaggtgggaggatttcataagcccaggaggcaaaggctgcagtgagccatgactgagccactgtattccagcctgggcgacagagcaagaccccgtctcaaaaacaaaaacatgtgatgccattcagcaatcattaatgataaaaactttagtaaaatggaataaaagaatatatagaaaacgtaataatgttttcctcaaaacaacagtccatattataccaaacggtaaaataacaaaatcgctgccttaagatattaaagttaagaacaagacaaaggtatgttatcacaatcattagcatgctagtaggcaagaagaacatgtgaggtatacatatttgaagagataaaatttttcttgtttgaggataatgttatttcatatgtcaaaaaaatcaactgacaaacaattataggcagtaagagggcttctgtggctgggtgcaggggctcacgctgtacttccagcaccttgggaggccaagccccttggactgcttgagctcaggagtttgagaccagcttgggcaacatggcaaaaccctgtctctactaaaaatacaaaaattagctgcgcatggtggcatgcgtctgttgtcccagctacttttggaaggctgaggtaggaggatggcttgagccagggaggcagaggttgcagtgagcagagattgtgccactgcactccagccagggtgacagtgccagaccctgtctaaagaaagaaaaagaggcttctgttttaagatgagcatttctaaacatatgttca

SEQ ID NO: 444 - DNA, 6761 bp, Homo sapiens
gcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacctacacatggctatcctgagaatgctttctagttagatattcagtcctgagtcgtaactattaattttggcatataatatcttccttagttagattcaaagcttaattattatattccatttcagcaagtaaattaaaataggatcaagcaattatgtttggtagccctaagtgactttcaaatgattaaaaaacatacacaaaataagcattattgtggtgattttgtaggcagtgaaactagctaggttgtgggattacaagagataaaaagcagaacaccaatcagcaatttgaaatgaactctcaccatttgaaactgagcttaaaggccactttctggggaaaggcttccgcggtctcccaggctgacaggatggcttttctcttgttcccctctctgccacttttcccgtgcactgccctgggtctcagcgtggtctgcttgcttccctatagggagctccttgaggactgcccacacctttcttgatttgtcttcactgtaatgactagcacatggtcttacattgagccctatgaagtagccatttttcaagtcaagaatggctaagtaccagcagtttcataggattcgatctaatggttgctgaactccatgactgttaaaggaacaggccagtgaattaatgtatcgtaacaagcacgtagccagcgttataaggaaccacaggctgggcgtggtggttctcgcctgtaatcccagcacgtagggaggctgaggtgggcggattgcctgagctcaggagttcgagaccagcctgggcaacacagtgaaaccccatctatactaaaatacaaataattagccgggcatggtggtgggaacctgtagtcccagctactcaggaggctgaggcaggagaattgcttgaacccaggaggtagaggttgcagtgagctgagtcggcaccactacactccagcctgggtgacagagcgagactctgggtgacggagcaagactccatctccaaaaaaaaaaaaaaggaagcacagtgccagcctctcaacacgctgagagctcagcaaactttcagagagctctggtacccagagccagcaaagaggccttgcaaagcttgcaggaggaccacaaatgtgattagagggttaccaagacattcctatggggtggagaaaacttcaaagattttggctgggtgtggtggctcacgcctgtaatcccagcactttggaaggccgaggtgggtggatcacctgaggtcaggagttcaagaccagccggaccaacatggtgaaaccccccatctctagaaaagagaagaaaacagacaaaaaaaaaaaaaaagatcatgagagttttcagtctcaaggaggcaaggcttaggtcttcgtttctgcaaagcaaactggctcaaattgcaagcattaagaagaaaagccttcttgacagggtagaaggattcctaagggcagctgggaagtttccccctctagacatctttaaaaatagtttgggttctcatctgtcattaatgaggctaaatgaccttgcaaggacttttctggtcataggaggtctggcacaaaggctgagggaatacagaacctaagaccaggtgacaagaacagacagtgggcaagcagccattgaaaccacacctcctgcatatgacatggccattgtactgcctgtgtaactcacatgctctggagcacaagtctggcacagcacaaagcggtgccctccgtttctatatgctgctgatgctgcacgtctgagaccatactttgagaactactgctctaaaaatgcggtcgatcagtttgattgaaagttactgtcagaactgttctctgctgctgtgcatgtaaactcgctgtact

SEQ ID NO: 445 - DNA, 6877 bp, Homo sapiens
gcctaacattttgggggatagaagaattaaggggaaaaaaaacttaaagcataaaactgatgattttgattaaaaatttcaagcattgattcttttcaaaaggagaaaaattcaaataaggtaacccttaaatagggtaatctttaaatacaattttcaagaaccatggagttgcagaccagaaagaaataatggatttgatattttcaaagaaatagatagtgcttttaagttcaaaaacctcaatgaagtcctattaaccagaagaatagtatagtaagaaaaatctaaattgggaagtagaaaatcttagcagactaataattagggagttctcacagaaggatcgatttattcacaggtaaagttttctaaaccttcaaggaaaagataacttccaaacatttccaaaatgaaagaaataactggaagctactctgttcgttctgatatagatatctttgaacgccatacctgataaaattaaacatactctcctcattccatagtatatacaataatgccccaagtaaccatgttttggtcaatgacaaaccatttataccactgtggtcccataagattataattgagctgaaaatttcctatcgtcatagcctttatgacactgtagcacaattccatttctttttataaattgagtgcagcctgaatgcattgtgtttacaaggtctacagcagtgtactgtaatgtcctaaccttcacattcacaccactcagtcacggactcagcagagcaactgccagtcctgcaagctccattcatgataagtgccctatctcggtgtgtcagttcttaaatcttttatactgtatttttactgcaccttttctatttatgtatgtttagatacacaaatactttaccattgtgtgtctgggattgtaagtagtaggctacaccacctaggagcaataggctatatatcctgtagtctgggtgtgtagtcggccctaccatctagggttgtatatagtagactacaccatctaggagtaataggctataccccataacctaggtgtgtagcacactacatcgtctagggttgtagtaggctataccatctaggaccctcaggctgtaccccatagcctagctgtgtagtaggctatgccatctagtccctgaattctatattgttgaaaacataacaaaatcacctaagaatgtggtttctcaaaatatatcctcattgttaagtataacacatgactgcgtgtcagattgttaatagcgagaagtaaaagctgtcttgttaccaaaagagtaatgtttgagactatcttactggtaatactgttttgcagtcttatccagtgtaacacaataaagaatagtaagatgcaacatttaaaaatgttgacctggggccagggacgtggtggctcatgcctgtaatcccagcactttgggaggccgaggcgggtggatcacctgaggtctagagttcaagaccagcctggccaacatggcaaaaccccatctctactaaaaatgcacaaattagtcaggcatggtgatgggtgcctgtaattccagccactcaggaagctgaggcagaagcattgcttgaactcaggaggcagaggttgcagtgagatgagatcgcaccactgcactccagcctgggcgacagatggagaaaaaaaaagaaaagaaaatgcagtgtgtaatggaggcacaagaaacggggcagtggaagaggggttaatgtggtatgtggaagagtcaggagcttttctttcaaacctgcttaaattatgacactcccctgtcctgtcccttggataagtttcttgataccattccatttcaccttgtttcttttcttttttttttttttaaacagagacagggaccttactctgttacccaggctggagtgcagtagcgtgatcatagctcattgtaaccttgaattcctgggctcaaacgattctcctccctcagcctcctgagtacctggactataggcacacaccaccacgcccagttaattttttaattttttgtagaagtggggtccatttcagttttcttattagtaaaatgaaatgctatcacttgacagaagtttttgtttaattacaaagaacccatgtcaatgtacagagcatagtatttggcaatcaaaagacactactcggtcctctcccattgtttatggtagtggataattgatgagaaaccttgatagaaaactaaacccacattttatagtaacataaaggcaataatggatgacgttaatccttctctgtccgccatcagaagatttgatacatctttgttgaggtattatatgatcgtcctctaaactttgaaataattaacagaaggtaagtcctgctgtgatggccatataaaagtttacttaaaccttttttttgtttgtttaaataaaaggcgatgtagatactggtagagcttgttgctcatgttacagaatatacagctttataaactttaatttctcaacaaataaattgactaagggtatagatggtttacagatgcggcgatgggaaagtgcgtagggaaacattcacgttctgtatcaagaatagcatttttctcattcgtagcttttatctgatttggcagggttgaagtgaagctggcattgtcatttttgcaactatcatggtaaactggcataatccctttggaaggcagttccctgataagtttttactgtacttaaagttgaagagatcttgttagagtcttgaggcttataaaataatcgctatctcagtgctttgggagtccaaggtggtacgattgtttgaggccagtagtttgaggctgcagtgagttatgattgcaccactgcactccatcctcggcgacagaacaagaacctatgaaaaaaaaaaagagcttataggtatatttcaggaaactgctgggctaggtttttcgggacaagtacttaaagaaggtcatgacagcgtttgataattgggcttgcatttgcattaggcactagtcattctctttttctttctttctttttttgagatggagtctcgctctgtcgcccaggctggagtgcagtggcatgatgtcggctcactgcaagctccgcctgccaggttcaagcaattctcctgtctcagcctcctgagtagctgggactacaggcacgcaccaccatgcctggctaattttttgtgtgtgtgtttagtagagatggggtttcaccatgttggtcaggatggtcttgatctcctgacttcgtgatccgctcacctcggcctcccaaagtgctgggattacaggcgtgagccaccccacccagcccgaaacagaaaagctttctaaagttgctgactcactaaatgtacccccgtggctttgcggtatgtttaagttgtataaaccaccccttcttgtcattttctatcctataattccttacctaatggattaagtggtgccagaactgaccctggagaatgcagatttttgatgcggaagtcacggaagttatgttatcttaagggaaggcctttgcttgttaccttttagtagtaggttacagttggtgatgccatggggctcattcctcacaaattgcaaaacttacatgtgctaataaaccttggccttcaaaagtagtaacctagatacaagtagttctccatgctctttctttgaaatttcctataaggactgctttccagcctggtgcatttccttggcactcaccgcattctgctcgctgagcccttttcccacccctgctctctccctggcttcccctcctgggcaactgctctcacttctcactgctgccactgtgctgcctttgcccggcggcccacctccggctgctcctgatgccccctcccagagccgccccttcagctgaaggtgataaagcatggctttccctttgtaatttgggaagataattttttttttttttttactgtttaaactgttaagggagttttttgccagtgatacatattataaaagacacttgtttgtctccaagtttttgtttttattttttcaagagaataaactggcttctgtccctacacagctgagcagtggttcctgattgtcctaaggaagcctttggccctaacctgtgtgcctcattggccacttttttactggcggcagcagcagcagcagcatcagtagttgagaacaccctaatctatcttttcctttctcttcttcacttctaactatagggaaaacgtccacagcgcacaaaggcagagttgcatcctaggtggatgtctgaccacctgtccatcaaacccgtcaagcaagaggtgagtgtgggtgagagtagcgaggaggagctttcctgatgaaagagacggatccttttcatgtacttccattcctgcctttttattttccttcattttttttcctaaaccccaaatgtttatttagcaatcttatgcttaagatacatttctagaaagagaaagaattagaagacgtgaggccacactctggttctgacaatctcctgggatggtaggcatgtccacatttaataagaatacgtactgcaataggtgcatgtataggagcagttcacaaatgcaaagatgggaggatgtagagctgggcaacggaaggagaatttgagtaggcagagccatatttgacctgaatcctgagatggctgggattgatggaaggggagcaaagagggtgggagaggtggggcagaaggcatcccacactacaggagtagtagaaacaaaagcacagagacaggaaattatataaatttatataaaatgatataaatatatatggtcaaaaaacagcatatattagagccaagcacaggtagctcatgcctgtaatccgagcactttaagaggccaaggcaggtggattgcttgtactcacgagttcaagaccagcctggccaacatggcaaaaccccatctctactaaaaatacaaaaattagctgggtgtggtggcgggcacctgtaatcccagctactcgggaggctgaagcaggagaattgcttgaacccaggaggcggaggttgcagtgagctacgatcgcaccactgcactccagcctgggcaacttcagagtttcactctgtctcagaaaaaaaaaaaaaaaagaaagaaagaaaagaaaacctgagagtttgtggcaagtttgttgttttgtttctaattggagatgtagcatggacctgaaaagggtccaggaatgagagagcgtggatctggctgatctgtggggagatgaaattcttaggtgtcaagacctcgccatggagggtagataatcacatttcttctaagacacaaagcaaaacaacataaatgggagggcagggaaatgtttaggtcacatgaaagagagagggcatcatgtgggagtttgagatataatgttaggtgaagaaagaatatttggtgcaaccactaattaaaagagttgtccaaggagcattctggagctgactgtgtttcggcattttcattctgtaatgtagctcaggagcctgaagcaggagatttacttgagcctaggagtttgagaccagcctgggcaacatagcaagaccccacctctgaaaaaaaatagttaaattactttatcacatcacatcacactgtaggaagggacaacactttttaaccgtttatcctttgggcactctttcatcgaatatttaaacagttcagtgatcgtagagagttttgagttaagggacagtagttttactctggaccatgtctttgaattgttacgttacggagccttccttttgcctttcagtaacattttcatggatcttaaatttgagtgacgacacgatgttctattacagagatcttgtcagtaactaaacacattctaccttgagccctgaaaagggaaagctaatttataaatttgtatttacttcagtatattttgatttcacatctgtctctttttaactcagagatgtgtcttgcccgatgtttaattacctgggggttgacaattctattcatgattgacctcccttctccagtatcctcttcctcctagcagtcactaatttcagagtggcctttggtccctggtattcagccatgttctcaaatggttttctagcctggccttgttgggctctctctgctgtctttattaccttgacagttcacacctccttgcaagctcccttttctgtttactgttcactgctctgagtattcctagatgccataacttaacacttcagactgcatagcaggctgaatagactgaaacgtccttcattgctccaagcaaaactttggcatcaaacactaaaatttctttttattcttggcagtgtttgagctttcttttattctactcttcagttcgaacaaaaagaaaccacagtattacagagactgtaaactatctgttgtggtccccgatatcctggagaaacccttagtggtgacatgactttttaagcatggaggcagggtttctggcctctattggtcactcagcagtccaaacttattgcctgataaaagactttgagttgtgacttcttggggaaaatatcagtgaggggagactgtctcgctgaactcagggattcgggatgcagtggttatttttgtccggacactttggtcattgctgttgctagggagctgtttgttgggtgttcgtctcaaatgtgctgctaacgggagcaagggtgccagcaagtctgatacctgccctcagagaggggagcgtgtaagggcacagcatgttgggcattgcttaaaccaggggttctgttgaatcgtccttgactggattttaaagtgttgtttctcattagcttctcattaaaaaccccc

SEQ ID NO: 446 - DNA, 7133 bp, Homo sapiens
taggtgaatgacatagccatcatccccatcatctagaaactcttactaagcacagcgctttcctcctccccctcatcaccgtcaggctcatcaactagccacatttcttccctccacctccagggctccatggtttccttcccaactcactgggagttccatctcctttcctggttccttctcttctctatgacctcttaaccttggaggaccctgggctcaggcctcagtccctgccttttctccagctgctctccccctcccttggtggtcccatccagcctcatggcttaatatcccatttccacgtcaacaactcccagtggatagccctggccgggacttctctcctgaacttcagatgcataccacaactgcctgcctgacatctcaaacttcacagatcgaaactgaaccctgttctcctctgagcctgctccatccacaccctcccccatcttggctggtgatgaatccatcattccagtgactcagggcaaaaactctggagtcgtccttgactcttctttcgcacacaggtcacactggatccatcagcaaatcctcttggctctacctttaaaatgtatccatccagtgcctaccagctccccactccctcctgtccagccaccatcatccccggcctgcactgcaacattacccatccacctttcccctatagtctatgcttaacatggcagcccagtgaccctgctcacacacatgtcaggtcactttactcctcttctcagaactcctcaacagctcctaacgtcacccaggaaaagccagtccttgaatggcccctaagggctccgtcatttatctgcacaactctcgcctgtctgatttcatctccttctcctctccctctggttccagttctgctcatctagttccgcaaacataccaggcacctcctggccttggcacttgctaacccctcttcttggaatgttcttctgctaggtccctcatggctccctcactccttcacctccctcaagtcttcgcccaattgtcagtgacacccacctgaccaccctgttgaaaattgcaatctccttctaccaactcctcctttccactgacatgccagacacccccaccctgcccacatttttattttattcattgcacttctcacctctaacatcctgcatcacctattattgtttacatttattttctgtctctctccactagaagagaaactccatgagggcgatgatttctaagttgttgccagctgtatcccagcacctacaacagtacctggcacatagtaggtgctcaataaatatctgttacatgaatgaaagaatgaattcagtcctcagctagatgcttcatgtaaaagtactaacattaaacagtaacaatcacaatatttgtgactacctactgtgtgccaagtcttttgctagctgatctttaatgaatatatagcctgtaccagtactgcacttggcactttcaatcatgattatgataatagttataataatagtagtaatacaaatcacccttttgtgaggacctactacgaggcagaccttgtgctaggcagctgtacagaataatactaagcacttcaagtttttattcctgtgcaagatgctttataaaacaacattatttactacctactgtgtgccagaaatttacacaggttgaacactaaccttcagacagtcctgggatggaacgcttatcatcccactttacaggtgaggaaactgaggctagaagagtcaagagatttgccaaaggcttcactgtggccaaggctcggtgccaagttgcacaaccagatctgcccgcttccaaagcctgagcccttactccataagctgggctaccttctcaagatttgggctgatgtcctgaccctgcttctggtcctatcatcacctcccatgattgatggaggaagtggcttctgaggcctctagacagccattcctctgcccccctccccaggtccttctccagggcccaggggcctcacctgtggaaggagaaatagggagaggaagttggccacagtcatgacagactcggagttgtcagggccaatgacagccaccacacgggaaatgtagttactgtagtcctcttggatgggaaggaggttgtcctcgtgtgccaggaagtagagcaccggctggacattgttggagatgtagcacacatccacgatctcatagcccagcagcacaccaggcagcaggctgctgtcattgttgatctcctccaccgcaaagcgcatggcctgcatgaggttgtagcctatcaccttcacttcatacctggaggggccacagcatcatgaggtggaagcagatccagaatgaggaaggaagagataagagaaccagcccactcctccttcctgccacaggaaagccaaggcattgactgagaagagccactccagaagactcgggcattttcaccatgtcattgtcaccataccacatctctagggtcaccattgcccatatggccaccactgatactgttatccatgtggccatcatcactactatccctataacctccatcaccactctaccaatgtccaccaatgtgaccatcattatccactaagacttccatcaccaccatcaccactatcaccatcatcacccactacccatattaccaatatcaccaccagggccatcactgtcaccacaaccttgtgaccatcatcaccaccatcatcaccgtcaccaccatcactatcagcacgaccattatcacagccatcatcaccaccatcaccaccaccatttccaccatcaccaccaccaacatcatcatcactaccatcaccaacgccatcagtaacaccctcaccaccatcaccatcatcagcaccatcattatcagcatcaccatcatcaccacccccatcaccatcatcactaccatcaccaacgtcatcactaacaccatcagcaccatcatcagcatcactacgatcaccaccatcaccaacaccatcactaacaccatcaccagcatcactaccatcgccatcatcaccaacaccatcaccaccatcagcaccatcttcagcatcactatcatcaccaccaacaccatcatcactaccatcaccatcatcaccaacactatcgttaaaaccatcaccatcatcaacgcaaccatcaccattatcactaccagcaccatcactgccaacactattaccaccactgccatcatcatcactaccatcaccatcatcaccaccattaccactatcatcatcatcatcaccatcatactttttatcattgtcatcatcaccagtattactgttatcaacattatcagcatcaccaccattactttcatcacaactatcaccatcattatacaccccaccatgatcacaagcattagaaaacccagcatcatgcctggtgccatcaccttcaccattctcaagccagcatataatcttccccagtgtcataaatgatgcatttctcatactcaacccttaatcatcttttgcactgttcttcctttctccttgtctcccgcaataccttcaccctctctgcaagaggtcactcttttttagtcccaggctggctccatgtccttcgtgcttgcatgcagatgcacacagcccccacaatctccaagtgatgctgccaccccaaggggctcagggaggaggtgggggaagaggaacttccctctcggcccaaaagcacccctacccaccacagaacctgctacagaaaaatcacattctgcctcccaaaggttttcagaatgggctttgacatggacccattgggagtcccccagttgccaaagtgggtgggagcagtcttgatggcctctaagagccctctaggctcaaacattctgtaactctatttaaaaaaaatggcactgagatgaccccagtctcagtgtttcagagcacagtcgccaaagattttggtaacccatattatacggggcctccctgaggactaggggcatggatccagaataagggggttggcaatgaatggggaggagtgctttaagcccttggtcctggtctggctcccaaggacccacaggaccaggcctggcctcccaccccatccccactgccacttccagccccacactggagactcactccttgcacatgggcacctgcaggaagttaaggtgaacaatgcccttcatgttggcatggagggagaagaggccacccaggaggtaatccccaggcaggtagaagtccgagttctcagccggctcagccaggacccataggaggaagaacagggaggagatggtctttgccctgggccccatggctgggaagtgatggtctcaggaggtagtcctgcctcactggagaattggcagcttgacaccagggtatttgcacagacatttacatagcgatggtcctgccaccgactgtggggcacctggagcaggtggagaggtttgggggcccagagggaggaaaggagggtggaattatgatgattctttcttagagcatagaggggctaggtggtctaggggaaccctatttggaaagagagagcatcctgataacttggccatgccctggccttctgccacttgtccaaggacaagtctcatcttcctgacatttcaaatatttcaggagtaaaggacataagtgctgtcaggaaacagagtactgtggccaaaagagcccaagctctggagtccagccaagttaggccaggcatgtagtgatgtataggtgtggagaaagtggtagccattgtcaataagaaccaggcatcatgctggtgtcgcggttcatcatctcatataatggttgcagtaaccgggactattactaaccccatttcaaagatgaagaaatggaggcactgagaaattaagaaatccagcccaggcttcctgactagcagagctgagattcaaaccacatggtctgactccggggctgggtccttcatcgctacatcacattacatcacaaaattagtgcttttgataaaaaaaaaaaaaaaaaaaaaacccagcggtgtcaaagagggtgggggaaggagggaagggaggggtggtctcactccctctgaaggctgccatcagtcagcctagcaacacccactctgggtccccgaccccttggaccccacaccaaagggcagggttgttggcaaaacagaaagttgaaaattcctaaattcaaaggtgaatacgcccaaggagtcagaagcggggaggtggctccagtgaattagggacccatttgaatcagagacccctgtccatttagtgctgttttgctcctttccaggcctaccaacatgtggccgagccctagggaacctgccacacaccacatggctggaatgggtctgtcacaggcacatacccggctgctgcgctccatggttctgatgggcagaggcttcaaggtagaaaaaggtgatcaaaaaccccatgatcggctgggcacggtggcttacgcctgtaatcccagcactttgggaggccgagacaggaagatcatctgagctcaagagtttgagaccaccttgggcaacgtggtgaaacccggtctctactaaaaatacaaaaaattagctgggtatggtggcacacactgtaatcccagctactcgagaggctgaggcacaagaatcgagaatcgcttgagcctaggaggcagaggttgcagtgagctgaggtcatgccactgcactccagcttgggctacagagtgagactccatctcaaaaaataaaaaataaaaacaaataaaaacatgctctctcctgccccaccccagccaagccctgctcctccttcagggcccagtctgagcttctcctcctcctaggaaccactcctgcccccagttcaagggaacctccccggctctgagcagcaacaagcctcctgtctgcgtcatcgctgggcactggctaccagccttacaccgttaaccggatcctgctgcgtgtgtccactctacttgaggacccttgaaaccacgtgacgtggacccacctggatttgacatcagctgtttgctggatgagcatgggcaggttccttaatctctctgaggctctgtttcttccccgttgaaacaaggataacaatttcagcctcatggacttggtgtgggaattaagttaaataaaactggggggtgtggagcaggcttggagaaaggtgagtttgccaaagtgcgaggttgtttctttttacaacgaaatcaactgccgcagggggcaccgtgggctccatgaccagctgaaattgcccctttgtgtcccaaagcctctcgaagttaccctgaaggatgttggatgtctttagctactgcagagccgaagtggcgcctcctcccctgcccctgacctctcctgggacggggtcatcccgtgggcctgtaagccaacaaggggaggcctcctggtgctgcaggaagaggcagaattggctgtgtgatctgggcttgtccctgcccctctctgggcctgtgtaaaccagtggattggaggtggggactcataaaataaaaggaagcgccctgcaaggggtgtttggaggtgtgggttctgggcctgactctcctctctctgggtctcagtcccctcatctgtacagtggggagcccctctttgcactgcccgtgtctgcctccatgtcagctggcccaaaaccccagcactgacccgtcaccactgccccatgggttctctccatgccctcccactttccacgccacaacccccgcagaccctcatcaccccctttctgcacctctccatctgccccacactgactgtttaaaaccccaaaccacagctgtcagctaatcactcctctgctctaatacccgccggggctccccgtcaccagctggatcaagtctgagctccttgtcctggcatttgaggcctccccagcccagccccagctcactcatcctccctttcctggcctttccagcctggtctctcctgcaccacgtgccacaaaccacagccacactggcctccttgggtctgggtccctggaggatcttcctggggtggcattctaggggcctccgagaccatagacgcccgccctgccaa

SEQ ID NO: 447 - DNA, 7153 bp, Homo sapiens
tcacaatcatacatcactgctattacaactattacatttcaacatgaaaaattgctacgaaacttctagtagaaaaaaatggtttcgtttaagctataggtgttaagctgtcatttagtttcaattttgtttcaataatacagtgttttgttgttgttgtttctgagatggagtctcgctctgtcactcaggctggagtgcagtggcactatctcagctcactgcaacctccatctcccaggttcaagcaattctcctgcctcagctcccgagtggctgggactacaggcatgtgccaccacacttggctaatttttgtatttttagtagagacagggtttctccatgttggccaggctggtctcggactcctgacctcaggtgatccacccacctcagcctcccaaagtgctgggattataggcgtttgagtcagcgtgctcggccgatacagtgtctttttaatgcacgtgtgttcctaaaaagatcattaattactcaggaacaagagtaacatcttaattatatgggctttcctatgtttatcccacacctcatctaaggataatgtaatggacaactggaagtaaaacaaaatctatctctaaaaagtcaacagggagatcaccagaccaacatgctgtatttaagcaaaagtaccttaggctttcactcagaatcatttctatacatataatttacacacgggtcaaattcacaaaatgacaacaaaataaataaatatcacatgcctactccatagaaatgcaaggaaaacagaagtctttaaaaatgtccaatcatctctcaatgaattgccaacatctatttttactacgggctaacagcttgggacccgggctcctgccactcaagaatggcacctaaaccagcagcagcagttggcagcttgttagaaatgcagactcttgagcctcactcaggactactaagacagaatgcacatttgaacatctccagatgactgatactgagaagcactgacccaaaggctagatgaatgaaagataaaccaagcagcttctaatgagaacactagctacagtaaagtttatataaattccaatcacccttaaagcaaaccagccttaaatacatacccatcctcatagttccacatgaatatatcactgtcaattgtgagccaagctctgctgataggagggaacacacccatcatgcaattacactgcatatctgaggtagtgtggatgtaaggcagacagaggtgaatcttattcttctttaacttgtttcaatagcttttgacttaatatttacgtaaaaaatcacaatgtgtccactctttaatacaacatggaacccatatacttaaacgaattttaaataaaacccttaaatgaatatataacacattaattaaacatagaacaagaattataagaatgaaaaataccaattttaacatttttaaaataaatacaaagtaataggatacgtccaaactgctcaacaagttcaggtgggagaggaactcttcggatggaactgatctctggaaggttgggtacggacagcaaaccaggtccttgcaaaggataatccatatctgacatgccagaaacggtgggattatctacaaaaagaaaatgaagtatttataataatgtactgctcatcaaccgggcaaacaaaaggattgagtgccacaaaaaaattgttgtgtgttggttccaaaggtacagagagaatattctagttttgacccaacacaaagtagtcctgaaatattcccttgtgaaggtaggaacagttactggtttcaggcctaaagggaaagtcatatctcaaaaaacttgctctgtaacaaaggaaatgtttattttattttattttttttttttttgagatagagtctcgcactgtcgcccaggctggagtgcagtggcacaatctcggctcactgcaagctccacctcccgggttcacgccattctcctgcctcagtctcccaagtagctgagactacaggcgtccgccaccacacccggctaattttttgtatttttagtagaaacggggtttcaccgtgttagccaggctggtcttgatctcctgacctcatgatccgcccgcctcggcctcccaaaaggctaggattacaggtgtgagccaccgtgcccagctggaaatgtttaaatttgataatttagtgttattttaaaataaaagtggctgggcgcagtggctcaagcctgtaatcctagcactttgggaggccgaggtaggaggatcatgaggtcaggagtttgagactagcctggccaacatggtgaaactccatctctactaaagacacaaaaaattagcctgcctggtggcgtgcgcctataatcccagctactgcggaggctgaggcagaactgcttgaacccgggaggcggaagttgcagtgagctgagattgtgtcattgcattccagcctgagcgacagggcaagactctgtctcaaaaataaataaataaataaataaacaaaatgaaagcatgtaattgtattgtttgtaacacaaaggataaatgcttgagaggatagataccccattttccctgatgtgatcatttcacattgcatgcctgtatcaaaacatctcatgcaccacataaatatatacaccgttgggcgcggtagctcacgcctgtaatcccagcactttgggaggcagaggcaagccgatcacaaggtcaggagttcaagaccagcctggccaaaatggtgaaaccctgtctccactaaaaatacaaaaaaattagccaggcacagtagcaagcacctataatcccagctacttgggaggctgaggcaggagaactgcttgaacctgggaggcggaggcagcagtgagccaagatcgtgccactgcactccagccagggtgacagagcaagactctgtctcggggagaaaaaaaaaaaaaaaaaaaaaaaaaatatatatatatatacacacacacacacacacacacacacacacacacacacacagacgcctactatgtacacacaaaattaaaaataaaaaaatttaaaaataataatttagtgtttttctatcattttgctaatctgaaatgggaaaatataaaactgctttggggctcaaaggtaaaatgactataagcaaacaaaataatgactgggggaaaatactgcctttaccagctaaacatttatagattaaaacaacccatgacttttccctttagatttatccccaagaccactaagacaaatacaaataataccccacaagcagtatcttattggggggataaaaacaaagactgctctataaagtgttctcatgggcaacctttctcttgctctaagactccatcactaaggacaggagtgggctggtctactcagcctacccttgctcccggacaaggcgttatttagacctgactgatgacctacttatctcaggcactttctcaggttctatagagtacaaagatgttaaggaaaactgacatataaaacaatcttgaagtgtattatggaaatttttaaaatatatataagaaaaatacaataaatacccatgtactgattatccaacttaataaccagtaatatccccaatcatgtttcatttttatcattgttcactccttccccaattatctttttatttttattttttgagacggagtctcgctctgacgccaagctagagtgcattggcgcgatctcagctcactgcaacctccaattccctggttcaagggattctcctgcctcagactcccgggtagctgggattacaggcatgagccaccacgcccagctaatttttgtagttttaatagagacaaggtttcaccatgttggccaggatagtctcaatctttttttttttttttttgagacggagtctcacaggctggagtgcagtggcctgatctcagctcactgcaagctccaccacctgggttcaggccattcttctgtctcagcctcccaagtagctgggactacaggcgcctgttgccacgccaggctaatttttttatttttagtagagacggggtgtcaccgtgttagccaggatggtctcgatctcccgacctcgtgatctgcccgcttcggcctcccaaagtgctgggattacaggcgtgagccaccgtgcccggccggtctcaatctcttgacctcgtaatccgcctgccttggcctcccaaagtgctgggattacagatgtgagccactgcacccggccgaactctttttctctttttttttttttcctgagacggggtttcactctgtcgccttggctggaatgcagtggtgcaatcacagctcagggcaacctcagcctcttgggctcaagcaatcttccaccacagcctcgtgagtagctaggactacagtgtcatgacaccatgcctagctaattttttttttgtttttggggtttttttttgggatgggctctcgctctgtcgcccaggctgtagtgcaatggcggctcactgcaacctctgcctcccaggttcaagagattctcctgcctcagcctcccgagatgccaggactacaggagtgtgccaccacacccggctaatttttgtatttttagtagagacaggatttcgccatgatggccaggctagtctcaaactcctgacctcaagtgatccactcacctttgcctcccaaattgctgagattacaggagtaaaccaccgagcccagccaaacagcatttttctttttcctttttttttttttttgagacggagtctcactctgtcgcccaggctggaatgcagtggcgcgatctcggctcactgcaagctccgcctcccgggttcacaccattctcctgtctcagcctccggagtagctgggactataggcgcccgccaccacgcccggctaattattttgtatttttagtagagatgggggtttcaccatgttagccaggatggtctcatctcctgacctcgtgatccgcccacctgggcctcccatttcttttgagaaagagtctccctctattgccctggctggagtacagtggcgcgatctcggctcactgcaacttccgcctccctggttcaagcgattgtcctgcctcagcctcctgaataactgggattacagccatgagccaccacacccagctaatttttgtatttttagtagagacggggttttaccacgttggtcaggctggtcttgaactcctaacctcgtgatctgccacctcagcctcccaaagtgctgggattatgggcgtgagccaccgcacccagccactttttgtagagacagggttttgccatgttgctcactcaggctggtctcaaactcaagctcaagtgatccaccccacttccaggtcccaaattgctaggattacaggcatgaggcacagcgccaggccttttttttttttttttttttttttttttgagacagggtctcactctgttgcccaggctggagtgcagcggcgcaatcacagctccctgcagtctcaacctccccgtctcaagttatcctcccacctcagcctcccaagtagctgggggtccaagtgtgtgtcaccatgccaagctaatttttgtattattgtatttcttttctttaagaggctgggttttgccatattgccaagactggtctcaaacttctgggctcaagtaatctgcccactttggcctcccaaagtgctgagactattgggctgaattcatattaaagcaaatccaggctgggcacagtgggtgacacctgtaatcccaacactttgggaggccgaggcgggcggatcacatgaggtcaggagatcaagaccaacctggccaacacggtgaaaccctgtctctactaaaaatagaaaaatgagccagtggcgaacacctatgatcccagctactcaggaggctgaggcaggagcatcgcttgaacctgggaggtggaggccgtagtgagccaagattatgccaactgcactccaggctgggtgacagtaagactctgtctcaaaaaataaataaataaagcaaatccagacatcccatttaatcctaaaacataactttaataggccgaaggtggcagatcaccatgttaaatggcagtgggaacacagagggaggaatcgataactttagtgaggatgggaatgctacgaaagacttcaggccaggagtgtgacttacatctgtaatctcagcactttggaaggctgaggtaggaggactgcttgatgccaggaatttgagaccagccttgtaacagagtgagactacgtctctacataaaaattaaaaattagctgggtgtggtggcaggcgcctgtagtcccagctactggggagggcaaggcgggaggaccacttgagctcatgagttagaggctgcaatgagctgtgatcatgccactgcactccagcctggtaacagaactagaccttgactcaaaaaaaaagaacaagaaaaagaaagacaacaaagagaaactaaggactttcacagggagtctggaaaaagtttgtcaggcaaaaaaagaacattgcagaaacaataaaagtaagataaaatcctgaggaaatcctgaagatggggcttcttacggaaaatatgctaaattctctgtaatcagagcaacggatgaaaaattggatggaaaagaaggggaagagactgggtgaaagaggaaggtgtgtgtaaaggcatgagatatgtaagagaaggaccagaatgcatgcactgtttttatatcttgttttcacacctaaggaggccaaaatgagtaatgttgttcaagatgataattgctaataggccaatcaggtattataagacacgctcattggtaagtagctgtagggagcaaatactatctttgtttctatcatttctttgattacaaagctatcaatgatttttataaataatcagaagtgttctcggtttacactgcacaaattatcctatttagattactttggttcttgctcaccaacaatcttttctttcttacacttcgctggttttctccaaattccatctcacaaaggggtcactttttctagcaactgatgtaattccataagccgtggggagctggttataacttaaaactgtt

SEQ ID NO: 448 - DNA, 7178 bp, Homo sapiens
tgaatatactgcacctcttctacaaacagaagcaaaaatgactcatcaaactgcagaactattaatcattagaagaaaaaccagaaaaggatcaccagaccttcccaaatagggacaggaattgtaccaagtcacagcattggaagaatctttggagaagcagcaaaacctctgcccaggccgactgtgcccattcttcaccaagccactcttcccatcctctctggaaacctacagtttggtgtggaggtctgagcacacattctagaaaaggagtttcttgaagatgtgtaaaaaaatctccctgcaaaaagggagaagtcatggtggcctcaaactatcctcctccctcagcctctcaaagtactgggattacaggtgtgagccactgcacccagcctctacaaaaaaaaaaaaaaaaaaaaatttttttaattagttgggtgtggtggctcacacctgtagtctcagctactttggaggctgaggtgggaggatcacttgaaccaaggagttcaaggttcccgtaagctatggtggcatcactgcactccagcctggacaacagagtgaaaacttgtcttgaaataggacaaagaaaggagaaggaaggaagtaagggatacttccatggtccttttgggagaaaattatctaccaacctgctggtggtcattctaactttgtacactaatttcatgcccagggagtagtaataaaaatgctaccatggtatgacctgatacttgataattttctgggttttctttcccattgttgatggaatgcaaattccaagggagtaagcaagttgtcaggctggtgaaccactatattctcatagattagaagaagacctagcacgtaatagacaataaacaaaggtatgtttaatgaatgaaggaagagaagaaggaatgccttataatcttgctctacttaaaaggatctctgccaaggtctctgtcttgacaacaataaaatcaaccctttcaaaaaataaaattcaatggtttttggaactgtgaatccatgactactattttagtacattttcatcactataaaaagaaaacctatatccattagcagtcattccctactctccctctccttagccccaggcaaacactaatcaaattgagtctccatggatttgcctattttacacatttcatattaatggaatcatacaatacatagtctatgtctggcctcttactttgcataatgtttttaaggtttaaccatgttgtagcacgttattattcattcctttttattgccaaataatatcccactgtatggatacaccacattttgtttatccactcatcagtgggcatttgatttgtgtccacattttggttattacaaatagacatgctatgaacattcatgagcaattttatgtgacgatgtatatattcatttctcttgagtacacacataggtgtgagatttctagttcttatggtaactccatttttaacattatagggaattgtcaaaccattttcccaaggagctgcaccatcttacattcccaccagtaatctaagaggattccaatttccacacatccttgacagtacttcttaccatcgttttcattttagccttctgtattagtttcctgtggctgcaataacgaattaggacaaaccaggtggtttaaacaatagaggcttattctctctgttcttggaggccagaattgtgaatcatggtgttagcagagtcatgcttcctctgaaggctctggggagaatgcattccttgcccttccggtttctggtagctgctggcattccttggcttgtgacaacactccctccaactttgccttctgtttctctggcttgtggccacatcactccaatctctgcctatgttttcacacagcattctcgttgtctctatgtcttcacatggctgttttcttagagggacaccagtcatattgaactaggggcctgccctactctagtatgacctcatcgtaactaattacctctgtaaagaaacagtctcccaataaatcacattctgaagtactggggtttaggactttaacatatattttgggtagggggacacaattcaactcataacagcaacctatcttgtcacctatcccagcttccctggacccacaatcctaccgtattccattgagtcagttcattctgttcctaagcccattccttacagctgtacttttgttcccaggcctccctgctgcttgagcttcctttcaacatgctaacagccattacagatattccacgtggagatgcaaatttatcccagccacagctaccgccttcccagataaactgccttgcagtatgctgggcagttcacatttactttgcatgtggtcaggcccatccttctactacctggccccaatatctgctgctacagagtagtgacaatttcctcaaaagcaccaacaatgcagacaaaacttcatctttgacagtatttcccactgcctttgctgtcctggggcccattgtgatgtcaaacctcagcttctcaaggtagaatttcttgatcccttctctgctttctcagtctccttactgactaaagctctttattgactactgactaaagtacttacactgcatagtatatagtaaatgtgggcctgtcttccacctgaaactgtgacttggaacatttgtcttgtgatcatcagcacagtacctggctcacgcatgtgtccagaaagtgctaccaaaggaatggatactcagaatactgcccacctggtgcccctccagaatcatggttggcctttgactccaaaatactataaaaaatctgcagctgggcacagtggctcacacctctaatcccaccactttgggaggccaaggtgggtggatcacttgaggtcaggagttcaagaccagcctggccaacatggtgaaaccccgtctctactaaaaatacacaaattagccaggcgcggtggctggtgcctataatcccagctactcgggaggctgaggcaggagaatcacttgaaccagggagacagaagttgccatgagccgagatcatgccactccactccagcctgggtaatagagcaagactccaaacacacacacacacacacacacacacacacccaggtctgccttgaaacatcctggacaacctgtgagtgagaaaagtgctgcagcttccagggtaccatgcaagttctccaggagaaacatggcttcagtgctccttttccaagacgttactagcgtcaataatcacaatatctgattgcagagagggttagagtaaacgagatgctggatgtgggcacggggggaatgtggataagctccctttgctttccacggatggcaaaaaaatatgagtcaaaagttttatatccagccataacactcattagtgtctctggtccctgactgaatcctcactgataaagtatagttgtcacagcccggcacagtggctcacgcctgtaatcccagcactttgggaggccaaggtgggtggatcacttgagtccaggagttcgagactagcctggccaacatggtgaaaccctgtctctactaaaaatacaaaaattagccgggcatggtggccagtgcctataatcccagctactcgggaggctgaggcaggagaatcgcttgaaccccagagatggaggctgcagtgagctgagagctgagatcccaccactgcactccagcccaggcaacagagcaaggctgtctcaaaaacatatatatatatattatacatttaatatatataaaatatataaaatatatttaatacataaaatatataaaatatatttaatacataaaatatataaaatatatttaatacataaaatatataaaatatatttaatacataaaatatataaaatatatttaatacataaaatatataaaatatatttaatacataaaatatataatatataaaagtatatattatatctattatatatagatataatatatatttaaacatatatattatatatttattctatattatatatcatatatattttatatataatatatatgtttaaatatatatctattatatacaatagatatataatatataattttatacattatatattttatatattaaatatataatagatacaatatatatgtcacaattaaagttaaccaatgaatccagagcctccaaagcagcctagaaaaaaatagggaatagagaaaaactttatcaatctaatagaaaatagaaaaaggagttgaacccaaaaggtatgtggacagagatgcacattataaagtaaaaaggcataaataagaaaaatgtaaatcaacttcataacaatggttgcctctgcagagggaatcaaaagaagacctcaagggtatctttcacattaaaaattaagaagttcttcagggtgctttttcttttaacttactttccggtatttttattgtgattgtactctataaattagcatagggagaattgacatgtttacaaacctatagtccccaggcacaaacataggctgtctcttcctcactcaaatcagagacagatttctcttcagggacttcatagttttcttcatatcatttcagcattttttttgttaaatgtatgactatcttcaatcacacgtaatatcctctagaaaccatccttctacatatctaattatgtgtataaatatatagttttaaataagtaagatttaacaaatctgctcttttccactcagtggattacaggtgttgtttcctattaataaatatgtacctacatcaacttttagtggctgcatagttttatgtcacataaatgtagtataatttaatgtattcctttaacacgaaactaaaatgcgtttagtacacacccatctatgtctttacctgctttaccaacttttccctggaataagttctcagaagtataattcctcagtttaacagtatatgcttttaaatgtggaggccaggcgcggtggctcatgcctgtaatcccagcactttgggaggccaaggcaggcggatcacttgaggtcaggagttcaagaccatcctggccaacatggtgaaacccccatctcttctaaaaatagaaaaattagccaggcgtggtggcttgcacccgtaatcccagctactcaggaggctgaggtaggaaaatcacttaaacctgggaggtggagattgcagtgagctgagattgcgccactgcactccagcataggcaacagagtgagactctgtctcaatcaatcaatcaatcaatccataaatgaataaatgaatcaatgaaggaaggaatgaatgttaatacattttccccaactaccttccaaactgtactaaccctccatcgatagtgtatgaatgatatttccctccatagcactgaatttgctcaatcttcataacctttgcaaaactgagagacaaaaacagaccaaacaaacaaacttcactgtttttaatgatttcttgtgggatttcttccacctttggccagtgtcttttgttttggttatttcttaatacatttcctgttcatgtctcacagctagttttgagaggtcattcatatttttttctaaattggatttgtaagaatcttttatgcatttagggaaatgttatataatctggtttgtttttccagtatatgaaaatactgtttttccagtataatctcacttgttttccagtagataaaaatgcgtggcctccgtttttattttattttacgtatctattgcaacaagactgaatgaactctgttagttccagtaatttgggggaattttgtttttgttctttattttggccagtttgctttctttggagttaactggctgttctttttgcaattacttcagtcaaattaattaattcataagtgttcattcttttgaaataccaataaatccatttaggctataaattctgattaaaagcttattacatcttaaaatatataatatgttggctgattgccgtgcttacttttgaaagtagctatacttgtttagattttctcattctgctagaagttactcaaaaggatgctattttgaaattctgtgaaaatttttttaaacctatgattaatttctgggatatagaataatagctaacagtaatttaataccatgcagtttaatttccaaaacacccaaacatggtttttattctgattttacaaatgaggaaactgaggcatacgagagttaagacatttgcccagtatcacagagcctacaaatttgaaaataaaactcataaaagttatgctttgggaatttattaaatatttatctgtaactcatataggatcactttggcaaagctttttaagaattggaggagaaggatatatttgctatatgatacaaaatggaaaacatagacattaaatcaaccttattaaacagatcatttatgcttttattatcatttatctgacttagcagtactaataaagatatcttataattcccatatttcttgacgttttctaatatttaataaacaaagatttatgtgtaccaaatcttcactgatatctcaatacctttatcattttatcttaatactttccactagtgcaatttaagtataattcttgctttctttacgtatgcatttatttaatatatatttgtcccttctttatctcttttttatttatttattatttatgagacagggtcttgttccattgcccaagcagaagtacagtagcatgatcatagctcaccataggctcaattttcggggctcaagcaatcctcccacctcaggttcccaaagtgctggaattacaggcatgagctgccaagtctggcccccatttttattttttatgttattagactttacatgggtctctggcagatgaccaaaacctggattctgctttctgactcattcacacctatttaaaagatgtttgacctaattacatggccatagctgatataactagttttccttgtgttatcttgtttatatttccctttcctatattttctggttagcttaaattactagtttcttttctcctctcaagaacaacaaaacatataaaacctcatttaaatggtatcattatctgtaaccattcatatagctttt

SEQ ID NO: 449 - DNA, 7480 bp, Homo sapiens
gcactcgtatttctcggtaggttgtcgtaataagttgagtatctatattatacagcaccataattttcctgtttagtaatacacaagactttctaaaatataatagtatgctagaaaacagattggggttttacagtggttacgtttatgtgtcaagttgactggcctaaaaaatgcccagagaattggtaagagagtatttctaggtgtctgtgagggcatttctggaagaggttagtattgaattggtagacagagtgaagatcaccttcaccaatgtgggtgagcagcttccaatctattgagggccatttagcacaaaaggacagaggatggctgagttcgctctctctgcctgagcggagccgtcatctttgcctgcactcagacactgcacacctggttctcaggcctttcagcttggactcattatgctgacagctttcctggctacccagcttgcagacagcagatggtgggacttactggcctccataattgcatgagccaattctcatcataaacctctccatatgtagaaatataaacataagtacaaatatataatatctatctcctatttgttctgtttttccgaagaaccctgactaacacagtcgtggatctctttaactttctattaacttctagttttaatgattaggctgttttaaacctgattataagtaaactgtcttaatctttgtacagatgccatatactgatttgcccatattcctaagtaggaatatagtcttcaaaattcaccttttaaatgcacgattcaaatttttttttcttggctgggtgaggtggctcacacctgtaactccagcacttttgcaggctgaggcaggtgcatcgcttgaactcaggagttcaagacaagcctgggcaatatagtgaaaccccgtctctacaaaaaaatacaagtcagctgggcgtggtggtgtgtgcctgtagtccaagctacaccggagtctgaggtgggaggatcgcttgagcctgggaagtggaggctgcagtgagccaagaccacgccactgccctccagcctaggtgactggagtaagaccctgtctcaaaaaaaaaaaaaaaaaaaaaaagtctttctagaaagcataattcctatatatcactactatctcttctcagaggaaaatacatataataagaggatcagaggctaggatcagtggctcacacctataatcccaagcactttggaagtccaaggtggtaggataacttgagcgtaggagttcgagaccagcctgagcaacatggtgaggccccatgtctacaaaaaaataaaaaaaaaaaattaaccggatatggtggtgtgcacccatagtcccagctacttggaaagctgaggtgggaggattgcttgaacccaggagctctcggatgcagtgagctatgatcaggccactgcactccagccttgggaacagagcgagacccggtcacaaaaacaatacaaaaataaaaaataggatcaggtcacagatattaaaacagttgcaggtttaaagatcactcccaccttacatattggtcaattccactgaaaccccaaagacagggtgctcagattgtagaattccatgttcaagagtgaactaaatattttttggtcagcactcacctgaatgttaggataattcagaggaatttcccaacagacatgagaaatgtgccttccaaattgcggcaggtggcctgagagcttgacatgagtttctcatgtgcagcagcgtcttgttatttgttataagggcttcataaacagagctgggtttacaaggagtcttatgggctcagaatcttaactgcgatgtctaactctctaagattatatcttttttttttttcttttttttgagacggagtttttgctcttgttgcccaggctggagtgcaatggcgcgttcttggctcaccacaacctccgcctcccaggttcaagcgattctcctgcctcagcctcccaagtagctggggttacaggcatgcgccaccacacccagctaagtttgcatttttagtacagacagttttctccatgttggtcagactggtctcaaactcccaacctcaggtgatctgcctgccttggcctcccaaagtgctaggattacaggcatgagccaccgcgctgggcaattatttcttttatttcttataaccaccctgatggttaagcattttcttcctccatttttacagttcagaaaattgaagtttgggagtagataactttcctagggtctcacagcaagtcagccaaatgaacaccaaaatccaggccttttataccaaattccaggctctttccagtatacagctgccactgcccacattgcataaccagaaagaccatgtttgaattattaaaatgttaattcctagaatttgaactctgggacacctttagaaactcaaactctcaagtcgtcatctatcttccacatgtgaaaatggtcttccccccaacctcagagcttaaggtcccaggggaggggcatgtgactcagtctccccacagcccccacagtggggccacgttccccagttgtacgcttcagctgcccaagctcagtcgacaacgttttcctcttattcccacactattagtgttactgatgcccgcaaaggggccagcactggaacagaccctgaaaatacaaaacccaggcagtcagggttgtggagatggacaagggttcagtgaggtggtggactgtgcagaggggatcaccggacactgggatcacagggtggcactgcctgcccttaaccccttcccaaatgtcccccagacctcctccagcagaaccagcacctatgcaattagaagccacagtccagatgtctggaactagttctacttcccaacactacctggacagtgggtttaatcaatgtattctcccaaaatacttcaatcaatctcctgatttgggggtattgccaaatgagtagtcgtaaaaccaagaaaaacttttaaatgataatttacgataagcatgtcctgcttggaaagcaggcacaaatgatgctaaaaagctagctatttacacgtcatctctggatttatactcaataaagcaaaaacaaacaaactaaacaccactttgtcctagaactggtaagtggagtccaaagaagtcagagttggacaagtggtaaagttagcaacgctgacttggaaaaaacaacttttgctacgcctgtgggcgatatcatacccctgagccttaatgtccatgttgctagtatattcataatgccgctttgacactcctgcattactaacccagctctaacctactggccacctgtaacttcgaatactaaggaatactaaggtgtacttggaatactaaggaatacaaggtttggaatactaagctggaagtagggtcaacattaaggattctgccactagatggagaaattgtcccaatccagcgccattgcagttgtgttttgcttttgagaaaaagcagcgggaaagatatttataaatgccattttgttcaaagtgctacggtaaccacacttttcattgacaaatgataactttttatccatttattttatgtacagtactttagcttgaatagggtggacagcccatattcatcttgatgacatcagtatgttctaggttctgtctttatccacatcatccatgattcaatgttgagtaaatctcttaaaaattacttaacatcttttaagttgctgtggcaattagcactaagtctatgcaaatttcacttccagttttgcaactaattagatacaatattaaagttcttaatagattaaaatgctttttggggataaggtctttaccaccagctacaataaacagtaaatactcacaaaaggaggggcttcactaataactggacgaatcacattttgcatattgcgtttattttgcagaaaatgctttctgctgattgtctttggctactttgtcaaaagaaaaatatgaaacagttatagtttaacaacacaagagattagctacatatgcttaaaatacacacattctagggggcagagcagtcaaattttcaattcaactaaaacctgctgtcctcaactatgattttattctgtccttaacagctcaactctaactacttgaaagcaacaaggaagaagattaagagtgtgctttttatctcactaaagtaggactggtggagtttacaaattctggtgtgccaaagttgccaatacactgtatgagaaataaaccaaaaaaagtttctggaccctggcaaacattttttcaccgtcagtgaggttgggccaactgcatcatctccacagttgggttcatctgtaagccacctgggacagcaccgctactgcaggtgtgagcaagggatgctggggctctggggaaaggtgccgtgtgctcctccactgctttgaaaaggaagttactgaggctgcatttccttcttaacctgagactgccactgggtacctagtaggtcaatccagtcaccactggctgccacgacaaaaagtcactgcatctttcgggacctgggccttgctgcttcacatggaaggtggcgacacaggtgtccatgaggctatgaggcggccttgggctgcggcgtcgtactggctgtccacgatgtctgtggccgcggccgccccttcgtacagtggggatcccgaggaagagggcgccgagaccggatgggtgaggggtgtgtagtgcgcgggggagccccggaagaactgggcccccagcccgttggacacggctgctgcctgggagcccggggtgacggcgccgttgctcacagaccacaggctggggtactgactgcaacagaaagacaccagtgagcagggcctgggcaggggctgcaggccagctaaggatggaaaaacacaccagaaatcccattcggagtgactgtgtaatatgacagttttcttctttcaaacaggtcattttctccaaattattaaaggactcacaagcacattctgtgatgtatagaagttattgtcgtatctattaataagaaacaaaatcatcaggaagatgactgaaaagattattcacatattcagagctcatgaaagagcgctgttaagtttcactgcgaaagactcataccaggccagccgcagtgggtgatgcctgtaatcccagtactttgggaggccaaggcaggtggatcagctgatgtcaggagttcaaggccagcctgactaacatggtgaaaccccgtctctactaaatacaaaaaattggctgggcatggtggcacatgcctgtaatcccagctacttgggaggctgaggcaggagaatcgcttgaacccgggaggcagatgttgcagtgagctgggattgcaccattgcactccagtctgggcaacaagagtgaaactccgtcaaacaaacacacaaaacagaaaagaaagactcagaccagtagttttgcactctcattcagaataaaacttttcagatagtctcaaccaaaagttactgaggatgggcttaagtacacatgtttttatctaggacaccccacccccaccaccgcagtgattctcacgatgaagaccagcctctcctcaaacactaagcagcagacattccttagagtaactccagtacagacacaattccctgcactttgtcctgttcagtacataggtgtgctagcatggtgcccagcagcaagaaaagcacctggcagtcagactaggaagccattcccagttccgcctttacctagctgtgtcacattacactttgcctgagactacttataggctgtgtttctcaaggcataaaatgaggaaggtggaaatgactattgaattctccagtctaagcacatggaagtggatagcattcaattatggtaagattttattttgggaaataaccttgtctttctacaagtgaataatgagaccttatgttgtatcaccatactgttttaaacaagtctgagttaatcaaggcagatttttatgccattttacaaatgaaagcttcaggttctaagatgcccaattagagccacactgagaccctcgggtggggcctctgtcaacagcttgcagtgtgcgggtcatctgatcgggtgcaggcttctggggcgatgctcttggagcccctgaaagcttcgcttgtttacgcattgttgctctgtttctaaccgcgggcaattgaattcttattatgaaggaactgttttctagacaagaattaagatcgcaggcatattttggtattctagaaaatgaagtgcattgcctttgaggtcaagatcacttaattccaggctcactctgctgtgagctggtccaatcatttaatatctctggccctccttcctccctagaaagtgagggttgacttctagctttggtattttaggtttttatattcatcctatgaagaaatgtaagacatttaccagcctgcttaatttgtaagcctttttccctctgcataacttgcaagttggtaacaaaatagtcatcattgtttaccagttacctagcacatatattaaagacttcgagcctgtatccatagaaaagccaataaactcatttccttcatttactagcttttgttggaaaaggttccgaaacgatctctttaagctctacctactgaccccaacaaccctgtaggagacaggccgaggctgggttatttttttaccaccttccttttatatgtgaggaaactgaggcccagagaggctaaaagacttgtccatcacgtgaaccagtaagtggcagaaccaggatggggaccctggtttcattcagggatgggatagcgcagctcccattccacacctgggttgtaaaggagcccagtccttccagcgaacagactgcaaacaggaactcggcagtcatgtcacctgcaatccctgggcatagctggctaataaagaattctaaataaagacccaaccacccacagggaccaaggagaataaggactaagggcctatgggaatggaaacagcgtgaagtcacaggcagagctcccaggatgctttgcaccaggtcctggacatacattacctggagctggtaggtgggctggcattgtggctcacggggagcatgctgggatgggcaggcattccaaggctggaccaattgtcatgggattgcagcatggataaacatgcaggtgagttgtcagaataggctaaggggggaaggtaacaaagtgcaattatagatggtgtcttccaagaacaacaaagtacagtgaaataccaccaataactgaagctacgtaacactgaaaacaaaatgtacatgggatattaactgtagaaaacaatccattagtctatttacatggttatcaggggcaagatttattgccaaatatatgtatttgaaaacataccctggtaaacccaagctttttcccttat

SEQ ID NO: 450 - DNA, 7530 bp, Homo sapiens
agacctcgtagtcctttctttagagttcagtatgtcctatattctttcaagccttagagttccttaggtcctgcacattctgtatcaattctaggaaaaagaaactgtctaaggccaggtgtgggagctcattcctgtaatcccaccactttgggaggccgaggtgggtggatcacctgaggtgaggagttcgagaccagccgggtcaacatggtgaaaccccgtctctactaaaaatacaaaaattagctgggcatggtggtgcacacctgtaatcccagctagtcaggaggctgggacaggagaatcacttgaacctgggaggggaggttgcagtgagctgatatcatcccactgcactccagcctgggcaagagaatgagcctctgtctcactctgtgtgaagcaagataaaggagaaaaggattattaatccagatgcagagattatttagaagagactttttagataaagtcagaggctgaaaatcctattgaaaatgctcttataccttgttcaagacagagaaaaacgtgcttctaataaaattgactaggccggacacggtagctcacgcctgtaatcccagcactttgggaggccgaggtgggtggatcacgaggtcaggagatcgagaccatcctggctaacacgatgaaaccccgtctctactaaaaatacaaaaaattagtggggtgtggtggcgggcacctgtagtgaacccgggaggcggagcttgcagcgagtggagatttcgtcactgccctccagcctgggcaacagagcgagactccgtctcaaaaaaaaaaaaaggtgactaaacagtccttcttagaaatatctggacttaaaaggtttaatgcagcttccacagaatgcaggctttaaatcctaaaacccttccttagtacttggttgtcatggataacagtattcacatggataactgtaactctacaaagtataaaaagtgccaattttttcttcattaaacagaagtgtcttaaaatgcgctatttgtgttttattcctttattcatttgggtgaaaagatggataatgttgatttcttattttaaaacaatatacataaggtactttcattctgtcagtgttgtacaagccactaaaggtaataaaactaaaaccacacaacatctacacctagcaaaacatattctcaggtaaagtcattatcgtgtacaatagaaacgttcaaatcatcctcaccccttcttccatataaattatctttccatacccaccaccttagttgctaacttcatcaactcaccagacttatggaaaagtccccataatgctgctagaagagtgtttccatataaatctgatcaaattattctcctgctttaaaagtcaatggctcatgtcaggggcggtggctcacgcttgtaatcccagcattttgggaggccgaggcgggtggatcacctgaagtcaggatttccagaccagcccgaccaacatggtgaaaccccgtctctactaaaaatacaaaaatcagccgagcgtggtggcgtttgcctgtaatcccagctactagggaggctgaggcaggagaatcgcttgaacccgggggacggaggttgcagtgagccgagatcactccacttcactccagcctgggccaaagagtgaaactgcgtctcaaaaataaacataaaaataaattttttttaaaaagccgatggctcttctttacatacagaataaaggatcttcacaatccagccccactctattattccaaccttaacccccccatccactcatcctacattccagtcaaactgaactacttgcagtgccccggtttcaatatctgcacaggatgcctcccttaacttggaatgccctagtaaacccccgccatccctcacaatccaactcgaatgtcacttcctctgtgaaaccttctcccagacaccgtggcgatggtactatactgtctgtactcacacgcatagcattctcgcactttgctgtttacactttacttccagtagtccatgaacttcaaacattaactgatcccttactacgtagcagagtgtgagccagaaattgtgaggaatgcaagagcgagcattcaaggtttcagtcctcaagaaattcccaccgtaaaaacaactttaaatggcacgttatcgactgcaaacctctttcacataccttagctcagatgatacccaaggatttcatggactgcttaatttctcccactagctccccttctcgtcatctgctccaggctcctggagggcggaacccactacagggctttgaatgttacccaccaaccttcccagggccccgctgccgcctctcaaggggaaaccaggagcacaaagctccacttaccgcaacttccgcggagctgaggtctgtttgcagggtaggagcgggagccggctccaaggagcgccaccgccgactccggccccgcctctgggacgttggggtcgcgggaactgaggcggcaaacacaagctcgcgaaactgaaggccgcgccacgcctgctgactggtcagaaacctcgccagtcagggagcgggggtggtgctagagagccgcgcacggtcgccgttacgtattggtgtgccgaccaatcagcgccccgcactggttccgcgctcgaccaatcccaagtcttcttggagaactgcgggcgccaccggcgctccaggatcaaggatccgaggatttaaacctttcatttcgtcaacggttaagttccggggcggggtaggctttccgcaagcgcaatggaaagcccagctaggtagacggaggagcgagtggcagatgaagccggaagtgctctataagatgatcattggtcggcgactggaagcggacacccgaagaacagtttccaaactctttacctgaaagcacaaaagacaagaaagttagagttattccagtttcttactttttaatttttattctaaaatgtacatttttaatttttcctttttgtgatcacttatcctcaacttctagatttcttccagtttctttcctaggaagccatctgttttagtgacataattttttttttttttgaggtggaatctcactccgtcgcccaagctggagtgcgatgacgcgatatcggctcaccgcaacctcgcctcccgagttcaagcgattctcctgtctcagcttcccaattagctggtattacaggcgtccaccacccaccaccacgcccggctaattttttttttttttgaaacggagtctcgctctgtcgcccaggctggagtgcagtggcgcgatctcggctcactgcaagctccgcctcctgggttcatgccagtctcctgcctcagcctcccgagtagctggaactacaggcgcccaccacgcccggctaattttttgtatttttagtagagacggggtttcaccgtgttagccaggatggtctcgatctcctgacctcgtgatccgtccacctcggcctcccaaagtgctgggattacaggcgtgagccactgcgcccggcctaatttttgtattttttagtagagacggggtttcaccacgttggctaggctggtctcgaactcttgacctcaggtgatctacccgcctcggcctcccaaagtgctgggattacaggcgtgagccaccactctgggccaaaatttgtatttattaattgattgattgattgattgattgagacagggtcttgctctgtcgcccaggctggagtgctgtgacgctatctcggctcactgcaactcactgcacactgccttccaggttcaagcaattctcctgcctcagcctccggagtagctggggttacagacaagcaccaccacggccggctagtttttgtatttttagtagagaccaggtttcaccatgttgggcactgggctgatctggaactcctgacctcaagtgatctgcccacctcggcctccgaaactgctgggattacagaagtgagccaccgcccccagcaaagtaacataaaaattttaaattcctgttgagtagaagaaaagaatgtgacttaaatttataaaccatatatgcctatctctacaactagcattgatattatatatagtattgatattttatgtatttatatacagtcagccctctatcagtgggttccatattcacagattcagccaaccgcaaatggaaatattcggaggggaaaaaaacaaaataacaacaataaaaataatacaaatccagtctgggcaacatggcaaaaccccatctctacaaaaaatacaaaaaaattgccaggcatggtgtcatgtgcctgtagtcctactacttgggaggctgaggtgggaggacggcttgagccggggaggcagaggttgcagtgaactgagattgtgccattgcactccagactgggtgacagatcaagaccctgcctcaaaaataataatacaaataagacacacatgttgggtgcggtagctcctgcctgtaatcccaacactttgcaaggccgagatgggaggatcgcttgaggccaagagttcaagaccagcctgggcaatatagcagcaccctgtctctacagaaaatttaagaattagtggggtgtggtagtacaggcctgtagccctagctactgggaaggcttaggtgggaggattgcttgagcccaggagtttgaggctgcagtgagctatgattgtaccactgcactccagcctggatgacagagcaagaccctatctctcaaataatttaatttaaaactataaccaatttgaccgggtatggtggctcatgactgtaatcccagcactttgggaggccgaggcgggtggatcacctgaggtcaggaattcaagaccagcctgaccaacatggagaaaccccgtctctactaaaaatacaaaattagccaggtgtggtggcacatgcctgtaatcccagctactagggagactgaggcaggagaatcgcttgaacccgggaggtgtaggttgcggtgagccccgagatcacgctattgcactccaacatgggtgacaagagtgaaactccatctcaaaaaaaaaaacaaaaacctataactactttttacatagcatgtacactgtattaggtattatacaatgtgttaggtattatacaattagttattatgagtagtctagagatgatttttttttttttgagacagggtctcactctgtcaccacagactcaacttctggctgaagtgatcctccacttcagcctccctagaaactgagactacaggcatatgccaccatccccaattaatttttgttttaagatgatttaaagtataaggatgactgtacattggttatatgcaaatactatgccattttatataaaagacttgagtatctgtgggccaaatttggtatccctggggttcctggaaccaatcccccatggatacagagggaagactgtttatatggtattaatattcctttgataatttgtaattatttccacagctaatgtggtaatagtgctttctccaccagtatctgatattattctcctaaaagccaaagtagagaagtgttatccctatttaacaagagatgaaatgtgttaagatcccacagctagttagtgcagagacaggatttgaaatgtcacttattttcctcaacactccacttttgttagtttcctgagcaatatggaaatatcttaaagtccgagctgtatttgtaggctgctctggtcagaataagcagctacccttttaagagagtgaaaacactattctgaaaaatgtatcaaactagcaaagaaatatgtgctctaagaccaggtgtggtggctcacgcctgtaatcccagcactttgggaggctgaagtgggtggatcacctgaggtcaggagttcaagaacagcctgaccaacatggtgaaacaccatctctactaaaaatacaaaaattagctgggcgtagtggtggacgcctgtaatcccgactactagggaggctgaggcaggagaatcacttgaatttgggaggcagaggttgcagtgagctgaaatcacaacactgcactccagcctgggcaacagagtgagactacatctccagaaaaaacaaaaaagaaagaaagatgtgctctgtagagcatcattctctgctttcctgaaaaaattcttggcatctagggtacaaattttaaggggaatgatggtcagttcctgagctctagtgtgagaacaggaagggcctcagacagccatgcatgtctgacaaactgttggccagcccaataaggagctccagagcaaagattgcccattacaggagtcccacattaggcagaaatggctaggccctagaattcttgctgtgcctagtcattgcctgaggcttccaagaaagaacaagcaccaaagctaaggcagattccaaaggaggctgtcaggcaactgcagtctttgcagctgactggaaagttctttctggaaagagatctaagtcattgagatcactgacacatctcaatgacggccattggttacatgaagtgcaaaggccctgagttacatgggaagcctttggaaaatttttttttttttgaaacagagtctcactctggtgccgggcctgaagtacagtggtgtgatctcagctcactgcaacctacgactcctgggttcaagtgatgaaccctgcctcagcctccgagtagctgggattacaggcacccgccattacgtccagctcattttttgtatttttagtagagacagggtttcaccatgttggccaggctggtttcgaacttctgacctcgtgattcatctgcctcagtctcccaaagtgttgggattacaggcgtgagccaccacccccagcctggaagattttatatacaggactgacataatctgattttaggtttttgtttgttttgttttgttttgttttttgagatggagtctcgctctgttgcccaggctggagtgcagtggcgccatctaggctcactgcaacctccgcctcccagattcaagcatttcttgtgcctcaggctcccgagcagctgggaatacaggcccctgccatcacgcccagctaatttttgtatttttggtagggacggattttcaccatataggccctgctggtctcaaactcctgatctcaggcaaccctccctcctcggcctcccaaagtgctaggattacaggcgtgagccactgcgcctgggtgaggctatgattttaggttttaaaaggaccattgattgctatattgagaatagactgtttggggcaagggcagagatgcaaggggaccagttaaaaaactgctgcaataacttagaagagagattgatggtagcttggaccagaatggtagcaatggaggtggtgagaggttattgtattctggatatattttgaaggaataatcaatactatttgattccagattgaatttagcatgtaaaagaaaggaacgctgtgtcagcttctcatgatttatgat

SEQ ID NO: 451 - DNA, 7860 bp, Homo sapiens
agatgtttgcacagaatatagacttatttgagcacacttacatagaaaaccctcagaaaaataagttttaatgaacattaaaaacctgaaaaaactaatatctaaattataagaatcccacaaatataataaaataaataacaattcatgtatcagcaattaagggcaacagatttcaaagtagttatataacaattcttacctttaaattgttacacatattttttctggtttgcttttcattgttccttctgttgttgtcttaaaatcacactatacatcttaaaactgtactacacaaaattcagttattacttgtactgaattgaaatatgaatctctgcagttttcacctattggtcttgacagaatcccatatgtagtgccattccaagatggccgaataggaacagctctggtctgcagctcccagtgtgattgaggcagaaggcaggtgacttctgcatttccaactgaggcacctggttcatctcactgggacttgttggacagtgggtgcagcccacagagggcaagccgaagtaggacagggcatcacctcacccaggaagcgcaagaggttgagggatttccctttcctagccaagggaagccgtgacagactgtacctggaaaattgtttcactccagcccaaatactgtgcttttcccatagtcttagcaaccgacagaccaggagattatctcctgtgcctggctcgatgggtcccatgcccacagagccttgctcactgctagtgcagaaatctgagatctacctgccaggctgcagccagccagggggaggggtgtctgccattgctgaggcttgagtaggtaaacaaagcagctgcgaagctcaaactgggcagagaccactgcagctcagcaaggcctactgcctctatagactccactttggtgggcagggcatagtgaaacaaaaggcagcagacagcttctgcagacttaaatgtccctgtctgacaactctgaagagagcagtggttctcccagcatggcatttgaactctgagaacagacagactgcctccacaaatggggccctgacccccacgtagacgaactaggagacacttcccagaacgggctaacagacagctcatacaggctggtgcccctctgggacgaagcttccagaaaaaggataaggcagcaatatttgttattctgcaacatttgctgttctgcagtctccgctggtgataacctggcaaacggggtctggagtagacctccagcaaactccaacagacctgcagctgagggacctgattgttaaaaggaaaactaacaaacaaaaaggaatagcatcaacatcaacaaagaggacatctatgccaaaaccctatctgtaggtcaccaacatcaaagaccaaaggtagataaaaccacaaagatggggagaaaccaaagcagaaaagctgaaaattctaaaaaccagagtgcctcttctcctctaaaggattgcagatcctcaacagcaacaaaacaaagctgggtggagaatgactttcaccagttgacagaagtaggcttcagaagatcagtaaaaagaatcagtaatgagcttctccgagctaaaggagcatgtttgagcccatcacaagcaagctagctaaaaaccttgaaaaaaggttagacgaatggctaactagaataaacagtgtagagaagaccttacgtgacctgacagagctgaaaaccatggcacaagaacttcatgatgcatgcacaagcttcaatagctgattcaatcaaaagggtatcagtggttgaagaacaaattaatgaaataaagtgagaagacaagtttagagaaaaaagagtaaaaggaaccaacaaaacctctaagaaatatgggactatgtgaaaagaataaatctacctttgattgttgtaccagaaagtgatgaggagaatggaaccaagctggaaaacactcttcacaatattatccaggagaacttcctgaacttagcaaggcaggccaacattcaaattcaggaaatacagagaacacaacaaatatacttcttgagaatagcaaccccaagacacataattgtcagattcaccaaggctgaaatgaagaaaaaatgttaagggcagccagagagaaaggtcgggttacccacaaagagaagcccatcagactaacagcggatctctcagcagaaaccctacaagccagaagagactgggggacaatattcaatattctgaaaaaggattttcaacccacaatttcatatccagccaaactaagcttcataagtaaaaaagaaataaaatccttaacagaaacgcaaaggctgagagattacaagagccttataagagctcctgaaggaagcactaaccatggaaacaaataaccagtaccagacactgcaataacatgccaaattgtaaagaccatcaatgctaggaagaaacagcatcaactaatgggcaaaataaccagctaacatcataatgacaggatcaaattcacacataaccatagtaaccttaaatgtaaatgggctgaatgccccaattaaaagacacagatgggcaaattggataaagggtcaagactaccagtgtactgtattcaggagatccatctcacatgcagagacacacacaggctcaaaataaagggatggaggaagatttaccaagcaaatggtaagcaaaaaaaaaaaaaaaaaagcagtgatggcaatcctagtctctgataaaacagactttaaacgaacaaagttcaaaagagacaaggccattacataatggtaaagggatcaattcaacaaaaagagctaactaccctaaatatatatgcacccaatacaggagcacccagattcataaagcaagtccttagagacctacattagactcctacacaataataatgggagacttgaacaccccactgtcaatagtagacatatcaatgagacagaaggttaacaaggatatccaggacttgaactcagctctgcaccaagcagacctaatagacatctacagaactctccaccccaaatcaacagaatatacattcttctcagcaccacactgcacctattccaaaattgaccacatagttggaagtaaaacactcctcagcaaatgcaaaagaacagaaatcacaaaaaaactgtctctcagatcacagtgcaatcaaattagaactcaggattaagaaactcactcaaaaccgcacaattacatggaaactgaacaacctgctcctgaatgactactgggtacataacaaaatgaaggcagaaataaagatgttctttgaaaccaatgataacaaagacacaacataccagaatctctgggacacatttaaagcagggtgtagagggaaatttatactactaaatgcccacaagagaaagcagaaaagatctaaaatcaacaccctaacatcacaatcagaagaactagagaagcaagagcaaacacattcaaaagctagcagaaggcaagaaataactaagatcagagcagaactgaaggagagagagaaacaaaaaaaccttcaaaaaatcaatgaatccaggagctggttttttgaaaagatcaacaaaattgagacaccattagcaagattaataaagaagaaaagagagaagactcaaatagatgcaataaaaaatgataaaagggatatcaccaccaaccccacagaaatacaaactaccatcagagaatactataaacacctctacacgaattttgaatcactgaatcgaccaataacaggttctgaaattgaggcaataattaatggcctaccaaccaaaaaatttccaggacaagatggattcacagccgaattctaccagaggtaaaaagaggagatggtaccattccttctgaaacttccaatcaatagaaaaagagggaatccttcctaactcattttatgaggccagcatcatcctgataccaaagcctggcagagacacaacaaaaaaagagaattttagaccaatatccctgatgaacatcaatgtaaaaatcctcagtaaaatactggcaaaccaaatccagcagcatatcaaaaagcttatccaccaagatcaagttggcttcatccctgagatgcaaggctggttcaacatatgcaaatcagtaaacataatccatcacataaacagaaccaatgacaaaaaccacatgattatctcatcagatgaagaaaaggcctttgacaaaattcaacagccttcatgtgtagggagaccccctgaaactattgctatggaataaaagatgaaatgcaactgattattgtaaatacaaaattgcatgcaggattgtgtaaagacaatgccaggctgggctgccagaatgagccaacagcgcgtgatgtgcttccccctgcagagagcctatgaacggatgtgcagtcagggaggtttcacatcaccaagattcctatcccaaaaaagcaaaggttcatagctctgggaatggaatgcaacccttgtggagagcctataaacagacgcatgaagggcgcctgttcatatggataagatagggctataaacaccctcatcttgccacggctcttctaggtctttttagggttaagacatactcccttctgagaatttctggtctaaccagttgtctagtttcaggtcctgtatctatggattgtttgtaaacagcttttgctgcaactgttactgctgattaatatcgtgctaatcataggttatggaaagacagtgtttctgttttaaggctgttaggaattgctgatgcacacactatgtcgtaaattcttatttctgtatgctgtacttctgcacagatgttatgtcaaagaattacttcatccccatgtgaccatctcacctcataatcaaatgaccgtaaatctctcactaacctacccctgccctcactaaacttaataacaaatgctggcatatccagtgcattggcagcatcacaggaccaaaaggcagtgacccccctggacccagctttcactattttctgtgtttcttttatttcttgacctgccgatccacctgggaacaaagagacagccccgttgcattgcgggctgctggccagatcccgcaatattcatgttaaaaactctcaataaactaggtattgatggcacgtatctcaaaataataaaagctatctatgacaaacccacagccagtatcatactgaatgggaaaaaactggaagcattccctttgaaaactggcacaagacagggatgccctctctcaccactcctattcaacatagtgttggaagttctggccagggcaatcaggcaggagaaatcaataaagggtattcaatcaggaaaggaggaagtcaaattgcccctgtttgcagatgacatgcttgtatatttagaaaactccatcgtctcagcccaaaatcttaagctgataagcaacttcagcaaagtctctggatacaaaatcaatgtacaaaaatcacaagcattcttatacaccaataacagacaaacagagagcccaatcatgagtgaactcccattcacaattgcttcaaagagaataaaatacctaggaatccaacttacagggatgtgaagaacctcttcaaggagaactacaaaccactgctcaacgaaataaaagagaacacaaatgaatggaagaatattccatgctcatgggtaggaagaatcaatattgtgaaaatggccatactgaccaaggtaatttatagattcaatgccatccccatcaagctaacaatgactttcttcacagaattggaaaaaaactattttaaagctcatatggaaccaaaaaagagcctgcattgccaagacaatcctaagcaaaaagaataaagctggaggcatcatgctacctgacttcaaactatactacaaggctacagcaaccaaaacagtgtgctactggtaccaaaacagaaatacagaccaatggaacagaacagagccctcagaaataacaccacacatctacaaccatctgatctttgacaaacctgagaaaaacaagaaatggggaaaggattccctatttaataaatgatgttgggaaaactggctagccatatgtagaaagctgaaactggatcccttccttacaccttctacaaaaattaattcaagatggattaaaggcttaaatgttagacctaaaaccataaaatccctagaagaaaacctaggcaataccattcaggacataggcatgggcaaggacttcatgtctaaaacaccaaaagcaatggcaacaaaagtcaaaattgacaaatgggatctaattaaactaaagagcttctgcatggcaaaagaaactatcatcagagtgcacaggcaacctacagaatgggagaaaatttttgcaatctacccatctgacaaagggctaatatccagaatctataaagaacctaaacgaatttacaagaaaaaaacaaccccagcaaaaagtgggcaaaggatgtgaacagacacttctcaaaagaagacagtaatgcagccaacagacacaaaaattgctcatcatcactggtcatcagagaaatgcaaatcaaaacacaatgagataccatctcacaccagttagaatggtgatcattaaaaagtcagaaaacagcagatgctggagaggacgtggagaaataggaatgcttttacactgttggtgggagtgtaaattagttaatcattgtggaagacagtgtggcaattcctcaaggatctagaactagaaataccatttgacccagcaatcccattattgggtatatacccaagggattataaatcatgctactataaagacacatgcacacatatgtttattgcagcactattcacaatagcaaagacttggaaccaatccaaatgtctatcaatgatagactagtttaagaaaatgtggcacatatacaccatggaatactatgcagccataaaaaaggatgagttcatgtcctttatatggatatgaagctgaaaaccatcattctcagcaaactaacacaaggaaagacgaccacacaccgcaggttctcactcatagatgggaattaaacaatgagaacacttggacacagggcagggaacatcacacactgtagtctgtcgtggggtggcgggctgggggagggataacattaggagaaatacctaatgtaactgatgagttgatgggtgcaggaaaccaacatggaacatgtacacctatgtaacaaacctgcacgttctgcacatgtaccccagaacttaaagtataatgaaaaaaaataaacaaaataaaataaaatcataatttaaaaaaatagaatcccgtatgtcacacagaactttctccatattagaaagctttccattttaaaaccaattgtctggtttattctccctaagtctttacttctctatattaagcatcttcatttttttcaaatgttctttgtgctacgtggtttaaacttatgtgccttcacctttctgatcaccttcccatgaacaaatccccagagcatattttttcaaacgctatatttttcatctctagaaattcaatttgtgttttttatttctgccatttctctattatgtaatatgttcaatatttctcctactttccttaacatatggaacatggttataataactatttgacatccttttctattaattataacatgtaatttcaagagaaccctaagagcttgatattcaacataaagaatattatttttgtatgaatgtattacctgataatcagcaggtccaggggtagcacaagcttctttctgaaccgagaagaaagtccgagg

SEQ ID NO: 452 - DNA, 7863 bp, Homo sapiens
gacagagagggtgaaaatggaaaaatcctccagtcatgaggctgctatgccctggggcaggacatggagaagtgggaaggaggtgaggaaggggaagaaggtggccaagacaggaaccagggtgaggggtgtgcagggaagaaccagctcggcctccttccagctgagtgttctcaggaaagccctgccacctctctgatcctcagtttccccatctgtgcaatgggatgatcatgccttcccctggggctgtggagatggtgcagttattgtaggacaagttcccacagaggcctgttctgtgagtgcagagccccctcagtgctgggagctggggggccccacaagaccccactcaggtcccagcaggatgctgtgagctcctgtctcccagggtgtcatctccaagagataggtgtcctgaggctggatggggcaaggtctgaggaggaggtggctcttggggccatggagaggcacagggcaggagtgatgaggaactgagggtcagtctgcagagggcggagagctcaagactcaccttcccagccttgctcctggcctcagtgaaggtgctggttcatgcaggctcttgagtcggcctactgaggagcatgtgtacaatgcacacatgcacacacatctgcatcctcagcatgcacacacacagcacacacatgtcacacatgcgcccagacggtccttctgtctcccatcccacaagatcattctccaggcttccagcccccagtgcccccactgagaagagcctctgaaagtgacagcagggctgaggatctcatggggctagcagctgatgaacatcagcaaggcgtctccaggatgagctgcagctcccccagccagggtctctgctgttgcctagaaggccgggtactccatctctggcttttctgttgcagccacaccaagagcccaaacctggagacctgattgagattttccgccttggctatgagcactgggccctgtatataggagatggctacgtgatccatctggctcctccaagtaaggactgatgaatatataattttcaaaatatttgttaaaaggataatgagagggccgggcacggtggctcatgcctgtaatcccagcactttgagaggccgaggtgggcagattacctgaggtcaggagttcaagaccagactgaccaacatggagaaaccccatctctactaaaaatacaaaattagccaggtgtggtggcacacacctgtaatcccagctactcaggaggctgaggcaggagaatcacttgatccccggaggcagaggttgcagtgagccgagatcgtgccattgcactctagcctgggcaacaagagcaaaacttgatctcaaaaaataaaaaaataagtcaatgagagccactgaaagacagttaagcaagggaaacttgagttaggagacacattcttcttagaggatgcttgatgagattgcacacacatatgtcccatgaagtagacacagtgcattccataggtcctggcagaacggaagaagagaccgttgcctcccgcagcgaagctgggctgcttcagcattgggatctctccagctcaaagtcagttaccttggcatgcagaatctcatacgacttaaaccagccaggtttcttaggtcttaaagaagaaagtttctcaaaaggaacaatgtttctccgtgccagatcctttgcctcatatgttttcacacaacaaggtgtcttgatattatatacttaagattccttactgggagcaattctcacaggtttatacatttttttaaaattctcatacaaatacacagtaagcaataccaatgttttatttaactcattaataacagaagcagaaatatgacatacccagttaaaagcagaatgaaggaaacgtatgtatggatagccaatgaaaggggaaaaaacgaacacagaggccaggcacagtggctcactcctataatcccagcactttgggaggccaaggcggacggatcacttgaggtcaggagttcaagacgagcctggccaacatggtgaaaccccgtctctattaaaaatacaaaaattagctgggggtggtggcaggcatctgtaatcccagctactcaggaggctgaggcaggagaattgcttgaacctgggagacggaggttgcagtgagccgagatcctgagacagtgccactgcactccagcctaggagacagaggaagacattgtctcaaaaaacaacaacaaaaatgcagaaatgagacaatgagactgccaaattaggtaggtgcaggcaagttcatatcctctagggcagtgccactacataacttctcatgttctcttttcaccaagcatttacattgtcactggacaaaaaccattcccatcactatcagggcaagacatttgcatcttatcagttttctccaagccatcatctcccaggcaggattgtaaaaatgtctgaattgatggaaaatagtaaatcaagcccacttaatccagatgatcctcagggaccttgtaagacaaagcatggcaatgaagacacatggtcctttttgtgcctaacttgcagtgtgtaaagaggctttttttttttttttaagacagagtcttgctctgtcaccgggatggagtacagtggtgcaatctcagctcactgcaacctccgcctcccagtttcaagcgattcccctgcatcagcctcccgaatagctgaggctacaggcgcatgccaccacagccagctagttttttgtattttagtagacatggggtttcaccatgttggccaggatagtctcgatctcctgacctcgtgatccaccagcctcggcctcccaaagtgctgggattacaggcatgagccaccgcgctcagccgtaaagaggctttttaaagacaatttttctctctttcctttttttttttttttttcctctgagacagtgtcttactctgccatccaggctggtgtacagtgatgtgattacagctcactgcagtcttttttttttttttgcataaacattctgatttaataaatggtatgaatatatattttgcatactttacaataaagaaaattttgaaagaaaattgatctaaaactgtttccctccaatttccatggtaaagtcaactgcatacagttctttccatgtataagttttacatttgtattttctacaattaaataaatctaaatgttaaattttagcacatatatccaattatgtacaaaattacaatgtcaatttataagtcaagcttacttaaaaatcataaattacaaaaaacacattatgaataattttgttctggaagtatcataccaactcatacgatctaggtgaacccaaaagtaaaaaacaatgattataaattacagtagtgtctgtaaaaccctgttataaaggaggtattcttttaaaatatgtaccttatatataaaagctcctgactccttttaaggaccaaaattattttcagtttaaccattttcattaaaatgcttatttaaaagtatcgccttataaaactgagtatataaaatacaatgcagcccttgataactaagaatctttataaatgctaattatttagtgacctgtttatcaaactatttctgtggatggggtgattttttttcttcctctaaattaagtggccctagactaatatatttatatagttattctgttttcttccgtactgtcatttcacatctctatcagtgagttcctcaggatttgcctttattttacaactatgaaagtcttcaatccaattccctgcttccacacataggacacagaaagcctaaactttccttttttctgggctccaatgggaagcagcatttacaacgtgtctggcttggtaggaggaagattgtcaattgaggtatcatgtgtgttcacctgcctatcttgccctatttctttggttgctgtaaatttcctgcttctcaaatatctggatttttggctacctatttggcttccgtctttggtgtttatatctgtctggttttagcaggtctctctgattcctgactcacagctcctctccttcactaatattcaagtgtgctgcttgcctaactcctcattccttctccttgaatttcactttacaattgcactaggttctatcatcgttggccacagattaccacaaaacataatttcttaaattctgcacatttctaatgcttctaatcttggtttcctacaagatctaacactaagcttgtgttatcctgattacagtgtatgtaaaacaatgcttgtggaaaactaacctaggagaaagcttataggggaaacctgataatgaattttattaaattaataacccttataaaaatttcaaatgtaatactacctggatttgaacttcaatacttttcttaagtaaaattcttaaccacggtagaagttatgtttgttgatgttcactcatctataccctccatattctcagcaaagttggcataaatctgacctgaataaatagggttataacattatcaggcttgtaaaatactttatcaaatcaatgcatcagttaaagcaggggtccccaaccctgggctgtgtgtggcctgttaggaatcgggccacacaataggtgagctgagaggcaggtgagtgagcattctgcctgagctccgcctcttgtcagatcagtagtagcattagattctcataggagtgcaaaccccattgggaactgcacatgcaagggatcaggctcactgcagtcttgacctccccgagttcaggccaggtgatcctcccacatcagccttctgaatagctgagacgagatgataggcgtgtgccaccacgcgcagctaatttttgtattttttgtagagacaggtctcgccatgttgtccaggctggtctcgaactcctgagctcaagtggtccacctgtttaggcctcccaaagtgctgggattacaggcatgagccactgcgcccagccaacaggattttcttaagagggttctaaatgcaaacatcagccttgagattagaaacggggcaaaagaggtaacacacctaattattgtgtgcattaggtactatccattttaataaaaataagataacacctggagtcactatataatggaattggggctccattggttgacagctcttctgtgttcctctctatgtgcctagaactgtgccagattgtaggacagaagacactttacaaaggattccctcagggtcagcccagtgcagtggaaggagcctgccctttggggcttaagagaagcagtttcacatcctgattctaggacttttcatagcacagaaaagtctcatgatgtctctcagcccaatattggtttttaaattgagatgataatattttccttgaaagttaaaaaggagattaaattaggaagtatgtgtaacagcacagcatggtaactgaaacagtgggtactaaacgaattggatctttttccgaaacacaagtgtacaaagctgaacaggtaataaatatgctttaccatcattgtttataatgatgaaaatttttccaatacctaaatgacggataacaggggattggccacagaagtgatgtacatgcatagcatggaatatggcagcagccactggcaatcatgacattcactgacttgaacgaacattcacaccttattttattaaaaaaagagagcaaaatctattagcccggcgtggtggtgggtgcctgtagtcccagctactcgggagggtgaggcaggagaatggcgtgtacccaggagatggagcttgcagtgagctgagatcgcgtcactgcactccagcctgggcaacagagtgagactccatcaaaataaaaaaaaaaagcaaaatctgtgaatccttcaatcacatttgtgaaaggataaacaccagtagttccttagtggagatttcaagcccttctctccctacttcaccttcccctgccagtgagagtgcctctgattgcaggtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtaaggacctctctggataatccatctccctctgcttggggctggactcacggggctgtgcagccaggcgatcactgtgaatgatgcaaatgcagcctcttagagacctgctggctgagagtcaggacctctgagctccaatgccagatctgcttctaatccacagagggtctttggacagttcccttccccccaggcctctccatgtgcagaggagggggtggatggaggagctctgaggatccttcccctctaaaacctatcctgaaaatggctcctgaagttctgggggtcatcaggagaatctgggccaacccaggacaatgacaggtcctgcaaccccccaaagagtactcaggcaagggacgctcagggtccgtggacctgtgtaagagctcaaggacatttgtgtgtaagatctgggcacagcctccatcccttgccccttcacagtctttcacatttgttgccccaaaacactcaactaataagtggcagaaccgggatttgaaccccagctgtccctttctagagtctctgcctgtgatgcctactcagggcccctggcctgcgtgactgaatggttgggggcccttgatgagagagggatggtggcaggagtagaggctttgcggagggaaatccagagtttggcgtggcatgtgatgtctgaggtgccccattagaggcccaggtggagataaggcatggagtttaggctgaagtacagctggagatggaagtttccaggctgcagttgggaatagtacacagtgaccccagggcacgcatatggccatggcctccctaagtctcccctcagcttctgccacagccctccctgtgcaaaggtgtagctcagggaggacccagactgcaaaatagtccccagtctggcccctggagctctgaccctaggaagcgaggcacaaaccttcttccttgccccaaatcagaacaaatgtcctcacttggaagctctctcaaaaggacctcatgggcccattctcaggacaagcccagacaagtcgaacaccaagaagtggtcacagcccagaaaatggagtccctggggatacaaccaacggcttctctgggagaggattctgagccagccagctgggagagaagagaggagatgccaggccttaggggaggcaggagagaggggagagggagaggagttccaggcccttgggagggagaaagtgccagcctggcttgccgtgaacgctcaacaaaagctgcttgctttgcaggtggaaaaggccaaggttgaagttggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgcccct

SEQ ID NO: 453 - DNA, 7917 bp, Homo sapiens
ccatcttcagatacttgtggagaccataagtgagtttctcccctggaaataaaataaaatttgtaaacttcaaattctaatggtactttcagttttagcatactttagtttcccattatgtttgtgaaaatactagcaaacctcactaacttatgcaaaaacaatttttttttttgctgattattctgtattttcccacataattagtcttccccccccctttttttttcttttaatgttgtctccctctgtcaaccaggctggagtgcagtggcaaaatcttgactcactgcaacctcctccttctgggtccaagcgattctcctccctcagcttcccgagtagctgggattacaggtgcccaccaccatgcctggctaatttttgtatttttagtagagacggggtttcaccagttggccaggctggtcatgaactctggacctcaagtgatccgcccagttcggcctcccaaagcgctaggattacaggcgggagccaccacacccggccgaagtcgtacatttttaatgtccttttgggtatggcagactagataaaaattgcctggagtacactgcacagtttctggaggaaggaggcctgcaaggcatgtgggaaacaggagagggagactctgcaggcacactctgcagatgaccaccaggcaagctccctagacctccctacttccctccagtcctactgaggccactgcagaagacagtgagtgatctgccaggtggatgtgttactggcatcaaggaaatgtgctttgtccaacccttctcatgcatctgcctgggacctagtggctcctaagggactgtgtgctcggcatgaacacaggttatgcatagagagtgaaagaatctatttcaccccaaggaaacggcagattggtggattgattgatccttctgtaccacagcacggaaaactgtgagtacaatcataacaggataaacacacactaacaaccactataacaaattattattatcatggttcagttttggatcagggatctgatggcaagagatcaggctcaatttcttagtgtttttggggggtggggtcagaaacatctcagtatttcacatgcccacgtgcatatgcactctcacacctgtaacattcttctgggctgaattctgtacaaaacagccaatggcagacaggatattagcaaccagttttaatataattacagtcaggcaagtcaagagattatttcaggggaatctctccattccattccattccattccattctctaccacactgagaacagtgatataactagttgtgttgttcagtgtttatgtggctaatagttctattttcatagttaattaaccgggttattactggaacaaattcttttagcctcttttattattctaacattccagagaatcctttttagaaatgatttgtcaacaactgctagattgactgactttagtaaagaattaagtagctaatatataaaaagtcagccaaaatactaggtctgtggccctccttgctgggaggatgaagttatttatagttctggttcaggttctcctgcaaaacagatcagatttaagcaccattagttaagaagcacctgtcaattttgagacacagctggtgagctgctgctttaatcctgtcctgcgcatcagcatgagtcatggactctgtcccaaagccgtcaatagccaggatgacatctccaggacacaggttggcagctgccgccttgcttcctggtgtaatctggaagaaatcatggcactatttaaaaaccaacatcccgcagtatcttgagttttgtgcctgacatttgtgtttcagcctggtaacattttaaatgtttaattgggcagaaagactgtaaatctaactaaagataactcttagttggtcagttgagttaggtctattttctcatcctgctgaatgattttgtttcttactaaccacatttcatatccttgtatctgttactctcttttaaaacatcttacataattcccagtgtgaatcatacatttttttgttttaaaaaattattttttatttttcatcacccagaagtctctatttgggaatagagttttactatatttaggcatcttttacattcaggttgaaactgctttcaatccaaatatagcaatccttactatttatcatctttaaaattcacgtaagaggcatgcaatggactttttatctccccccaaaactcaaatgttgaaatcctaaccacaatgtgatggtatttggaggagggacttttggggggtaattaggtcagaagtgaggagccctcatgaatgggattagtgcccttatgaaaaaggcctcagagagagctctcagctctcttgcctccaataaggaggaaacaataacaagtgaggtgtctgcaacccagaagagtttcctcaccagaacccaaccatgctggtatcctaaccttggatttccggtctccagaacagtgagaaataaatttatgttacttataagccacccagtctattgcactttgtttagaaatctgtagagactaacaagaagaggccagataatacacaaaattataacttctcttgaacccttcagagagctaaagtcacagggcaataaacttgaaatctaaggaaagacaggtgccttcaagcaaaggcaagacatgagcacaggctcacctgcatggagcagggcatggaggaagatggggctcccatactagctgttatgaagaattcagctaaaattattaacaaattgctaaagatccagtgtgagttaacatgagcgtacagaactcccggaaaccagagacaaaggaagtttgtattcactcatggtctcttctccacgaatgaaggacagatgaaaccaaactagcaagacagtagattttaattaaaccatagcagcaattacattaaatgtaaatcatctaaacacatcacttaaaaaacagagactatcaaactaggtgaagaagtgagatccaattttatgctgtccacatgtttttcaggggcaggaataaaagaaatacttaagaatacagaatatgggaaaaatatggtttcccataatttaaaatatttaaaaataggaagtttgtaattattactgttgaatattcagttaaagtcaatgattcttttgaccagtatacctactcccaatttttctgggcaaatcccaactatacacctctgtctagacctcacatgggtcttaccttgcctacttctctcatatcatcttacattattcctgctctccctcatccatggtgctgtggccattctgatttccttttagttcctcatgtaggccaagcttgtgccctttctgggggttctcatgcactcttatttctgcctgaaatgcttcccttactcttcactccttctcaacctttaggtctaggttcaaatgctgcactctcagaaagacttcgccaaacatctgaagtagcttctctagtcctcccctcatcatttttcaccattacatcctatttccttaatgaaagttatttgtacttttatgtttgtttatttactcgtgtattgtctgtcttcccaactagactggatgctcttgaggatatgtacaatatgatgtatatttttaatacttcacagtgtataccccagtatttagaataattgaagaatcaattaaaaagcatttgtcagagcttatataaaaaagaactagtccctatatacccaaagattatggcttttaatgtcaacttgtcattgctatgtttgtgagtttctattagagcagaacaatacatactactatcaaatctcaaactgctccaggaagaaactagattatttctaatgctttatttagggatcagtaattcatttgctttttctttatttgcttattctagctatctaattgcggttctaaggaagatacaagttcatctgaataaataaaaattgctaaaataataagttgtcttgtgtcctggatcttctgtctcattactaaaatgtttattgtactcactttatttctatgatcacctcactgtagctatcacaatgatttcccagtaggaacagttaatagaagctgggtgaagacaactggggattattatatcttagcctttgggaggcatttcatagccgttttccatttagaaacattctcagacccagaactgttagtagaacaaaagtttccatccccaaagtgacttgtaaggataaaaataatcttaaacttttaattttctctcatttgtcaaaatcagtattttctatttttaaatgtctaagactagaataattttctttgagttaaaacacagggccaggcatgatgcctcatgcctgtaatcccagtgctttgggaggctgaggtggaaggattgcttgaggctaggagtttgagaccagcctgggcaaaatagcaggaccctgtctctacaaaaaaatatatttttaaaaagctaggcataatggtgcacacctgtagtcccagctgctcaggaggctgagggaggaggactgcttgagcccaggagtttgaggccacagagagctatgattgcaccactgcacgccagcctgggcaacagaggtagacctcctcctctcaccaaaaacaaaacaaaacaaacaaacaaacaaacaaaacacacaagcaggtgtatctcaacatatttgcttttagagcctaacttagcttttctaatataccttaatagagttaagttatgtaatactcaattctgatttggaaaagtctaacttttcttttagctctggttaggatgagtgtaaggtgggatgagtgggggtttgtttctgcatgtgtccacactaattttaaacacacatctgaacaatagcttttcattatctaagtccaatatctattgatatctagagccatacccctgatattggacttagataatgaataactattggatatctaagttgaatatcttagatactgaatattactaaaatttactaacaatattaatactaaataataccatcttatacttatgcaaaatgttacatttgcaaagctccttctcacacgtttgaccattacaactctctaagacaggctggacaaggaaaactggctctggctttcagaggagaagaggtgtctaagtaacctgcggctttgctgctgagcagctgtacagctatgtcaccagctccttcagaagtcagctaggacaggtggttgatagtgatggccagatcccacttctcattttgtattcaacctggttattgctgtcctgagacctctaaggagacagttgatgagaaaaaggaaatagagagaggaatgagagagaaggagaaaacatgatgtctttactttttcctcgttttcaagttcagcgagcccagtgatcagaaaatgactgcgaaattggcctgattttactaagttaaacgatctgttttccctgcattactttatattattactttattgcattattatattctttccttattatattactttgtattagcatgcacagtttattactgttttcccaaattagaagagagagctgaaatgaggcatagtgtttgtcagcggattattttttatttaggttcattagggtctcaaatatcaaaagtaccagagagatcattgaacacggtactgcagtgaatcacttagcaccatgttttcaaacttgtgtgattataagaatcacctggggcccttgctgaacgttaaaggctccagtcctattccagatgctcggaatcaggaacagaatctctaggagaggagccagggaatttatgctttcaacaagcgcctcagatgatttctgttattcacatcaacttatattacttggatctgttggggaaaaaaaagctaactgaaaacacagataaagcatctataatgtcctatttatgtggagacgtaaggcaagcccaagacatggtcctgagatgatgtttctgttaataaaaacgactgaaatagttatggagcaagacaagcacacactgaagcactgcacggtaggcacggaccaaaatcatgagaaaccccattgttcattctccatccctagcaaatagactccgcgtgcctccttggcatccacagccctgcagcacctgcctgccaaagacatttctagagccacaccccacaccggttatattagaatctctgcatgcacctgggcatggctgtgttcagaagtcacatgggcggctttaacatgctgccagggctgggaaccatcaccgtattactattgagaactattatctcacataattcttaagacaatcttacaacatagttatctcttttttaaaatgagaaaatggatgcttggaaagtataagaagcttggttagggtcccacatcccgagaaaacctgaaattcccatctgggtccgcctcgctctatagctcagaatcttctatcatctcgcattgcctctcctgcaggtaatctttccttcaacacctcctagctctttgaccatacttttcttgtggaattctggataggttgtgtgatggcagttcatatacatgttcctttttttctgctgatatattatcttctcaggggttagaagcccatctaagccacagttatatgcccacagtgtctttcacatacgagacattctgcacacagtagatgcttgtgggatgtatgagttacacatgaaccagtacttccacgtagacacggtctgtgttagaacaaaattgaacaggtttttatttacatcaacctttccactacatttgtgttttaccctggaaaagaattgcattccattgcaaacagtcctttctaaaagtttaaacttcaaatgtagtttatattacatgaaatttcaaaagtagtttatgttaaagtcatacactgttctatcttaaagcctgtacaaattaggaacacactaactttttctatattggtactcaagctcatatagcattctcagttataataatcttgatcttggatgtgctctgcataggaaggagggaggagtgaagagggggaagacattttagtgagaaaagacacactggcatcagatatagacaatcattttatatcatgtacacaaaagaagcttgccctgtacactagcctccccttattcacggttttattttctgcagtttcagttatccgagaccaactgcagcctacaaatagtaattggaatatttgagaagtaaacaactcataagtgttaaattgcagctgtgctgagtagcgcgatgaagtcttactctgtcccacctgggtcatggatcatccctttgtccagcgtatccaccttgtctatgctgcactcttcacctgtaaatcacttcgaagtcttagttatcagatcggctgtcacagtattgcagtgcttgggttcaagcaacccttatttcacttaataatggccccaaagtgcaagagcgctgtgcccaagttataaattaaactttatcataggtatgcatgcatagaaacacacacacacacacacacatacacacacacacacacacacacacacgtatatatatatagggtttggtactaatgtaggttttaggcaaccattgggggtcttggaatgtgtcccctgtggatgagaggggattactatattccatattgaaatcttgtcaaagcaaacgatttgcaacttgtctgtgagagtagatctagcttctggatggtccaaaaacttagactctttagaagcttcttataaaaagaaaagatgctcacttgaagaagtgaaccttcaaattcttctgtgaaatgcttaggccagttatacacggtgtttaacaactccctcccctaaactgaacat

SEQ ID NO: 454 - DNA, 7954 bp, Homo sapiens
cagaaatgttaatttcttaaacagtatatgctgaggcatttcataaaatatttaaaagccttttttattataaatgtttataataaacactatagacgttttacgttttagaataatttaagacttacagaaaagttgcaaagatagtatagagactttctgtacactcagtttccctcagaatgaatagtatacattaccatggtacatttgttataaccaagaaacttacattggcacattactattaactgaattccagattttatttggatttcacaagtttgttcatcaatgccttctttctgttccaaggtccaatccagggcagcatattgcatttcgttgtcatgtctccttagtctcctctgatttgtgacagtttctcacttttcttttttatgaccttgacagtctggaagagtactggccaattatcctgtataatgtcaccaatccatgtttgtctgatgattagcctgggttttggggcaagaataccacaggggcaaagtgtcccttctcaaatcataatagagagcataggatatccacatgacatcagtggtagtggtcatcttcatcacttggttatcaagagagtattggcagcatatgtttcccccttaggttactgaggtctgtttcttttctcatcacccctttcagtggagctatgtcatacctgtagagtacaactaatttcatctgtctcagtctctatcctatgttggcacccttttgatgctgctggttgatgtgttcattagggaagtgtgtgtgtgttcatgttagtgtgcatacattaatgtacattctttgtaacataaagttctatacctcttggcaaatacatacaagtatgcatctgatatggttaggctttgtgtccccacccaaatcttatcttgaattgtaattcccataatctccataatttccacaagtcaagggagagaccaggtggaggtaactggatcaccgggatggtttccctgatctgttcttgtgatagtcagtgggtctcaggagatctgatttttttttttttttttgagatggagtcttgctctgttgcccagtggcgcgatctcggctcatgaaacctctgcctcccgggttcaagtgattctcctgccttagcctcctgagtagctggggttacaggtgcccaccaccacgcctggataattttttgtatttttagtagagataaggtttcaccatgttggctagtctggtcttgaactcctgacctcaggtgatccccctgcctcggcctcccataatgctgggattataggcatgagccaccatacctggcctgatctggtggttttataagcttctggcatttcccctgcttgcacttattctctctcctgccaccctgtgaagaagtgccttccaccatgactgtaagtttcctgaggcttccctagccatgcagaactgagtcaattaaacctcttttcttcataaaatacctagccttaggtatttcttcacagcagcgtgagaatgggctaatactgcgtataacacacagtaccacacagaacagttccttcactctaaaagtcccctgtgtacccctttctggctgacaacccacctcagctcaattcttggcaaactcgcaactgttgtctacccctataattttctagaatgaatggaataataaaatatgtcatcttttgggtttgacttcttccatttgcatttacattcgtctatgccactgcattaattaatagcttgtttctattattgaatagtattccattgtatggatgtgccacggttttattcacttgctgactaaagaacatcttggttgcttccaagttttagtgattaagaataaagctgtttaaacattcacacacagatttttgtgttgacacaaccttcataaaccctttggtaaatatctaggagtacaatttttggattgtatagtaagtctatgtttaactttatacaaaaaactggtaagttgtcttccaaagtgactacaattttgcactgccaccagcaatgagtaagagtttctgttctgcattctcacaagcactgtcagtttttctgcattttcgccattttagtaggtgtacagtggtatcttgctgtggtataaacctattttaagtgctctgttgttcattttcaaatttaaatgctacccgaatttttaattaaaaaaacttcatgttgaaaccaagctccccagatatactattcataaaactttatctacagatgtcagatcatgtaaggttttttcttttaacttaatagaagttatttgttctaattagaaaagtagatatatatatgtgtatatatatacacatatatatacacaaaagtatatatatttatgtatatacttttgtatatacttaatatgtgtatatatacacacatacattatgtataccaacaatatacattattggtaatgtgtgcacatatatatatacccacacacacatatataaaaccagtagctctaccatccagagacgaacaccaattttttccaattgtgtgtgtgcacatgtgtgttcagattaaaacacatgtaacaacctaaagtctaaagcaggtatgagtgtacaatgtttgaggaaaagaaagaaagcacggtgtaaggaaagaatgacagtaggcaaggaggttataacagaagatgaatttggagacagaagtcagttcatgtagatcagggattctccaactttggtgtgtcttaaaatctttaggagggcttattaaaacagaaggtagccctgcacccctggggtttctgactcagcagatctagagtggggtctgagaatttgcatatctaatgtgcagggccacacctgagaacacctgtcgggcctgctacactataatgaggagtctgatttttattccaaataaattggaagacattggaatattttaaggacagaatgttgtgatttgttttgaattttaaatagatcatagtgactgaggtatgaaggtcaaatcagagagaacaaggtggtaaatgggaaaatagtaaacagactctttatgtgaaatgatggtgctttgaattagggtagtggggatattaataaatggatggattcagaacaaatacagaaaaagctcacagaagttgcaaatggatctggtgctagggtgagaaaaggggaaacaagggagatgtctaggtcacaggcttatttaataactgcctctatggaaggctttatggggatacaagtcataagttctattacaaaaatatgtggtttgagatatcaatatacaattggaaatactgagtacggaagttggatacacaaatctgaatctacaagaaaaatagtaacaatttgtaagtcattagatacaaatgatatttataatcttccaacctattgaggtcattagtatagattaatggctctcaggcagggttgattttgcactaccctccaggagacatttagcaatgtctggagacattttttatttgactagaggttagggatgttgttaaatatcataaaatatacaaaaaagcacctgccaacaaagaattaccctgctcaaaacatcaatagtgctaaggttgggaaaccctgtaatagatagaaaagttgtctttctagtatgaagagagtaagggagcataagcggtttctcagatataaaattgcatcgaatatatatatatatatatatatatatatatgtcacttatgtatccaatttagaaactgcttaactatattatttgaccagctgataaacaaattaaaaatagctcaagaattacttatagcattagacttaaaatggctgctgttaaacagtgagatatagttacaataagaaaagtaacattaattttacccttaaaattaatataataatagtttaaatgaaaaaccctgattaataaaaagaccatatgttgtctccaaagctcttgtattagattatgctacctgcacacctttgttcaatgaaaacaaatgcacaaatacgtaagcacatgactgaatgagcagtaacacagctctcttaggtattaacaaatacacatatcaataaaatggaagaggaaatctggattatgaatgcagagtcaaaatctctggagtgtagatacagacttacaaatccctagaaatagaaaaattccaagagtataaaggaggtagaagaaaagggtctgaaactaatagaaatcctgacttcagttttttaaaaaatttctagtatacagaatgatcctagcatctttttgcatctagcactgtacaagcagtccattaataccagacagaaattttcaagtaagatttctgaaggttttatttgctggaaaatatctctgaatacagtcttcaggtctaggtaagataggttcacattacagagggcgggtgttggtggcttatgcttgtaatcccagcattttgggaggctgaagcgagtggatcacttgaggtcaggagttcaagacaagcctggccaagatggtgaaaccccatctctactaaaaatacaaaatttagccaggcaaggtggtatgtgcctgtggtcccagctacttgggagtctgaggcacaagaatcgctcgaatctaggaggtgggttgcaatgagccgaggttgtgccactgcactccagcctgggcaacagagcaagattctgtctcaaaaaaaaaaaaaaacccattaaaaaattcacattacagaagacatcttcatatagactactcaattagaacacctacttcatttataagtctgaagatgacctttcacacagatttacctaatgttaatgcttttactgacagcacaagctgagtatagtaagggtatactgggattagaaggtaaacatatatatattctaggtatgaagaggtgactataggaaaagaataatgttaaaaggtgtgagaaaaagggcttttcatggggaaagtggaaaagataagagagacagatgcacttcggagatattctgtgattaatcacaatgaacatgaagagcagatgatttcaaatataaagatgatcctttgaacccagggacaaaaatatgttacatgagaattacccttcaccaagagcaagttggccagcaccattcacattcaatggccagtggagcacatgtgtgagaatgactgagttggtgacaaggaatttgtatttaccccttacacaaccaaatcctatcacaatactttctgtgttatagacaattagatttaataaattagaggtgtatactgggcttgtgggaaataacaaattattttatgtaatttatgaacataaagttcacatatggcatactgatctaccttaatcatgaatccaaagaagttaaaactgttctaccctggacacacaggctgaccacaactcacccttcccagttctttatcttccagggccagaactccagtgctttctgtgaagagtttcactttgaccacaggccgaggatgggtggtggtgaaatctccttgagtcccccatctgtaatgaagtaaaaaaaatgtttcttaaaatgcagcattatttttttccccaaggagatgtgtctccatagaaggcaaattaaatacagaatcttctgtgctcaatgagctttttatctttgcttttgtttctagcagatggcacaatcaagaaggaaaagaacaataagctttacagcttgtaatagttactcagctattcaaaaaattagcatgttggactataaaaaattgcatgttatgagaatttaggttaaggtaaagcaatatagttgtagctattgaaatctattactttattaattcaaatgtaaattatagcaccatttttactggcagctgggaaaattgctcagggtttgtttacgtaagagagagtttctcagaaaatgatttttatatactaaagactttaccccacctgagaggtctttattaaacattatctttttttaaagtaagcataattatctcagatctattacttcatatgacttttgaagctcctgccaaaaagaaagaaatatgcatcataagaatctgaatgttttgtagttaatttcccactacattctcttaggaagggaataagtctgtagacatctggcttttgaaatcatcacaacaaaataacatgctttcttggcttatctcttaattaatagcatcttgcctttattgcagaccagttcattctacctgatttacaaacttaactggcacacacctgatattaaaaaatcttatcaatatttctcacaactctgagagatcagatgcaatgagactcagcacagcatgaagaagatgccattgagcaaaataccagagaaaaaaatgagatttaacaaaatacagatcatgttaaaaataaaacaacaaataaatatcaattttcttatgctgtcttgaaaaaacaaaacaattcaccattttcacggagctgtctacattttattttataaatctcattcggagagcttacaacatacagaaaactcagtaaagcaggtataataaaaattgaacaaataattgtgattgccttcctctcctatcacagcatttataataaatgtatacagtaaagcagagaccatttcaatgactgaagaaactggcatctagatgcagtctttttttttgaaatatcataagccagagggaagagaagaatcaattagggaagaaaacagcttaatttctattttagacttccagaatggggttagcaaagagactttttgcaatttcatataattaagatggtttacataaagcaatggtaaaataggaataaaaacaaaaatagattcagaaccaaaataaggcataaagaaaaattctcagtttagtgtttggaatcttaagccttgaatatagtcaggcaatgtggttaacagcctgggagctaattctcatgacatacccttttaaattcagtgtcacatggttaaatttagaagactaataaccttgggaggcattctcttataactgaaataaaagatttttgatagtcatatagaaacagtctaataggtttccatagaatttgctttttaaaatcctccccataaaacttccatgtattacactgatttttttcctctaatttcaaaatcctttgaaactatttacactacatgttcatttttaattcccaaacctcctgcaatacatgattcttcaaagagaaaagtgaactttgtctttgaacctggtccttctgaaatgcatcccaattccactttgctggatagaataagacaaataacaatgaatgcggaggaaaaaaaaaaactgctcactcatggttccatgaacttccagagaactatcttttacctttgatccttcacagacaagtatattcaaaaactattctacaatatttatcaccatagcacatttctcatttatgcattaaaatatttttatacaatgatatattttaagtgtccataaaatgagattcagttaaagaataatgataaagtgaaaaccaacattcctgccattcaggttaagatggggaatgtactagaacattaggaaagcccttgtgtgcccctggtctcatcttcctctcctctccaccgtcactactctgaagtacctagcatcctgaattttatatttatcactcccttgaatttcttcttaaaaggaatattttcagcattttacctttaagtgtgataactgctctaggttttcagtagtcttttataggtaaaaaaaattcccatatttattagacacacacataaatatatcagaatatatgtgtgtgtatatatatgtaatatatgcatatgatatatacataatatataaaaaatatatatcacaattatatatgaaggagatattgtacgtgtgtatatacgtata

SEQ ID NO: 455 - DNA, 7994 bp, Homo sapiens
actctgttctcatctgtcaatattcaaatcctaactcctaaaattcccttaaatacagcattgagagccttcacttccttatagctacagatttccttttccctactttcctcaaaaattggccaacagcgtaggagaaagatagacagagttacattccagtggggtgcctagttcccactacttccagatctacttttcaggtttttgtcggacgtcacaaaaagcctgacacagctcaagtaaggaacacatgggacaggaaagcacatatgtgtgtggcttcccacctcatccttgaagttccattttgtatatttttagaatgctgaaatagatttgttcaaccggtgtcttcaaaaagtaactgtggaggcaagtgagcaaataagatagttaagtctagtcacttggagagtaataaggcaggaagggtggtcgagagtgaatttcctttcttatgtgctaaatagaatgcattatttagaaaaataagacataagagctgggagaaatctcaggagatgtctactgcccagttttaaagcataaagtgatgataaaaattgcatggcaaagtggacaataggtcaagatctctcctagcatagtactcttttcaccaccaaactaaactgccttacttgatcttggtttgacactgaagttgggaattatgtttattatttgtgaaaatgatagaaatatctgcttctaataattgaaccaaagcaaaacaagtgaaaagctccacagtatagcttctaatgcctcagaccattaataaaacaaacatatttttaaaacaccaaataagtactacatttattgatttaaataaaacctattagggataatttctagagttgtttaatgtactgtattcttagtaatggtcttgagttgcacatactaattgcctaaattaaggaagaaaaaagaaaaaaacatattgactgagcatgtatgatataaagttctccaacattaatatcctcatcagggttcctgggaattctacgtggcaaagagcccagctgagaaagaatagttgttttcagcccagaaggcagagtgcctgaaagctgaagcaatttatcagtgttcaccaggcacttactcttccaaaatcaaacaagtgaagttcctgtagttcttattttacacatgacaatagttcacattgaaaaatctgacaacttaaaaagtgccagtttttttttctctctctctttttttttttttttttattttgaggtggagtttcactcttgttgcccaggctggagtgcagtggtgcgatctcggctcactgcaacctccgcctctgggttcaagcgattctcctgcctcagcctcccgagtagatgggattacaggcctgcgccaccatgcctggctaattttgtatttttagtagagatggggtttctccacgctggttaggctggtctcgaactcccgacctcaggtgattcgcccacctcggcctcccaaagtgctgggattacaagcatgagccactgcgcctggccaaaaagtgtcagttttaaagataacttggattaatttattttttaagtaattgaagtaagaacagcacctgggccaaaactaacctacttttcttaatctatgagtagcttttaatagccatggttttcccagttccactaccaaaacaatcaggaagggctcaactttttcatggctgtggcaaaccttggctatgattgtgcatgtggggtcattgagagcacacagacacttactgcagtgaaaagaacatggcgcaaccagacaggatgaccatggggagcaggcagtaacccagcacgctggccacacagccgtacgacacccctgaagagctcatcaggttcagcaaggcatgaatcacaaggcagccaatggcactcatgccatacacataaccaaactgaacttttcctgcctgaaacgacgtgaagaaaaaacagtttgaacacacaatggacaccgagaggaaatctgaatatcatgaagcagagagcatcttagagtcagttcagtgctgttccatgtctttgtaggactgtcatcaggagactggaagttctgggaaaaacatggccaatggtttgaattcagattctgaaaacaaacacttctgactagagttaggatgggataagcgtgctacaaaaaagattgaatatttctagacttatattttttactctaaattgtccattacgagtacaaggcataagtaagactatattttgttcccatatttattaaacaaataagtgattgaacagaggaataaaaaatccaattttagtcttggagatttacaaggcatattagtaaaattagcaaacacctacagggtttaccatgtcagatcccattctaagtgtgctacatatatttatgtaatccacataacaaccttatgaaatcagtatcattattacaccaactttacacatgaggaaactgaggtgcagagatgataagtaccttgcccaaggtaatataacgctaagcaatggaggttggcttttaacctaggtatttcagctctaaaatttaggtcctgaacatcaacgggaactcttacaagtcctatcccaaaataatggcacatatttaaccctatttaatttagcatttagttgaccacagaatccttttatgtttcatgatacctattgccaggttgattaaccacaccttatgaaaaggtgatttatataaactaactggtaatgaattataaaaggtgtactgtcaaaggaagttagtagtgttcggagtacactaccaatcttctgaggaaaactcataaaaacagccattgctcataaagctagtgttttgtgaatacaagccccaataaattcattcagagaactattacttcagaagtaagtactattacttacagcgtaccattacttcagaagaggatattttaatgtttgctatctgagaataccaaagctacagttaaaaaaattcattaattttttatatttacattatgctgatcataacttctagataaaagttgaataggctgtctctggttttcatgggaattagacaaaaacaatgaaggatctgataaattgattcaggagagaaggagctttttagctgccacttttccttctccatgctattatctatgaagtattttagagatatttattttacaattaatcagggtaatggagaatgtcatagctattttaatgttcaaaattgtttacctattctgaattcttcttcctctgcagttggagagttgatcactacgaagtcctttcataaatattcctgacttttgctggcagaattgtctccagcattagccactgataaattcttatgataccttctgtatgcttgtgactatttaatgaaataatgctaatgatggacatgctaacagaaatacatcagctatccactgctttattgggtgagtttgctccacttgcaaaatagtgacaatttcacatcattgtcatgcattagagaaaccatctacttaatattttacttggatgggataaatctgaggtagggctagtcctaatggtataggacaactctcttacacccaaaggacatctaactggaccttcctgtcctgaaaaggcagttctacaaatggagtggggcaaatagggagtagatgaagctaatttggtagtaaagttgtgtcttttcatggcagttatgtgcttctctcatcatgtctttctcttgttagtttgtcccgtttaagttgtaattccatttagccgaaatcacggccattttaaaaaagtgtttcaaattctaacaagggcttataattgaaatagaaaataaatgttctatttttttaacctcaaaatttttaaggatcctccctattccatcctcattagcacatcttttttttttttttttttttttttttttttgtgatggagtctcgctctttcgcccaggccggagggcagtggtgctaactcggctcactgcaagctccacctcctgggttcattccattctcctgcttcagcctcccgcgtagctgggactacaggtgcctgccaccacacctggctaattttctgtattttttttttttagtacagacggggtttcactgtattagccaggatggtctcgatctcctgagctcgtgatccgcccgcctcggcctcccaaagtgctgggattacaggcatgagccaccgcaccaggccccacatcttgatttaaaatacttagtgttcttctgattgcacttttatattggccatgcatattgctttttcagaccacactcttggccctaccagaaaagttacatggagcaaaagttttaaaccatttgtcttcttggtgttggaaaagaaaataattttggggaaaagaataagtaaaactaaatttgtgctaagtgcttgaagttgttttctttggtttgtctcctttcgcctgaagaaagcctactgaaagaattgtgtcttatgtcaacataaatcttaaaggaggaagagtatgtgactatgactcttatgtctccagagataataagcagatttggatattgattctggatttagttttgctttctctagtaaaattcctgtgtcagccggtaaaatcactcttacattttaattctacatatccaggaaagaattaacctataatcaaatgaattctgagttaaatcatacttcaagtaatattcaattggagtttttggggagtcctttttgctttatatcagaatcaatttggaagttatcacatctaatggtaaactttcaagtgataatgtttgcataaagacattcagaaaatacgtattttcacatattctccacaattttagaattaaatagaacctgaagagccactcaaataaacttttgccttgaagaaaatgaaatgaaagcctagaaatatgaagccaagggttaaagattacagcaagtggcaaagctagggtagatccaattttctcgcttccagttaagaattttttgcctctattgctttgtatttaaaatataagaagggttatgtaaataactccaactaacattatgcatccaagagagatcataatggaattgatgctgttctttaagggatagtaacagtaatattctgccacagaaccaacagctgctttattacaaatgacttgtaaagaaagatgagttaatatattaaattgattgtttctgactatttgattaattgacatggccttacttagcagttaatctaagattatcaaattactgtgacaaagacagaagaagggaggttagagactaaattaaaactctagttgatatagtgtttgatttacagagtatttgcatttgctgtagtaccaagaaataagatgttatcgctaaatactattgtattggatgaatatgacattattggccatattgcctacagaaactagattgctatcagtattttgattgattatatacaataattgaaaagcagaattttatttagttgcaaatgcattttacaactacttttgaaaattgtatatccattggaagaaattattattatggaacatgaagagcaggaaaatggggaagagggctaaatagttattgtaagagcttttcctataatgtttaatttcccatattatttcctctgcctggtttatctctttgtgtcttaatgaaactatacttttcagactgacttaaccatctttatcattttctgtttttaatgtattgccacctcctccttggtataaagtcagagacattttctcatttttttcttctgcctttttttcttaatgaaacattttcctaaactatgagctagaatgtcttttaaactttacttaggtggaagtacatttttctttacttttctagtgacccttaatatcattacttccagatataaagaatgaaagcatacataagacatatagtgaagtcagggaacaaatgtcttcataaaaggtggaaaactaacattttagaggaaatatgtaggttgagtaaacaaaacataggttgtcattgcaaattaatttttcatagtagcctaacccaaaacaaggagatctgtctcgtacctcataagatgttagaaatagtctggagatatatcacagcaaagaagatggtgaccaaagagaagtgacttcttcagtgtcacaatagaactctcacaaaataacaaaaaataaaatgtaggccttatatctcccaaatctatgttttccttccattattccagatttacagtcttttcttaataacaaaaaagacataaatgatctcctgctttgatctgcttcttgatttttgaaattctatttaaatttatactttttagctgttgcaatgcataatggtagcatatttttgtcactatggttaaattattctctctcacttaaaaaattcactatgtaaggtgacacagtttctcttatatttatacagattgcttcaaagccagcactggaaaggacaagcattaaaatctggtgcttcctgtgacacattaccagaagcaaggtggctcccagggctacgcaaaaaagaatgggtccagtgaggtccgtttcattcataatgctgccatctactggcttcattgggtttaacactgtcaaagttttttgccatatgtgatcaaaatggattccaagttctgtaaaaaggaaaaaagataaataatatgataacataaatatagaaaaataaaaataagttacactctttaaaggttaacatatctgattaatttacttagcattttaatctgattgttctatcataccttctaaagttctatgttctgtattacacagaaactcaagttctatgtaacatataataatcttaaaaaacaaactaaaaaataatttggcttccaaagaatgacttaaaataaatatattagagaaacatttccatcaaggaaaacattccctgatttatgcagcaaatacaagctttaaatctaattgaaaattgggaagttggcaatatacagtaaaaaataaaattgtagctaacagatcaaaactttcatcctattgtccatctagatatttccttttcctgcattttctgtttcttttttatttctttttcgaggcagggtttccctctgtcacccatgctggagtgcagtggcacgatctcagctcctccgcctcctgggttcaagcaatcctcctggctcagcctcttgagtagctgagactataggcatgcaccaccacacctggttaatcttttttcttccatagtggcgaggtctcactatgttgcccaggctggtctagagctcctgggctccagggagcctcctgcctcggcctcccaaagtgctgggattacagaccttagccaccacacctggcccttttcctgtattttcaattgctgacacttctgaaatcctgtcatattggccatggcataatttttcaattagcagtactataatgaactaatgagacttagtccaagtctgggtttttacttccactatgcctaatgagaagagcaattttatgctaaatgcttgaaactacacagaggggaaaagggctctttctgtaagtaaaagtgatcatgatgtgcatgcatatttttgtaaggtcaatgtactgtgaagttgagtctatgcattcaaagattaaattcttgagacgagttaacctttctcttttatacatggtagtattcaaataaaatatccaaaatcaatgaggttcagtgttcatgagtccaaatccatttagaaacttctgattttttttctccaattcccatttttaaaatacttctgactgctgcctcataggtccttctgctagaatctgcttctcttattactataaagcaaatacttagccatttgacatcccctgaacatagaaataaatatcgataccagatcagtttcttttctca

SEQ ID NO: 456 - DNA, 8068 bp, Homo sapiens
atttaggtgctgcctaaacaaaatactaatatgtgtggcattaacttagcaggtctgcagtgagaggcacagaaagaaatatgggaggttggaagcctgggatccctgttatgccatagcagaccaagtgcttactaagactgtaggtcaaaggaaggatgttgggaaaacaacgaataataatgtgttgatatggtttggctatgtccctacccaaatctcatcttgaattgtagttcccataatccccacatgtctgggagggacctagtggggagtaaatgaatcatattggaggttacccccatgctgctgttctcatgataagagtgagtgagttctcataagaactgacagttatataaggggcttttcccacttttgcttggcacttttctttcttgctgccatgtgaagaaggacgtgtttgcttccccttctgccatgattttaagttttcagaggcctccccagccatgctggaactgtgagtcaattaaacctctttcctttataaattacccagtctcaggtatgtctttattagcagcatgagaatggactactaaatgtgtactaaatgttactggctgcctttggtaagagagaataaattgatgagcttgcaatatagctaactagtttgtaaggagaaataaaagggaatagagagagtctaggaaagaatctagaaatttggggcattgaagggcattaaagagttggaaaggccaactatttctaggtcccaaaaagaaagagataaggctgagaaaagtcaagccacaaaaggccactaatactcagccttgtggcaaggatcagattatggataggtgttaacttcacatcaccttaatcaattagttaaataacctgcatggtagctgccattaggcagagagaggtatgggccaaagaaacaaatcatgctctgaaattatattatacatagaactggctactattttgatggaatttatataaactaggactaaaaagcctttgaactgtaaaatcagctttagacacccaattttgttcaaacagattatgagctctgaaagctatgcatccccaatagagggcataacctcatcatccacttcgaatgtgggcaagaagatgaaaaaggaagaaactcccacggactggagccagtggctactaagaaaaaatggacaagaacattcctcccaagagcagagtcagagcccaagaaaggaaccgaccccattcccagtgaagagggctttcaccatatcttcccaatgggattttataaatgctgtggatgagtgatgctgtgcgttcttcctcatctgagcaaaggttattatgggcatccttccatgctcacacactgactgctacattccacagttgtttgggcccagcaagtatttgcctatcagattttacagtatttgtactaaggcttgaaagaacagcatcctagaaagacattgatggaaatgcaaaaagattgtttagttaaaaaaaatcattgttttagttatgttcagcagacttgaaaatataccaagttagaatcaattttaaaataccaattgagattcaagaacctgattcagtgatgcagcaggccaggagccatcaccatcaatgaatagctcaatttctctctcatgtagttgccaagaaagatattatctactgaagaaaacctaaatacctgtaagtcttactaaaaatattgtttgatacaagtgagcataggctgactgcttcaaccagtaaaacctaaatctcagtgtcttaatacacacagaaacatacaaaaggatttccttttctctcacataaaaaccaaatgaggattaacaaagtgagaggaatggatgtgctacatgaagtgattcggggacccaattttcttctaccttgtggatctgctatccctgaggccttggaatttgcttttagaccctctatatccacccataacacaatttttttttaaagaaaaagcacaaacaagaaggatcacctgggacgttttaatgggctagtcacagaaacgacatgtatcacttatgtctaggttatattggcctgaagtcagtcgcagggtcacacctaagtgcacacagtgtttcacacgcctatctctaaacacagtagcatacataccacacactaccaaacagtgtttcatgcatatatcactaagcaaagaagtatgtgtgcatcatcacacactggcaaacaaagtgtttaacacatacactttgttatgtatgtgtagcctagttctgtgtcccatagaaaaagcctagttctgtgtcccatagaaaaagaaaacagtttggtgagtgcatagcaacagtttttgccacagtccatcaatttgatcaccaaataaatagcttttgctctttcttcccagaatatacttacctccttgccaaggtaagacaaagccccatccagtcattttatccagtgcaaatttcattgattaaggtgagaaaaatatatttaggtgataacataaaaaaaagttacagatgcatagcaaaatggatttttatattagattttaaaatattttctttgcttttattttaatgctttatcctttacttctggctttgagagtaacaggggaaagatttagcttcttactgtgaagaaacagaaaattagtcaaaaatatatgaaacaactgcagatattgacatgcaccttaagactatgacccctgagaggaatgaagtgaggcccatccatcattctagatttctacctgcaggcacagacctcagagcagggtaggggatcccaaacaaagcatggtggtttcatgtagttgagaagacagaggctggagttcagggaggctgaagtggctgaagttgcagagcagagtaccagagagctaacagatatgtaaaaacagaattccagaaatctgcataggagccccttgagaggtggctggatattaagacatgtaagcctagagcaaaactctacgaggtcaagcagagtgccacacaggcctgtgaggcatctgaggtccaactagccagtgttgagtgtcccagctgatcactcacagaattttctagtgatcccacaatagctatgccttagaaatggtgttaaactctctgtggggtgaagctcactctatacttaccctaacaaaggcttgaaaagaagaaactgaactgcaattaatttaactgcctataagaataaatctataaccaacaatgtgaaatcatcaatgcctggcatctaatataaaattagtagatattacaagaagcagaaaatgaaacccgaaaccaggagaaaaatcagtcaccagaaacagactgagaaatgaaaaagatactgtgtaagtatgctaaaagtcattatatgcctatccaattacttaaaggaaaacataaatacagtgacagaagatataaaaaaagaaccaaaaggaacaatatcaagtggtttacaacaggctgtaattaaagtcccaggaggacaggaaagggcagaaaaataatacaaaaatggcccaaaattttccacatttgatgaaaactacagatataagctcattgaacaccatgcaatataaacacaaaaccaccctaataaaactgattttgttagttattagctaatggcaaaacgtttttgaaagctcatatttatagtctatatgtatacaacctatatggtataatcaacatatattttatggagttatttttgtctcatgttttgttgtgtgataaatgagcagggaattacagaatgttagtatcagaaggcacactgacagcaatcaaatacacacctccaccactgcaggaatccttcgtatactattcctgaggaatggtcacctaatctctgcttaagcaatttcaacgatgataaacttacgactgggtagttctccagatagtaatattttctgtatttctgtagctgagttggcaaattgctttaataaagttaaatgaactctacaaattcaagatttttctaattcatagtcagattaattgaatgttaacctgtaaaaataatgccctactgtcaaatatatgatatgagctcatatttatgtagtgctttattatcttaaaggtactttttcataattcaattatatgtagtgatttcaataccagttttcaatattctggtatactctgccctttttaaataccaaaatcccagcactgttgttacagtttggttattctgatatttaaaatcaacaatctaaattttttaaatattaaattagtatctataactcaattacctaatttatgaacaaaattaatacaatgtacatagtatagaagtctagacaggtcctcacctgtgcacacagcaaaaagcaatcaaatagtgttactgataagcttctgttgcaagaataattcttagttccaaataagtaatttcttatccagtagaatatgaaaataatagtactaaaattgatataggtaactctgctttggaatctcctatacatgctaaaactaattcagatgaagaaaaggtaggaataatttatttgaaatcaatactatatagctctttataaattttttaaaaatccagccccagtcaaaaatcaaaaggtgttttataaatatctccacaaggtcattaagtaaaaaaattggattatttaaatttaaataagtcaaaggaaaatattgggaattagcatgtaatgctctcatcattattgttttgacatcttggttggaaaattctccccaaaatagctattttctattcaacatagtactggaagtgctagccagagcaatcagacaagagaaagaaaaaaaaaaggcatctacatatgaaaagaattcaaactatctctcttcaaggataatatgaccctatacatagaaaaccctacagactctgccaaaagggtcctggaattgataaacaacttcggtaaagtttcaggatacaaaatcaatgtacaaaaaatcaataacatttctatacaccaacaacattcaagctaagagccaaatcgagaatgcaatccaatctacaatagccacatacacaaagacatacacaaaaacccctaggaatatatctaaccaaggaggtgaaagatctctataaggagaactataaaacaccaccaaaagaaatcagacaacataaacaaatggtaaaacattccatattcatggggtggaagaatcaatattgttaaaatagtcatactgcccaaagcaatctacagattcaatgctattcctatcaaactactaacatcatttttcacagaactagaaaaactattctaaaattcatgtggaagtaaaaaggagcccgaatagccagagcaatcttaatcaaaaaggaaaaagccagtggcaacacattaccagacttcaaactatactgtaaagctacagtaatcaaaacagcatggtactggcacaaaaacagacacagagaccaatggaacagaataaagaacccaggaaaaaaaagccacatacctacagccatctgatcttcaacagtcaacaaaaataggcaataaggaaaggactccctattcaacaaatggtgctggaatagctggctagccatatacagaaggatgaaactggacccctacctttcaccatatgcaaaaattacctcaagatgaattaaagatttaaatgtaagccctcaaactataagaatcctagaagaaacctaggaaacactttttttttttttgagacagggtttcattcagttgcctagccttaagtgtagtggcatgatcacagctcactgcagccttgacttgccaggctcaagtgatcctcccacctcagcctcccaagcagctgagaccataggcatgcaccaccatgcctggctaattttttactttttgtagagatggcagtctcactatgttgcccaggctggtctcaaactcctgggctcaagcaatcctcatgccttggccttccaaagtgttgggattacaggcatgaactactaggcctggcccctggaaacaccattctggatgtcggccttgcaaaagaatttatgagtaagtcgcaaaagcaattgcaaccaaaacaaaaactgacaaatgggacctaattaaagagcttatgcacagcaaaagaaactagcgatggagtaaacagaaaacctacagaatgggagaaaatatccatgaactatgcatctgacaaaggtctaatatccagaaactgtaagaaactgaaacaactcagcaagcaaaaaataaccccattaaaaaaaatgggcaaaagacacgaacagacacttatcaaaagaagacatacaagtggccaacaaacatgaaaaaaatgctctacatcactaatcatcagagaaatgcaaatcaaaaccaccataagatgccatctaacaccagtctgaatggctattattgaaaagtaaaaaagcaacagatgctggtgagactgtggagaaaagggaacacttagacactgttggtgggaatgtgaattagttcagccactgtggaaagcagtctgaagatttcttaaagaacttaaaactaccatttgacccagcaatcttattactgggtatatatccaaaaaaacacaaatctttctactaaaaagacagatgcacttgcatgttcatcgcagcactattcacaatagtaaagatacagaatcagcctaggtgcccatcaacagtggactgagtaaagaaaatgtgctacatatacaccagcagttcccaacccttttgacaccaagggctggtttcatggaaaacaatttttccacggactgtattttggggaggggatggttttgggatgaaactgtttcagattaatcattagttaaattctcatctggcattagagtctcataaggagtatgcaacctagatcctccacatgcacaattcacaagagttcgtgctcctatgaggatttaatgctgctgctgatctgacaggaggtggagttcaggtggtaatgcttgctcacctgcagctcacctcctgctgggcagcccaattcctaacaggccatggatgggtaacagtccacggccagaggctggggactcctgatacacaccatggaatactacacagtcataaaagaaatgaaatcatgtcctttgtaacaatatggatgcagctggaggccattttcctatgcaaattaacacagaagcaggaaaccaaatactgcatgttctcgcttacaagtgatagccaaacactgggtactcatggacataaagacagcaacaatagacactggggaccactagagggtggaggaagaaaggagagcaaacattgacaaataactttcggctactatgctcagtccctgggtgatgggattatttgtgccccaaatctcagcattatacaatataccacgatagcaaacctgcacaggtacctctgaatctaaaataaaaattgaaataaataacaacgaagaaaaaataaaatccttatctctcactgtaaaaaagtaaaaataaaaagaccaaggtgaagtcagctcgaggagagttggaagaagtttcattcagtttgagagatgaagccacactaaaccagcagagtgggtcccaatcttttctgtacaatttcctgggggaggcttaaagaaatacatgtgagatcacaatcctgggggtggtgcacatgtctgagtattttacttttagctcttcaggtgagtctgacacacagccaaggttgaggacccatgtaagcaggcgggccagagtgctttttgtccgaggcatgtcctattctctggtccagccacacctgcagcactgaaacccaatgtctccaagcagctgacctttaaagggtccaattcttcttttaagaggaggctgtttgaagagatgtgaatagaacatgaataaggacagcgaaggtacaaatatgctaataaagcagatattccaaccagtttattgtatttttacacacacacacacatatacacaaaaataaataaataaataaaagctctata

SEQ ID NO: 457 - DNA, 8219 bp, Homo sapiens
agtgagacttgccaagttctaaagattcatttaagaggactgtagaattatccaaaggcatcttacaatgtgatagaatcagcttctgagctccagcagctttgcaggaacaagtaaaaattctgcaaagaaacagtacttactgaaataatgctaaccaatttaagtaacattattatcactagtatttttgtttcatcgacgtatagaacatttattgcgagcctcctctacgtgccaagaattgggaatgtgtcaataaatagatcagatctcatcaacccctctgggaactcaaccgtaaatgggacaaaaagtttgaaaaatcacgatggtgtgaagggaaagcataacagagatacaaaccagtttgctggaaattggttagaaaagttctcctgggacgggtgcggtggctcatgcctgtgatcccagcactttgggaggccgaggcaggcagatcacttgaagccaggagttcaagatcagcctggccaacatggtgaaacctcgtccctactaaaaatacaaaaattagccaggcatggtggcatgcacctataatcccagctactagggaggctgaggcaggagaatagctttaactcgggagatggaggttccagtgagccgagattgcgccactgcactccagcctgggcgacagaacaagactctgtctttttaaaaaaaaaaaaaaaaaaaaaaaaggtttccctaaaggaagagaatttaatgcaagaatgtgtatgatctagccaaataaagcaagagggaagaggtgagaaagaaaattttttgtccaaagggaacagtgtgttcaaatggctaggtgtaggtgaaaatatgacatttgtgtggaagtaaaagaagtccaatgtagatgttcagaatgaaacaggaaatgagaaagggcatttcctgagacaagatgggcaaagaaagaaagcaaaaggtgaagcaatttgccctgaatcacacagggctaaaggcagagcccattttaaacccttaccacttgactgcaatatactagccattctgaaattctaagcaggaaactaaaagttcctagagaggaatttcaggggacctttgcaagagcccaaggaatgactgccctgggccaatagctgaccttgccatggatggataaaagaatcaactgatcatcaagcgtccattgtgcagaatgagaaaaaagtctcatcacaattctcaactaataattaacaattactaagcactttactatgtgtaaagccctgttttaagcacttgacatatatttattcaatcctcacaacatcactatcaagcaagtgctttcattatcctatctatctaattttaatgacacagtccaatcatggctattaattttcttgtactgacaacaagaaatgtcaacaatacttcttgacacaatattgaaagcactttagtgactcttctttcagaaaagtactgctcaaatatcaacaaaaaaagactttagaacattaatttggttcctttagcttttctaatttaataccactgtttcaggtccacataaaaaactgagggtaaagtacagagatttcccattgactccattaatgcacagccttccccatattcaacattccccaccagagtggtacatttactacaactgacaaacctacactgacacatccttatcacccaaaattttaggcttcactcttagtgctgtacattttatgaatttggacaaacataatggcatgcatccactatcatatcacaccgaatagtttcatcggcctaaaagccctctgtgctctgcatatgcatccctcccctcactaacccctacaccacattcatttttttattacctccataattttgccttttccagaatgtcatgaagttggaatcatacaatatgtagtagccatttcagactggctcctttcacttagtaaatacacatttaagatttctccatgtcttttcacggcttgataatttctttttggcactgaatgatatattccattgtctgaatataccacagtttatccgctcacataatgaaagacattttggttgcttccaagttttggcaattattgaaaaggatgctataaacttccatataaagatttttgtatggatagaaactgtcaattctttggttgctagatcatatggtaagactatgtttagtttcgtaagaacctgccaaactgcctttcaatgaggctgtaccattttgcattctaaccagcaatgaatgagagttcctgttgttccacatcctcaccagcactggatgtagttagtattttggattttcaccattcaaatatgtatgtagtagtatctcattttaatttgcatttccatgatgacagatgatatagtgcatcttttcacatgcttcttgaggtttgtatatcttctttggtaaggttatctgtcagtgtacctggcccattttttaactggtttgttggttctcttactgttaagttttaagagtccattgtgtactttggataaaagtcctttatcaaatatgtcttttgcaaatatcttcaagtctgtggtttgtctttttattcttttgataagtacctctcacagagcagacatttttaattaaatttaattttttctaacacggaatacgtctttgatgttgaggataaaaactcgctgccaaacccagtcatctagatattctcttacgttatcttctaggagttttatacttttacaatttacatttaggtctctgatccattttgagttaatttttatgaagggtataaggtctgtcgagattcatttttttgcacatagacagttgctccggtaccatttgttgaaaactatcttttctccattgtattgtctttgttcctctgtgaaccattagttgactatgcaatcatgaattgcattaacaatgtttcaggacagaccgtatatatgacagtggtcccataaaattataatatggagctgaaaaattcctattgtctagtgactttatagctgttgtagccattcataacattgtaatgcaattgctttttaaatacatttagtgtagtctaagtgtacagtgtatataaagtctacagtagtgtaccctaatgtcctaagccttcacattcaatcatcactcactcactgactcaccctacgcaacttccagcccaacaagctccatggtaagtactctatataaagtataccatcatcttttaaactgtatgtttacattccttttctacattcagatacacaaactcttactgttatattaaaattacctatagtattcactacagttaacatgctgtacagtctagtaacagtaggctacaccatacagcctaggtgcagagcaggctatacatctaagtttgtgtaaatatactctatgttatttgaacaatgacaaaatcatccaacaatgcatttctcatctcagaatgtatccctgtcattaagtgacacatgactgtactgatgtggatctattcctggtctctctattctgttccactgatctattaaaatatttgtctatgctttcaccaataccacactgcttgatgactgtagttgtaaagtaagtcttgaagtcaggcaatgttggatctccaattttgttcttttctttcaattttaagttgcctattctgggtcttttgcctctccatataaacttattggaatcagtttgttaatatctacaacaaactgcaattttgactagaattatattcagtctacaaataaaattgtgaagaactgacaccttgttaatatagtcttcctatccatgaacatgttatttagttattgtttatcagagttttgaagttttctttgtacatattttatatatattttattagatttatacctaagtatttattttgggagatattaatgtaatggtattgtgtttttaattttagaattccacttgttcactgctggtatataggaatataatctacttttgcatattaaccttgtatcctgctaccttgtgcttattggttccagtttgtcaattcttttggatcttctacatagacaatcatatcatcttgcaaacaaaatgagttttatttcttctttcccaatcagtatacatttcttttcatttttttatcttactgcattagctagaacttccagtatgatgtgaaaaggagtggtaaaacgggacatccttatcctgttcctgatcttactgggaatcttaagttctagattctcaccattacataaaacgttagctatagttttattctcacattcataaaatacttttaatcttccattcatatcccaataccaacacctaattcagtgacgctctttactgcatttaggctgttatgtccccttacctcttttgaaaaaattattatttaccactctgaagcacaattcacatactataacactcacccatttaaaacctacaattcagtattttttagtgtatttacagagttgtgcaactatcactacaatctaattttagaacatttttatcccccccccactttgctgagctgtagatttttttaatagatgttctttctcaagttgaagaagtttctctctattccaagttttacagttacagagtttttttttaaatcatgaatgggtgttgggttctgtcaaatgttttttaaacatctattgatatgatcatatgatttggttttctttagccagttaatgtaatggattaatttcttacatgccttggataaatcccacttgatcacagcatatagttcattttataaatgttgaatttgatttgctaatattttgttggggatttttgcatttatgttcataagagatattggtctacagttttcttttcttgcaatatctttgtctggttttaggattagagtaatactggcctcacagaataagttagaaagtattccctctgcttctgtcttgcaaaagagaatgttaacattggtgtaatttcttccttaaatgtttggtagaattagaactcaccaatgaacccatctggacctggtgatttctatcttaaaagattataaataattgttgactcaatttaatagatataggcctattcagattgtctacttcttgtatgacttttggcagattgcgtccttcaaggaattggtccatttcatctaggttatcaaattcgtgggcacagagttgttcataatattcctttatatttttaatataaatggaaatctgttatgatttctactttcatgtcttctattagtaatattagcgtatcctttttccttagttagcctagctggaagcacatcaattttattaatctcttcaaagaaccagcttttggttttgttgattttctctatgatttcttattttccatttcactggctgttttgtttgttttgagatggagtcttgctctgtcacccaggctggagtgcagtggcacaatctcggctcactgcagcctccgcctcccgggttcaagcgattctcctgcctcagcctcccaattagctgggactacaggcgcctgacaccatgcctggttaattttttgaattttttgtatttttagtagagacggggtttcaccgtgttagccaggatggtctcaatctcctgacctcgtgatccacccacctctgcctcccaaagtgctgggattacaggcgcgagccaccacgcccagcctctgctctaatttttattgtttcctttcttctgcttactttgtatttaatttgctctactttttgtagtttcctaaggcagaaactttggttttagatctttactcttttctatgtattccacgctataaatttccctctaggcattccatttgttgcatcccgcatattttgttaagttgttttcattttcatttagttcaaaacatttttagatttctcttgatacatcagtgtagtgtggcaaaaaaagatgaaaataaaaatttttttaatagatttcttgagaatctttgacccatgtgttgtttaatcttcaagtatttggggattttccagctgttactgatttctactttaattatattgtggtctgagaacagatactgtctgatttctattcttttaaatttgttaaggtgttttatggcccaaaatgttgtctcttgtggtgagtgttccatgtaggcttgagaagaatgtgtattgtgctgttgttggatgaagtagtctatagatgtcaattatatcaagttgtttgacagcactgttgaattcatctatgtttttactggttttctgcccgctacatctgtccatttctgataatggggtattaaagtctccattataagagcagattaatctgtttctccttgcagttctgtttttgcctcacatacttacatgctccactgttagctgcacagatgtttaggactactatatcttcttggagaactgacccatttatcattatttatgcaatgcccctctttattccggataacttccttgctctgagagctgctctgtctgaaattaatatagctattcatgctttctttcggttagtgttagcatattgtatttttctccatccattttcttttaatctatgtatctatatttaaagtgggtttttttggtagacaacataaagttaagccttgatttttcatccactctggcactgtcttttaattggtgtgctgagatcactaacatttaaagtgatcattgatacagttagattactagctaccatatttgtgattgctttctgttctttattcctattttagtcttccagtctttttctgcctgttgtagttttacatgattctattttcctctcctttcttggtatacttttttgcttttttgttttactttttttagtagttgccctggagttcacaatacacatttacaactaatctaagtctactttcaaataacactaaaccactttatgggtagtacaagtaccacgtaataatcctaatacctccctcctatcctttgtatcattcctgtcattcatttcacttttacataagcgcatacatacatacgtgtatatataagcatacataattgaatacactgttgataacattattttggacaaaccatcagttaaaaagataatgatttttccttaagcctgttaatgtggtggatcacactgatttttgaatatttaacctgccatgtatccctagaataaactccatgtgattactatagtgtaagattcttttggccgggcacggtggctcacacctgtaatcccagcactttgggaggccgaggtgggcggatcatgaggtcaggagatcgagaccatcctggctaatacagtgaaaccctgtctctactaaaaatacaaaaaattagccgggtgtggtggcacgggcctgtagtcccagctactcaggaggctgaggcaggagaatcacttgaacccgggaggcagaggttgcagtgagccgagatcacgccactgcactccagcccgggcaacagagccagactctgtctcaaaacacagaagattatttttatattttgctgaattctatttgctaatattttgttaaggatttttgtgtctctataaagaatattggtttttaatttgttgtttctgttctgcctttgtctggttgcagtatcaggataatacttgaaatgttcccttctcttctgttttttagaagagactatgtagattagactctgcagtgaaaccaactgggcctagagatatctttttggggagtttcagaattacaaaatcaatttgcttaatggttatgggatagtagtagtagaatgttggctttttcattactctcatacattgctggtgggagtataaattgatataaactttatagagaacattatgtcaatacccttaacaaaattacaaatgtttttaccctttggtacagaaatataggggttataaccagcattttaaaaatgaaacatggtggggggtggggagtcggatcgcaggacacctagttatggtaaagggtatttcctgaaactgttgtttcagatatgtgtgtatgagtgtactaggtcataacataaaatatatttcttactatgagttgtggtcatagaagtttgggagctattgtttcagctttaaaaggataacctgaggcaaaaattataagc

SEQ ID NO: 458 - DNA, 8275 bp, Homo sapiens
ctccaacccttgcattcttctttaaaaaccaaattcgtttaaatactgggcaggagggtggggtcctgttttgctgagatcccttactcatcttcagatgagtccttccagatgaccccattattactaaacaacccacactcctgaccccaaccgaccctcattgcttctttctgccccccaaccccccaacttaaccaacttataacacgatttattaatcgtgtattgtctccccgctccatcatcctatcctcgaagatagaggcttacccccaacgcctgtcactgaatgaatgaactgttgtctaaggctagcttcttctgccacagggtatttcagcaatggtaagacacaggcctttgcagtagggtctcatctgtgccctttcctcctctccagccctaccccttctctatctagggctccagctcttcctccagaatttttttttttttttttttttttttgagacagagtctcgctctgtcccccaggctggagtgcaatggcatgatcccggctcactgcaacctccgcctcctgggttgacgcgattcctctgcctctgcctctgcctcagcctcccgagtagctgggactacaggcgcgcgccaccatgccgggttaatttttgtatttttaataaagatgggatttccccatattgaacaggctggtctcgaactcctgacctcgtgatccgcccgcctcggcctcccagagtgttgggattacaggcatgagccaccgctcccggccttcctccagattttctaccttccgcaggggtcccttctgtagtttgagatttctgtacttctctaaaaattgtcccccacccccaccccactcctcgctcccctggggttcatgaattaatgaataggagattggtacggcagagaggtaagcaaggccccgacggcccaggccgcctgaggtcagccgcctttctcaaaaccgcgtgccagatatttggaagaaagaactgggttccgtgggcctcatactcgcgaaattttaccctcaccttggccctcaggcctgcctgggctgcactcctaaaggcagccggcgctgttgcctcggggacatgaaagcccgggcagatacagggtgggaggcgggaagcgtggcgggtctcctggaacctccagggcgtctaggagtggtgcgaaaacgccctccctccttcccttcgctaccaagaaagatctcgcagtggaagaggattcgacgctggggatcaccgcggagatccacactcgtctgcccagacccgtccccgctctcagcgaccctccttatgtcccgggccaccccactagccagcgcgttgggccccacctcccgggttgggatccccgcacctgtgcagagtggctgccgagcacccgccagagggcgcgctgactccgttgccagaaccaggggggcaggggcgtgcgcccgaggtcgagcaaagcaccagtacagtggtgaaaagggggtcccctagatgcccccatcaggccaataccctttggctttgtttttattttattttattttaattttattttgagacggagttttggtctcgtctcccaggctggagtgcaatggtgcgatttcggcccactgcaacttccgcctcccgggttcaagccgttctcctgcctcagcctcctgagtagctgggattacaagtgctcgccaccacgcccggctaatttttgtatttttagtagagacggggtttcaccatgttagccaggcaaatctcaaactcctgacctcaagtgatctgcctgcctcggcctcccaaagtgctgggattagaggcgtgagccactgcgcctgacctattttattttgttttattttattttaatttttttgagacagagtcttgctctgtcgcccaggctggagtgcagtggcacgatcttggctctctgcaacctccgcctcccgggttcaagcgattctcctgcctcagcctcctgagtagtgggattacaggcacgcaacaccacgcctagctaatttttgtatttctagtacagatagggtttcaccatgttggtcagcctggtctcgaactcctgacctcgtgatccgcccgcctctgcctcccaaagtgctgggattacaggcgtgagccaccacgccaggcttattttatttttatttatttttgagacagagtctcattctgtcacccaggctggagtgcaatggcacgatctcggctcactgcaacctccacctcccaggttcaagtgattcttgtgcctcagcctcctaagtagctgagattacaggcccacaccaccacgcctggctaattttttgtatttttagtagagacagggtttcgccacattgcgcaggctggtcttgaacttctgaactcaggcaatatgcccacctcggcctcccaaagtgctaggattacaggtgtgagccaccatgcccgggcttttattttatattttattttttaaaattttattgaaacggagtttccctctgtcacccaggctggagtgcagtggcatgatctctgttctgggccctttgcctccagggttctgttgtggctggatcagtgttaggcatctcggggctgcagggagactggctgcagaggaatgggggactgctgagccatgagctttagggagattccaccggcctctaaatggactcagctctggccaccaaatcagcccgaaagccctgagcttagtttggttgcctcaagcctgggatccacctagttcaggtaggggagcttggagcttaggccagcgagagggagtgcaaagggccaggtagcaggaggggcgaagggtgttggctgtgtgctcacccaaggaagatagcacaactagactggctcctaagtctctggatttattctgttgatgaaaagagtcaaactctgtaaaatatttggacactttttttttttttttgagacaagagtctcgttctgtcacccaggctagcatgcagtggcgcgatctcggctcgctgcaagctccgcctcccaggttcacgccattctcctgcctcagcctcccgagtagctgggactacaggcacctgccaccacgcctggctaatttttcgtatttttagtggagacagggtttcattgtgttagccaggatggtctcgatctcctgacctcatgatccgcccgcctcggcctcccaaagtgctgggattacaggtgtgagccaccatgcccagcctggacgctttttttggatggagtcttgctctgtctcccaggctggagtgcagtgacatgatcttggctcactgcaacctccgcctcccgggttcaagtgattctcctgcctcagcctcccgagtagctgggactacatgtgcccgccaccacggccagctaatttttctatttttatagagatgggtttcgccttattggctaggctagtctcaaactcctgacctcaggggatccacccacctcggcctcccaaagtgttgggattacaggcgtgaaccactgtgcccggccctattcagacctgtgaaaggtgctaaactcttaatctcttcaggtttgggagggcctggaagaaaatctagctatgttaatagagattctttacagatgcaaaatttcctccacaaaggacagttttgcaggaccatttccaagtatggcaaagaaacattgttttggaatattttgactttcttgtcacctaatgttatgccagagtcagattgcaaagtaagttccgatatataggattaaataaaacccatctaatgagaatttatggtttgtagggcaaaccatacaatttgagatagtaatttgagcaatattaaaaaaaaaaaatcagggccgggtgtgatggctcatacctgtaatcccagcactttgggagacctaggtgggtggatcacctgaggtcaggagttcaagaccagcctggccaacatggcgaaatcccgtctctactaaaaaatacaaaaatcagctgggcgtggtggcgggtgcctgtaatcccagctattcaggaggctgaggcaggagaatcgcttgaacccaggaggcagaggttgcagtgagccgggatcacgccactgctctccagcctgggtgacagagcaaaactctgtctcaaaaaaaaaaaaaaaaaggtgtcagcctggcatgtggagaacgacccacaggaacgagggcgtgcattgggacatcagtgacgaggctgttgtgggaatagggtagtgtggtttggggagtgtagagctggcaagcccttatgaccacctgagttgtggttctgagaagcatggaagcatccagagctcaggatgatgccaagtctgcagcctgggggatcaggtggatggcagagtcattgtgaaaagggaggaccctcactttctgacccttctccacagtgccagcatgggtcattgctgaccaggccttgccatcctgcccctaatggctgtggttcctaacacatgcagggcctgtggggttgaagcaccaaggaacccctcttgaggacagggctacccttccaggggcccatggtcaccggatgctgctgggctggcaagacatttagactgtggccagagtccaaggtggcccagcacctcttgatccttctcttcctccacataacctttgactggacttctgcccgtccctaggcctgcagaagagtctctggtctcccacgctgggttttcaccagatgggtcttcactgatcttctgttgggtcacgggtgaaggtgggggaggcaggggctttgggagtgggagttctgagccagggccttagcgggagatggctggaccttaagagagggtggggctggtcacagtggcacacatctgtaatctcagcactttgggaggctgaggcaggtggatcacttaaggccaggagttcaagactggcctgggcaacatagtgagaccccaactctacaaaaaataaaaaactagctgagcttggaggtgtacacttgtagtcccagctactcaggaggctgaggtgggaaggattgcttgagcctgagaggtcaaggatgcagtgagccgtgattgtgctactgcacttgggtgacagagagaccctttctcaaaaaaaaaaaaaaaaaaaaaaaaaaaaggaaagaaaagaaaaaggggccgggcacagtagctcacgcctgtaatcccagcactttgggaggccgaggcaggtggatcacctgaggttgggagttcaagaccagcctgactaacatggagaaaccccgtctctactaaaaatacaaaattagccagggtggtggcgcatgcctgcaatcccagctactcgggaggctgaggcaggagaattgcttgaatccgggagacggaggttacggtgagccaagattgcaccattgcactccagcctgggcaacaagagcgaaactctgtctcaaaaaaaaaaaaaaaaagaaaaagaaaaagaaaaaagaaagagggagggtggtggtagcccagtcaccaacatgtttcactataagaactcgagaagggcagggcaagatagtggcttcatagccaggtcagctgcttaccaagaagaaggaaggaaggggcaggacaaatttcttgggaccaggtgggatgaccagggtgcagctgccccttcgaaggggtgggtgtgtggaggatcaagacctctatttcccaaatactctcgtccctctatcccacagtgacctatggtgctggcatataaccagctgtcaggtctttgcccactctgttcgcccctgcttcctggcgcagggagtccatgtcctctctggttccccaggtttgcgagagtggagggggaccacgagctcccgatgcctctcctgctctgcaggggaacttgcagatggcccatggcgcagggtcgagactcaagcccactcccaaccccgcgcccgaactgcccggactggcggggtgacgctgcactctgcgcccctaaaacgaacagattaacccctctcttgggaactgaacatgctgacctggcctctcccggttccccccgcatctgtaaccccggggcagagttacaggggctgactggccgcacccaggtgccctcggggcagggtgtgctaagaattggtgtgggggctgcacaaaggtcctggtcagctcctggtcacctgaggcccaagaactgtccgggactcacttcctctcttcttgctttaaccggggtcgctcagcagcggccagcgctgcaccccttatcctctcccggtcttgtccgttccagatcctccaggtcagggggtcgccaagtgagagctgcgcagcgtggatttcgggtacccagggctgggcggggtacagcagcggcgagctgggttcccgggtgggcgactgacagcccggagccaggcgatacctcgatccatcgatgcgctcggcgctcagcgtggtccaggaagcagggggttgggcaagggcggggcggcgacctccgactgggaggggcgtatatggcggcgagtccctattggccagccatttgcgggaggcgggccctgattggccggggggatgcgggggatgcgggcggcggggttaagcgcgtcgccaccgcccccgcctaggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctgggtgaggcacgggtctcgtggtggatctgtcggtcgggcgggacgggccgcgggcggggctgccttcccggtctgcttctgttccagtcacgaaatgggggagcgtattggtatctgtcttgtcacttaggtgatctagatctgccggctcacctcccgccatgctgggcgcgggtgtggtcagctccccacctcctgtcctggtagaaaatgggggtgagtgggagagttaccatctggttattcatagttccacctgtccgcatcattcccaagccttgcctccccttatcccatttttaagctggaaagacaggtgcttcagccccactcctgagggatggtgggggtgtgtagagtggctcctgagttgacttctgcatcgacctgggcctggttaggaggctgtcaccctcgacccctccaatgccacatatgccagaaggcattgctgaaaggaacctccttagggaaaggattgctgtcctagctggccaccaactcccacaacttatcagatgtgtggcattgcctgagggaaaaggcctaagggaaactgaagacaactgaagtcaggggaaagggttgggacaatggccatgaacctgtgtcaggcaacatgcttgtactcttaccctgccacacatgcttggactagactatgtggaggctcggtgacctcccctgctcaccccgctccttgatcacaaccctggcaactctacaacggccactgtatttccttgcagggatgggcagggatgagacctctgtctggggggccttgggtgcctcattgaggccgtcactcccatccagagctggtgtgtccgtggccagccaggattcctgaaagcagaggcatctgaggcatgaattacacgtggagtctagtgcagcatgatctccatgctctttctgctgagagtactttaaatggggacgatgcaaatcacagaagggtagagttggcaggtagggtggtgccaggcaggccccaccaggagttcccagccaggaaaagctccagggggatactaggcccaggttcaccatgggatttgggcagacttggccctgcctccccaaagcttgcaggataggaataacagtgatccccagagaggaagtctgtgtggggcaagcacagagaatccaccaacccagcctggatgggtgggtgtcaagtaaggcttcctggagtatatagctggagctaaggccaggagagagtaatgggtcggggagagacgtgagcatctcaggctgcctgggatcgagtcacaggaggagtggactgcacaggacttgtgactggttgggtcatctgaactttatcttgagggcctcagggagtcctgggttggcctgcagagttctaagtctgaggggcgtggcattaggaagcatgtggtctgtggcacacaaaatggcacatagcc

SEQ ID NO: 459 - DNA, 8316 bp, Homo sapiens
cccaccgaatgagcaataaatgttaaagacaaggttcacacaatgattcgttttactacttgaggcctacaccttagaattcaaaataaattcagctaacagagtgggtacttggagaagtctgattatccaacaaaagacagagaaatgggccaaacgactcaggtaagttgcttattaggagaaaggtttaaggtttctgtattaacaataaaggtagctgggcctggtggctcacacctgtaatcccagcactttgggaggctgaggccggcggatcacaaggtcaggcgattgagaccatcctggctaacacggtgaaaccccgtctctactaaaaatacaaaaaattagccaggcatggtggcacatgcctgtaatcccagctactcaggagcctgaggcaggagaatcgcttgaacccaggaggcagaggttgcagtgagctgagatcatgccactgcacttcagcctgggtgatacagcgagactctgactcaaacaaacaaacaaacaaacaacaacaacaaaaaaaaccaataaaggtaaaggtttacagtatgtttcaaggttagaaaatgagtcagttcctgggggtgatggctcacacctgtaatcccagcaatttgggaagccacagtgggtatatcacttgagcccgaagttctagaccagcctgggcaacatggcacaaccccatttcttcaaaaattacaaaaattagccagagctgggcaccatggctcatgcctataatcccagcactttaggaggctgaggcaggtggatcacctaaggtcaggagttcgagagtagcctgaccaacatggtgaaaccccgtctctactaaaaatacaaaaaattagccaggcgtagtggcgggcacctgtagtcccagccactctggaggctgaggcaggagaatggtgtgaacccaggaggcagagcttgcagtgagccgagatcgcgccactgcattccagcctgggtgacagagcgagactccatctcaaaaaaaaagaaatatatacatatacatatatataaagtttagctgggtgtgagggagggcacctgtaatctcagctactcgggaggctgaggcaggagaattgcttgaacctgggagacagaggttgcagtgagccgagatcgtgccattgcactccagcctgggcaacagagcaagactccgtctcaaaaaaaaaagataagccaggcacggtggtacatgcctatagtcccagctactagaaaggctgaggtaggaggatcacttgagcctgggaggtcgaggctgcactccagcctgggtgatagaatgagaccctgtctcaaatttaaaaaaacgaaagaaagaaaagaaaatgagtcaactctgggtgtaatggctcacacctataatcccagcactttgggaggctgaggtgggaggatcccttaaggccaggaggcccagaccaacctaggcaacaaacagtgaccgtgttgctataaaaaaaattaaaaaataaaaaattagcctggtgtggtggcacatgcctgtggttccagctactcaagaggctgaggcaggaggactccttgagcccaggagttcaagactgcagtgagccattattgtaacactgctctccagccttggcaacagagtgaggtcctgtcttaaaaaaaaaaaaagaaaatgagtcaagtgctgatctcaaaggaagtggtttgtattttctacgaataccaagctggaggtaattttacagatcatacaatccagtatcttaaaaaaaaaaaaaagaaaaaaactttgttagtagcagaatctttttttattctccaaatggatatcttccagagaacactgatacattaacaagtaaaagctaagctaccaccataggctttgaagccaaacacgtgatcctaaattcctggctccatcacttcctggctgcctgacattatttatttattttcttgagacagggtcgcattttctgacccaggctggagtgcaatgccatggtcatagctcactgcagcctcaaacttctgggcttaagggattctcctgcctcagccacttaagtagctagaactacaggcacataccaccactctcagctaatttttaaaacttttggccaggtacggtggctcacgcctataatcccaacactttgggaggccgaggtgggcaggttacaaggtcaggagttggagaccagcttagccaacatggtgaaacctcatctctattaagaatacaaacatgagccgggcatggtggtgcacgcctgtagtcccagctacttgggaggctgaggcaggagaatcacttgaacctaggaggcggaggttgcagtaagccaagatcatgccattgcactacagcctgggcaatattgagactatctcaaaggaaaaaaaatgttttcctagagatggggtcttgctatgttgctcaggctagtcttgaactcctggcctcaagtgatccccctacctctacctcccaaagtgcttgattacaggcatgagccaccttgcctggctttctgcatgattttatttacttatttatttgaaacagggtctggtctgttctctgggctggagtgcagtggcataatcatagctaaccgcagcctccaatttctgactcaagtgatcctcccacctaagcctctggagtagctgggactacaggtgtgtgccaccatgcctggctaattttttatcttattgtagagatggagtcttgctacgttgcttaggctagtcttgaactcctgtctacatgactttaaacaggtcaatttatttctctgaaccatctttcttaactgtaaaatgggaataataatagtgccttccttttagagttgttatgcatacatttaaaatggtgcctggccacatggtgcatgctcaatatattaatatcgtataatagctatgttcatttcactgctctgtgattcagtttcttcgtctgtaaaatgtgaataataataagtggctgggtgcagtggctcatgcctgtaattccatcaccttgggaggccaagatggatcaccagagaccatgagttcaagacaagcctagacaacatagggagaccctgtctcaatttaaaataataacagcaactacctataaaagtgattgcaaggactcaattagttaacatacataagctgggcgcggtgtctcacgcctgtaatcccagcactttgggaggctgaggcgggcggatcacgaggtcaggagataaagaccatcctcactaaagcggtgaaaccccatctctactaaaaatacaaaaaattagcagggagtagtggcgggtgcctgtactcccagctactcggaaggctgaggcaggagaatggcgtgaacccgggaggtggagcttgcagtgagtcgagattgcaccactgtactccagcctcggtgacagagcaaggctctgtatcaaaaaaaaaaaaaaaaaaaatacataaaagcacttagatccctattgtccagtggccacttgccacataagcgcttgaaaagggctaatctgaccaggggtggtggctcactcctgtaatcccagcactttggggggccaaggtgggtggatcacttgaggtcaggagttcgagactaccctgaccaacatggcgaaagcccatctctactaaaaatacaagaaaaaattagatgggcatggtggtgaacacctgtaatctcagctacttgagtggctgcagcatgagactcacttgaaccctgtaggcggaggtttcagtgagccgagatcacatccccgcactctagcctgggcaacaaagcgagactgtctttaaaaagaaaagggctggccggatgcggtggctcacacctgtaatcccaaaactttgggaggccgaggtgggcagatcatgaagtcaggagatcgagaccatcctggctaacacggtgaaaccccatctctattaaaaatataaaaaatcagccgggcatggtcgcaggcacctgtagtcccagctacttgggaggctgaggcaggaaaatggcgtgaacccgggaggcggagcttgcagtgagccgagatcacgccactgcactccagcctgggcaacagggccagacactgtctcaaaaaaaaaagaaaagggctaaactactttaagatgtgccgtaagtataaaacaccagatttagaaaactttgtaccaaaaagtaaaatgtcattgatatttgtatatgggtaagatattgaaaaatattttgatattgtggatttaagcatgcatggcattttgatcaatgatggaccatatataaaatgatggtcccataacattataatggaggtaaaagatccctgttacctagtgattgtcacagaaatccgcgcccagccatgtttgtgttttaagctatgtgttactacaaaagagccaaaaagtttaacaaaaccagcctgggcaacatggcaaaactctgtctttacaaaaaatacaaaaattagccaggtatggtggcgcgtgcctatagtcccagctatttgggaggctgaggtggaaggattgcttgaacccaggagatcaaggctacagtgagcaatgggtgacagagcgagaccctgcctcaaaaaaaaaaaaaaaaaggtaagcattcatgaagtaaaaagttacagttggcagggtgcatggcttacgcctgtaatcccagcactttgggaggttgaggcaggcagatcacttgaggtcaggagttcgtgaccagcctggccaacatggtgaaacgctgtctctactaaaaatacaaaaattagccaggcatggtggtgcacgcctgtagtcccagctacttgggagcctgaggcaaaagaatcacttgagcccaggaggtgaagtttgcagtgagccaagatcacgccactgcactccagcctgggtgacagaggaagactccgtctaaaacaaacaaacaaacaaaaaaaactgacagtaggctaaggtcaacttatcaaaaacagaaaaaaaaaaatttttttttagggatgggggtctcactatgctgcccaggctggagtgcaatggctattcacaggtggaatcaccatgcactacagccttgaaatcctgggctcaagtgatcctcctgtctcagcctcccaagtagctgggactactgtggtagctgtgccaccgtacccaactagaaagttgttttttttttttttgagatgaagtctcactctattgcccaggctggaatgcagtggtgcaatcgcagcttactgcaacctccacctctcaggttcaggcgattctcctgccttagcctccagagtagccgggactacaagtgcccgccactacacccagctaatttttgtatttttagtagagacagggtttcatcatgttggccaggatggtctcgatctcctgaccttgtgatccgcccaccttggcctcccaaagtcctagggtaggtgtgagccaccgtgcccggcctattttttatcttttatactgtatttgtactgtaccttttctatttagatttgtctaaacacacaaatatttaccattatagtccagttgcctatggtattcagtacagtcacatgctgtataggtttgtagcctaggagcaatgcgctataccatatatcctagggtgcagtaggtttgtgtaaataaactctaggatgcttgcataagatgaactcagggctgggcacagtggctcacgcctgtaatcccaacactctgggaggctgaggtgggcagatcacctgaggtcaggtgttcaagaccagcctggccaacatggtcaaaccccatctctactaaaaatacaaaaattagctgggcatggtggcgtgtgcctgtagtcccagttactcgggagactgagacagagaactggttgaacctgggaggcggaggttgcagtgacccgagatcgcgccactgcactccagcctgggtgacagaatgagactacgtctcaaaaaaaaaaaattaatttccatttctatttaatttttaaatgtggctactacaaaatgcaaagttagaaatgtggcttgcaaatttttctattgcatagctcaagcttagaaccttcctgtcgttacaagttctaagtttggtttttatctcgcaagcagcactactgtgtgggaagttgtggggggtatggagatgaaagaagaggggcgctacctcctgggaagtgacaacctagcgggggaaatagatgtatcttcccagtgggggtgagaagtgtcattctcacctatttcagcagccttggtggtatgaaaaggcatcccaaccagcacagaagcaggatgcctccaagactgccttggttggcacctgcagcctgaagggggagaaaaaggctttgctagctcccctaccatcgaggatgaagacccccactgtacacagtgtataaggtttctttccatgtgaatcccagtgactctccttaactgggtggaggtggaaggtgtcatcagccttgtcccagatcgagcccctcaggcccacagagccccagtggggcctggctattactgacactcatgtcacactgagatgtaagacggcagcccaggccaagcttccccgggccccctcagattctcgggccctcccactcccctcaggcttcctcggcctccctgccaaacatctatctccctttggaccccactgctccccaaaactccccacgcccttagtctgttccttcagttccccaaactccttcagcctcatctagactcccctccgtccctcttctaggaccccaaaagctctcctcggccccaggaccccgcagaggtcccgtagtcccatctctgagaccccacaaagcctttcggacccctcaggtggcccttaggcctccggagatcccttggctccccacactctcctcagaccccagctcaccttagcctcgccccgaacccacctcacacaccccaaacgcccacaagacgccgctctgtctagtctctcccaactcccgcgcacccccggacgtcccccccaccccaggcccggatcctggaatcacctgggccccgcgccccacgccccgccgccgggcccacctgcgcgcccagctggttcagctgctgcatgtcgccgcccacggcctccggcaccgggtcctcagtgcagtgcaggcggcccatggcgcgcgccccagccccgcaggttccaccgccgccgccgccctgctcagcttcctcctccgctgccgctgccaccgctgccggcctctccgcgcatccacaaccgcactttcgccacggccgtcgcagcgcactcctcccccggccgccctgggctgtccggagccggggagccctcgcagggccgcggacacgcgcggccgccgggctccggggaggggcaggggcggcgccggcaccggcagacgcgaggtttcctgccagctctcccgctgagtgacctttgggtacggcgcttggcctctctgaacctcagtttcaccatctgagaaaatgatggctggggtagctccttaaatgagttaagcctccagaaatgtttaacgcagagaccggcacacaagaggtcttcaatcaatggctagctgctattatcatcatcactgttactatgcactccagagatatttatggcagcctactcgatgccagacactggggacagggaagggaacaaagcaggccagagtgtctctcggagagctgacatcagagtagagactaggtctcaaccttggaagggcatcagcatcaccccagcatcacctggtattgccgggccccgcccccagaggatctgattcgaaaggccagggtggagcctgagaatttgcatttccaataagcacccagggactacactttgagaccttctggagtggaagaaactgacttaccaaagtttcctcaaaatagtgcgagggctttgactgtgcggggcagggagggtggtggtgaggtgggtgaggggaggttactgagaccgtgatcatcactgcagcccctcaaacactctaacccccatgccctctcttcccaggggctcctcacagttcccaggtgaatattaccctaatccccactggaaacatgagaaaatagagacatgctacccagaatctaggaactgaacgccaagcctaagggcttcacctagcccctaagtccagccttgagggtaaagaggtaatgccgagaaacctggagcagggaaatgtggggggtttggctggccttcctcaccagccctcctcct

SEQ ID NO: 460 - DNA, 8383 bp, Homo sapiens
tcagtctgcctcctgttattttcttatcagagagcagaattgtttctaactactcttgctggtgaacccgtgccccagttcctgctcccacaggcacctagagtgcagatcgcgagacaacatagggtagtgcagcccttgtctgaaccacacaacacagaaggggatttcagggtctggccattttctcatttctcccaagaatgaaatagtattattttattcccacttttcagatgaggtaactatcatttggaggggttcactaatatgctcaaggtcacagactggccagggacagaagcttggctctatgtgactctagagccccatgctctggagccccagatacagcaatacacagttgctgaaaagcagaaaagcaatgtcaatcttcctcttgtgagcaaacctttaactcacaggattatcataaggattaaactatctgatgtagatagagtacttggcacagtacctcaatatggctgttaactcaaaaaaatttttaatttttcttttttagggacaggttcttactgtcacctaggctggaatgcagtggtgcaatcatatcatagctcactgtgcaactagtgccattctagaggcagagaaagtgactcattgtaatctgatataggtgcttcagggacgtggggttaattctcttggtcctagttaaaagcatgggctctggagtcacatagagccaagcttctgtcccaggccagtctatgatcttgagcacattactgaacccctccaaatgataattacctcatctgaaaagtgggaataaaataatactatttcattgggtctttgtcaggattgagtgagataattcatgcaggctcttattatgaggcctagccaatggtaagtgctttataaatgttagctattaccgtgttgccatttgtataaaaccctcagaaacttttcactgtccacaggattgagtccaggtttcttcagcatagtgtttcgaggctctttgcgagctggctctaacttctaaggcctcatcattctccattttccctctggcatgttgggccttggtgaactagttctctgaagtgaacttctctttcattcctccaggctgttgcacatgctgatccttctgttggactgcccttctcattgtctgctgcaagatgccagcagtttacaatgcccacttctaggtttgactttggcctcagacaatcctaaattcacatttaggctctgtcagccactgaccagctgtatgacctttggtaaattattaatcttcagctcacatgattatcataaggattaaattatgtgatgtagatcgagtacttagcacagtacttggtacatggctgttaactcaaaaccatttttgtttgtatttttagggacaggctctcaatctgtcacctaggctggagtacagtggtgtgatcataagatcatagctcactgcagcctcgaactcctgggcttcacgggatcctctcaactcagcctcccaagtagctgggctacagattcgtgccaccatgcccagttaattttttatttttgtagagatagggtctcactatgttgcccaggctgtcaaaaatgttacctctctttccccccttcctccctttctgaatctttctcaacctcttcccagctgcactttgtatgtacctctgctatggtattagtcacactgttataattatttgtcacttgttggccgggcgcagtggctcacgcctgtaatcccagcactttgggaggctgaggcgggcggatcacgaggtcaggagatcgagaccatcctggctaacacggtgaaaccccatctctactaaaaatacaaaaagttagccgggcgtggtggcgggcgcctgtagtcccagctactcgggaggctgaggcaggagaatggtgtgaacccaggaggcggagcttgcagtgagccgagattgcgccactgtactccagcctgggtgacggagcgagcctccgtctcaaaaaaaaaaaaaaaaatgtcatttgtctgtcttagactgtgagttctttgggggtctaagaccagtgttggtcacacttttatcctcagggcctcgcatagtgcttggcacatgccagatccttaataaacatttgtatgttgagtggatgagacaaaaacccatgcaagacaaggaatggtgatcttccacgcaggaaattctctttacaagcctgcttcactatctgagcccaacgttcctaagcaagattttccttcctggaggtgaggtggctgagactgtgttacagagcccagtgccatacacatattagctgatcaagaaatgttggatggaacaccaccaacagaatttactgaaggttctgccctggggaggagtgaattctgagggtcccacaaatctttctctcagaagccccagaaacagcaatagacagttgctgaaaagcagaaaagcaatgtcgaccttcattctgagcccaccacattgttttgttgcaatgggagtaacaaagaagaatctggagaggctgccctagtcctaccctgggaaagggagtagattgggtcatgctacatagcagaggagaagggtactcaggacagatgagcctgggggaggccaactctatctgggcatcaacaattccggccagggctggtgatgtcaggttactttttaaagaagaaggcttcccttccaaacagaaagacaacactttgatttgtgtgccaggttccctgaaggataaatatggtgaaggataggccaagagaaggaagaaggggaagagtggcctatcaagggaacactgtgaggggcagctgggctcaaaaatgtcccctctaatgtgtgttctccttcccccacctcgagagcctccagggagaagcggagctctggctctgctgagacagctgctgagatgatcactgagtctgctggcagctcacatttcagcacatggtacaacttctcaaaggttctttggaacacctgggagagttgcatggtggcaaacccttcctccctaggtcctcggggatttggaaacaaggaccccagacacaacaaccctttcaatatcacacaggggcctcagccccatttatttgcacagccaggggttcctgccacaaacagcagttttcgattatcagtagctgtttccctctagcctgggcaggggctgagagagacacacacagaaatatgatatttcagactcctttgagatctgaagaaatcatttcctcctttcttgccatctccataagaccacctctggaagtatgctatgctcaacttatactcacacatacagatttgctcataggttgaacagtgaagtttaagtaaaacccattgcacagactgttcctttcatcacagacacaaagaaggtgagagtaagatgctatcaaggaactagccaatcttggaccaagcgtacatgctcccttccttcttactccatggaagagactgctccatgggcctctcctggacctgttgccacggggagatttaggaggccatccaaggagtgactgagccttggccctcttccatggctacaggaatattgttcctgcaggtactatccagatttcagctctagatgtaactgaaaaaacctgaaactctgaggaaaggaatctaaggcttatagtgcttgagtactgatggggaacaactgcagcgaacagcaccagggaagctggaggatgctcagtaggtgaatcgcatcttttgtgagtagcccagtttgtccaagttgggatggcaggccagctgcaccattgggggtggcccacaaagcagtaccagcacatcatcccctggagcgggcaggtgttcccggatcatgtcggcagtcacaaagcccttgctgtaggcccaatctgaagtatggggagaagaaagtacttaatactccagatacatgctggcaagggggtgtggtgccatgagactggggagggccctgaaaggctctggagaaagtgtcaagtggtagcagcagctgggaatgggtatactcagcctgcctcaagctgagccttagcagcaccgccatccctgtcacccacctggtaaacaggaacccaaaggaaagggaccaggagatcactgtgtctgtgcactcagacttccgagttggcagtgtgaggcaaggttgatttcaatgaagccagaattcacaaaggggcaaggctttgattttgacgatgaggggatagtgggatgtccagaaatgggaaggataccttttgggggatgatccagagtgaaccagagcttaaagcgattgggatagcgggcctgcagttcctctaagtcctcccgcaagatgatatccttttctgtctgaaatgcaaaggggaaggaaagtctttaggagtcttctcaggcccacataaaaagttttctgctatacaactttccaactaagaaaaagaatgttaagggaaagcaaaagttctaggaaataagcaagacttgcagtgcttttagggagttaggatgaggagaagaggggaacagcctttatctacacattatgaaggaacaaagatgaatatttaaccaagaagatctaagtttctgtgctccagactagataccttaaaagttttcttctttccttggggaccagggaaggaatttgattcagtgctctgtccttttcctccttattgaaagaggaccctgtgccttacagaggggaccttgggcagaggctaaaacagggcactgggccagttctgcccatccataccacgtctctcagccctacccacacagcaactttgaagtcttagggtggaggaaaacaaaccaacctggttggcaaaaagcagaaagcactgggttggatcttcagggactttcaggatggcccggatcagctgtagcattggggtgattcctgcatgaagataccccacagtgaaatgtagtggccacactctctgccctgtcctggctccttagctgaccagccctttcatcttcattctgctcattcaccactccactccattttcctttagcattctcatcctctaaactcttcctgcatattctccaacatctgtatttccgggcacccttcaaattcatctaagttcatattgtagaaatctttcttaggaactaatctaagactcttctgaaagtcctttggaggctaggactccagtgtcacaaatgactacaagtacctccggattcaatgatgagggttctagaacactgtatttgcagaggttaagtgcatgtacttaggcactaggcagagccaaatactaattttgctccaggccattaccagtgaaataaccctgtggaaatcatttagcctctctggaaccccattgtctctctgtaaaaggaaaaggctagtacctacttcatagatacctatatatgtgtctaatttttgtgtctaatatatagtagtgtattagactacacagtgtctaatgcacagtagtgtccaatgctaattttctttcttcctagctagtcattcctagctgcttctctcttctctcacctaaaactattagatccattcaaaatgaggaaagctcatttaatttgtttctctaattccatcagttaaaattttttttggtttctacctgcttatgattttgtttttcagatactagggagttctaagcattgctggaaatcccctgatgaacaacagcttggctatggttaccagtcttcagagggtcacctaggaatttgcatggcaacagtcaacaatggtgggagagaaaggccctcagtgtaatgcacctgtcccgccggcaatcattcccagtttcttcgccactcggggttctggtggagatttcttgttgggctgaatgttaaaatgccctgagaggtcaggtgaagagagcagtggaagaataaagtcaatacagcgaacttagaaaacaaatgcagagttgaaaatatgcctgaggccagttgagcagctgctatgacatctgatcctggagcttgggtggaagcttgagttgagccagccctgacaataatatagttgagggacaatggggccagggctatctgtgagtcagttcagcgccacacaatgtatcagctgcttctggcaaagtgtcactccctggtgaaggagacaggcacagagccaggtgtgaatctattttcccaagtggcacacagcagctccagggacttgctaatgcacccagctgttcccatgggaagggctgaaagctatctctggctcactccacagctcacccaggggggcaaatttttgaaggtggggaagaggggcacatgtttgctttagtaatctccacagctgccatggctagggaattcaagtggaggaggaactgcttcctgtggcaaatggggctgagaaacatgcctttctattgtatcagcgctatgtttagaaggaagggcggccctggcccttacgtgcatacacatgtgtacacacagccatactgtgccaagaggactatgggaactgataaagtgggagacaggctcaaggagaagacaggtcattaccttttccagtgtaagtgagcaacccgcttggcccccgaaactccaccacatccccaaccttcaggctatccaggtactgagacatcttccctccctcaggaaatttggggtgcacacccttcaggtagaccttacaagacagagagaaaaataccttatttggaatgtcactggtttctgagccccatgttgactaaacctccctgaggctggggcagggatcagatatgtgctatcttttccccgtctacatactttctttctttcttttttttttttgagtcagagttttgctcttgctgcccaggcttgagtgcagtggcgcaatcttggctcactgcaacctccgcctcctgggttcaagtgagtctcctgcctcagtctcctgagtagctcatactttcttcacatccacagagtacataccatttcctgctgtcaggcaaatcttagaaatttctacaaatcccagaaagaatgggtaagcagcccctgggtcccttcctagccccttaccttgatgacaagatccacatagccttgatcctcatcactggtgacaggagtgtatggcctgatgaccaggctgccatcaattcgggtggagaggtagatatgtttgcctggggaccgtgcagagagctacataagggttgtctgtgatgtgctgcatccctcaaaatactcaaagagatttgagagaacaagatgtcttgcttcctgctgtggtcccaaggagctacaaggcagggaagatttgccccattgagccctcagttggatctcttataagcgcccagttgaggaaacacttatttccagcgtttcctgccagttactgccaggaccttgacagatgagccaaaagggtctgggcaatgggaaaaagttagtagtgcttgctcagagggagtaattagcaaatcctgcagggaagaggcaagactgttgagtgttaaagctggatgggggtcatggaagccacactctagaggggcccagtggcacctcacagcttggaggatgcagagccaagtgggggaaggggaatggtgtgtggagcaaaccggttgaagcagcgtgtttcatgagatcccaggaggggagtcaccttctgaggataccagggaaaggagcccattccacactttccttacccacaggcagccccagagtgtggtgggcggtgggcagggcaaagcggaacctcttggtgttgtggctcacagtctggagggtggaggacacaagtgtttcaccaagcgcgcctggcgctgccacgtcccttggacatcccaaccaccgtgggtgctgtaccctccatgccaggagcactctggtcccctccttcaccctggccctttcttccccaacttaccgtcttgtctagcagtcgtagcaggtacttttcattggggtccaggagagtgacctgaggccggcgggacctccgaaccaagtaggagcccacagccaggccgagcagagtgaccagccccacccccagggaggccagcaggacggggctctgtgggtagaggaggcagcgtgaccgccaggctgggtaagagcccggggcttgggtggtgaccgtcccaggggtggcgatcccgagctccagcgcggaggcatgccaagggcagaggggtaacctggcggagtcccgagcccggatgtgcgggatcgggaccccagcatccacggtgggcccagagccctgcggggcggggtcggcagcgacagcccctggtccggagctgagtggccagaaccagatggggaggggtccccca

SEQ ID NO: 461 - DNA, 8621 bp, Homo sapiens
taagtgttgcctctactgttccagagatagtctgggaggagcataaggatgctgaggccccactagttatctgtgtgacttcagacaaaattacctagcctggctgggcacagtggctcacgcctgtaatcccagcactttgggaggccaaggtgggaggactgcctgacgccaggagttcaagaccagcctgggaaacacagggagacccccatctctacaaaaaatttttaaaattagctgggcatgatggcatgtgcctgtggtcccagctactcgagaggctgaggtgggaggactgcttggccccaggaggttgaggctgcaatgagctgtgatcacaccactgcactccagcctaggtgacagagcaagatcctgtctcaaaaaaaaaaaaaattaccacgcctatctgtgtttgagtctcctcatctaagagtgaggatgctgagaataacagtactgaatccccaggaggctggaaagatgaaataagttaacacatgccaaagtctggctactttgctcccgcttaggtcctcaccttctgggcccagtaatacacggactctgggttgttgatctccttgcccagccgggcgatcatcttagaaggcgtccactttacaccctaggagaggatgtgaccttcaggccatgcctcccctgactcccactgaactggcccctccaggttgccccagccccacctctgtgttctgctccatcaccatctggtccagaatgggcatcagccagtcctcaaacttgcagtaattctcattgggcaccagcaggtttccgatcctgagaacaggaggcatgtaggcatcaggccccaggacccttggtccagctcccctgcccaacaccactcagggttctcacctattgatcccgttctcccggagctccttccccctgaggctaaactcgcccaagtatgtgggcgccaggcacttgatgaggtcttcctccacgccgccagctgtggtcaccaatacgtccacctgcagccacaaggcagtgaatttggcccaagaaggaagcccctgccctcattctgggcagaacttctaacctcatccttgtccagtgactcttatgagggagctctgctacaaaacaaaacttgattctattcctctgcttataacagacccctatctgcccatctcacttaaacgatcaataactgcattgcccattgacccagaggccaaggccacggcctcaccaggtccccaccatgttgtgctgcacaaggtagcgaatggtctcacggatgcctgaactgatgaggttggatgtatatcccaggaaaatggtgcagctggtaagtgggcggcggctctgggtcaggtccgcgtgctggtcttcatcctgtgacagtggttccagcttcttctcgatctgtgagtaagggccaagtcaagttaagcactggccttaaatcccagactcaggactccaggtgggctccagaaacagatttcaccccaggccctgcacattcagggatacaggaccagttctacaggggaccaaggaacatctcctgtgtaaactctgccccttcccagaccagatctcaagacacacgttcaggatttgcccccacccttttttttttttttttggacggagtttcactcttgttacccaggctagagtgcaatggcgcgatctcggctcactgcaagctccacctcccgggttcaagcgattctcctgcctcagcctcccgagtagctgggactacaggcgcgcaccaccatgcccggctaattttttgcattttagtagagacggggtttctccatgttggtcaggctggtctcgaactcccgacctcaggtgatccgcccgcctcggcctcccaaaatgctgagattacaggcatgagccaccgtgcccggcctttttttttttttttttttgagacagagtatcgctctgtcaccaggctggagtgcagtggcgcaatctcagctcactgcaacctccacctcgcgggttcaagcgattctcctgcctcagcctcccgagtagctgggactacaggcgcgcaacaccatgcccggctaattttttgcattttagtagagacagggtttcaccatgttggccaggcttgtctcgaactcctcttctcttgatccacccgcctcggcttcccaaaatgctgggattataggcatgcgccaccgcgcccagccagcccccacccttttaggaatcagagagcatctcctttcagatccggtcccttccccgctgggaaaagcaaatctaaattcaagaaccgcccagacttaggctcctcctcccatatcctcccttaatttgtcttgccccaggctccgcccattccagaaagctttaaatgtacctagaacccgcccccacaccaagaatcagtcctcgcctcctcaggttaccgtaccagcatgtaactaccagagtgcaaaatccccttcccaggacagaaactcccgcccagaataggtcccgccttcctccaactattgggcaactcaaataaaagacatatcccctccactggaaacgctgcccccgtctagtaccgcgttggttctacaagccacgcccctccgcgtccctagaaattccgcccggtcctcaccatggcattgacttgctgtacagcgcgcccgaagttggttgcttggaagccggtggtgccgaaggcctccagcagtgcgcggtaattcacaccgcggttgaagtcgtagccccggacctgggtgctttcgggcggcaacgtcgagctgtgctttagcacggcggccagcgcccccgctggcgcctcccgttccagggaaccttccatgcgcctatagccggctctcgagtcaaagctgcccctaggccgggcttacggcggcccagaaacgcgttaaaccccgacgcgcgcgtctccgcaagagcacaggaagtagggaacgtgctttgggcgaaagaccggaagttggtttatcacgtgaccatttttagcccctgtaaaccaggtcgccgccatttttgtgcgtgtgttccgtaatacggaagccgcgaggagcctttaggccctttctttctttttttttttttttttttttttgagacggagtctcgctctgtcacccaggctggagtgcagtggcgcgatctcagctcactgccagctccgctttccgggttcacgctgttctcctgcctcagcctcccgagtagctgggactacaggcgcccaccaccacgcccggctaatttttttgtatttttagtagagacggggtttcacctggtctcgatctcctgacctcgtgattcgcccgcctcggcctcccaaagtgctgggattacaggcgtgacccaccgcgcccggcgcctttaggccttttcttcctttttttttcttttttttttttttgatacagggtttcgctcttgttgcccaggctggagtgcaattgcccgatctcagctcaccacaacctccacattccgggttcaagcgattctcctgcctcagcctcccgagtagctgggactactggcatgcaccgccatgcccggctaattttgtatttttagtagaggcggggtttctccctgttggtcaggctggtctcgaacttccgacctcaggttatccgcccgcctcagcctcccaaagtgctgggattacaggcgtgagccactgcgcttcggcctttacttgttttcatgtgttctcgacttcccatgaatgaagattcttttttatttttattatttatttatttaatttatttttgagacaagagttacacgctcttgttacgcaggctggagtgcggtggtgcaatcttgactcattgcaacctctgcccccctggttcaagcgattctcctgcctcagcctcccgagttgctgggattacagacacccaccaccaggcctggctaattttttatttttagtagagatggcatttcaccatgttggcgaggctggttctgccctcaggtgaccgcccgcctgggctttccaaagtgctgagattacaggtgtgagccaccgtccccagccaaaattcctattttaatgccacctgctggagacccactgcttggcccggcactcgcccattcgtttctgttctgtcccctcgggaggggaggatggttttgttgttgttgttgctgttttgtttgtttgtttgtttgagctagagtcttgcgctgtctcccaggctggagtgcagtggcacgatctcggctcactgcaacctccgcctcccaggttcacgccattcttctgcctcagcctccccagtaactgggactacaggcgccggccaccacgcccggctaatattttgtatttttagtagagacggggtttcaccgtgttagccagggtagtctcgatctcctgacctcgtgatccgcccgcctcagcctcccaaagtgctgggattacaggcatgagccaccgcgcctggcctgctgctattttttgatagggtctcactctgtcgccaggctggagtgctgtgacgcgatctcggcccactgcaacctctgactcccggactcaggtcatcctcccaccccagcattccgactagtgtgcaccatcgtgcccagctaatttttttatgagggtcacttttttttttttttttttttttgagacagagtctcgctctgtcgcccaggctggagtgcagtggcgcaatctcggctcactgcaagctctgcctcccaggttcatgccattctcctgcctcagcctcccgagtaactgggactacaggtgcccgccaccacacccggctaattttttctgtttttagtagagatggggtttcaccgtgttagccaggatggtctcgatctcctgaactcgtgacccgcccgccttggcctcccaaagtgccaggattacaggcgtgagccactgcgcccggccgagggtcacttcttaagcgtcacccatggacaagatttcggtcaccaggcagagttagacacagtttcatccttcctcagccacttttgtctaatgggatagtgagcccggttcgtgccctcacaagtctccaaagccttcacatgctgcataacgctctgttcttccttcccttatagctgcagctgtcacctccacctcctctgggaagccttccctgaactcccactgggtcagtggcctcttctgggacccagggctgacgtctctttccctcctgcaagaatgtgagaccctgggtgtcatctgtatctcaaacacaccctcctaacagtgcatacggccaacaggattattcactcactctacaattcatgtagtctattctctatggtgggctccgtgctaggcactaaggatttagtggtgaacaagaccaagatgtggaccctgccctactggagcccacaatctgattgggaagatagaaagttaacaatagtggtgagtgctatcaggccttttttgttttttgttttttttggagacagagtttcgctcttgttgcccaggctggagtgcaatggcgcgatctccactcatcgcaacctctgcctcccagtttcaagcaattctcctgcctcagcctcccgagtagctgggattacaggcatgagccatcacgcccggctaattcttgtatttttagtagagatggggtttcactatgttggtcaggctagtctcgaactcctgacctcaggtgatctgcctgcctcggcctcccaaagtgctgggattacaggtgtgagccaccgcgcccagcgcaatcaggatttaaacaggataatttgagtctttaggtggaggagttcgggattttagttggagggatgggtgaaggacgccaaggaggtgagatttgagccaaagccagaaggctgagaaaatccccgtatgtgaagatgcagagaggccatttcctgcacatgggaagacagaacagcaaaagccgtgaggctggaatgagcctaccttgttggaggagacagacatcctccttgacatcctcgcttggacctcaaagttgccccctcagctccctctccacctatccctgatctttctgcatctcagcaaacggccccaccctccactcatccactagactgaaaaatagggattggggctgggcgcggtggctcacacctgtaatcccagcactttgggatgccaaggagggcagatcacctgaggttaggagttagagaccagcctggacaacatggcgaaaccccgtctctactaaaaaatacaaaaattagccgggtgtggtggcgcacacccataatcccagctactcaggaggctgaggcaggagaatcacttgaacccgggaggtggaggttgcagtgagctgagatggtgccactgcactccagcctgggcaacagagcgaaactccgtctcaaaaatagataaataaaaattaaaaatgaggagcgcagcttgctgtctccccttttctcacaccccacatccatccttctcagcatgtctgccaacctctacctataaagtaggtccgaaatccaggtgttttctttatccccatagcctgcaagctggctttggtatcctccaacccatctcccacctaacagctaaaatcagagagcttttttttttttttttttttttttgagacggagtcttgctctgtcgcccaggctggagtgtagtggtgtgatttcggctcactacaagctccacctcccgggttcacgccagtctcctgcctcagcctcccaagtagctgggactacaggcgcccgccacacgcccagctaattttttgtatttttagtagagacggggtttcaccatgttagccaggatggtcttgatctcctgacctcgtgatccgcccacctcagcctcccaaagtgctgggattacaggcatgagccaccgtgcccagccgctgagcttttttttttgatgcagggtctcactctgtcaccagggctggagtgcagtgggacaatcacacctcactgcagcttcgacctcctggcctcaagtgatcctcccacttcagcctccccagtagctgggactacaggtgcatgccacagctctttaaccataaatcaaacatgtcactgttaaaacctcctaatggtagcttccccctgggagtaaaatccaagcttttcacagtggccttaaagggcacctctcaacctccctgctgccatctcccaccatgctggccctccctccctctctcctctccagctacacagacctctttgctattcctggaacccaccaagctcttttttgtccaaggagtcaggtacttgccgctccttctgcctagaacaccccatttctcagttccttctcctcctttgggcctaagttcaaatgtcacctcctctgagaggcctgccctgaccactcctctcccctttactttgattttattcttctttcatatgccctttcacatgtatactctttcactgagtacattttctgttgtccatccctgcctaactagaaaggcagctccatgagggcaaggttttgtcttgtttcattgctaatttgggtttttgcacagtgctgggcacatattagaatctcggggcagggctcagtggcttatgcctataattcctttggaaggccaaggcaagaggatcgtttgaggccaggagttcaagaccagcctgggcaacatagtaagaaccatctctacaaaaagttaaaaacataaattagcagggcacggtggctcacgcctataattctagctaatcaggaggctgagttgagaggatcacttgagcccaggagtttgaagttacagtgagctatgattgtaccactgcactccagcctggacgacagagcgagaacctgggcttaaaaaaagaaaagaaggccaggcacgatggctcacacctgtaatcccagcactttgggaggccgaagcaggtggatcacttgaggtcaggagttcgagaccagcctggccaacatggtgaaaccccttctctactaaaaatacaaaaattagccaggtgtggccgggcgcagtggctcatgcctgtaatcccagcactttgggaggctgaggcaagtggatcacctgagatcaggagttcaagaccagcctgaccaacatggtgaaacctcatctctactaaaaatacaaaaaattagccgagcatggtggcacatgcctgtaatcccagctactcgagaggctgaggcagaagaatcgcttgaacccagaaggcggaggttgcagtgagccgaaatcacgctattgcactctagcctgggcaacaagagcgaaataccatctcaaaaaaaaaaaaaaaaaaaaaattagccgggtgtggtagcatacgcctgtaatcccagctactcaggaggctgaggcaggagaatcacttgagcccgggaggtggaggttgaaagtgagctgagatcgcaccactgcactccaacatgggtgatagagcaagactctctctcaaaaaaaaaaaaaaaaaaaaaaaaaagaacgaaggcattggagatttgagcctgagcagtggcgacaacaggaggagaggcaaggctgcatgttggagatggc

SEQ ID NO: 462 - DNA, 8706 bp, Homo sapiens
ctttccttgccttctaatctgatcttggtatttatggagatgctaaacagatcatgtcctctgaggatggagaaggggaagaccctatggccctgttgatctcattactctatgtcttctcagcagatctgccgccctgctgctcattcaggcttggggctaatcatattaattgaaatattaaacattcacaaaaatgaattaaaatgaactcccctcactcctcctcccagtcagtaattggggagacagctgcagacagcaaaatgcgtccagtcctttgcttagtttgtggtccccaaaggtgtcagtctgagagaagaggcagggtttagaggagaagagttgtaccactcatcagactctccttgctgagtgacggtgaacacatctctggtgttctttcaggccatgggatgggagtcctgtgaggtaaaggcaggggagccctgagactcagatgcctattctggaaagtttctctctaggagagagagaggcttccaggatactttctctgcccaccacccccaagctcaccctcttttttattcctctgcagtcaaagctaggctgccctacataaaaagattattgaatttataaagggagagctctgatcctggctttagattcttaggaaatgagaaatgctggataattgggatatttttcagaaagggcaaaatgtggtggtatgtgtgggcagagtggctagtcatgaagtacttactggcttccctgattgaatacagagtgaagacatctgcagcagaatttatgagagtgcacaaagaattgattctataaccttcctgccctcaagtggcttccacctcaagtggaaggtaagacaggccaacacaatacataatagtgagtactgagacgctgttaaaaaaacaaaaagtagcccctctcatacatgggcatttgggtcataggatgtgatcagtgaagaaaggcttgattgattatcaaagcacaagaagatcacagattggcagacggagggtatcaatcatttcctacttggaggtggggaggtagagaacactgtgcatgcctgtgtgtgtttgagtgtgtaggtttgctggtccaggctctggcattgtctaatataatacaagccacatatatggtttaaaaatgtctagtagccatatataaaagcaaaaagaaacaagagaaattacttttaataataaatgttatttaacctgatatatccaaaatactatttcaacatgtaaatcaattacatgttattaatgagatttttttcataccaagccttcaaaatcctgtgtgtattttatatttgctgcacatttaacacctacagccacttttcaagtgttcaagagccacaggtggcttgtggtgactgtactggctggcacagctctggaggtgccaccaccagcttctctggagggagtatggggagaaaagacagatcttggccaagaggaaccattatctctggttaacctcttgctcctgccgggaaaaaaaaaatcacttctgacagatggcagcttatctctctctcactctattaactctctctcttaaaaaaagacaatcaaccaaaatgatcactaaccaagatggggttcctgggaagtggcttgtagcccactacctaatttacttcttgtggttttccctggcttgggaactgccaacactttcacttcttttcctcagtctttgctggaaaggacagaagcagaccaatgataacccctccacggccagggcctaatgctgagcttgtttctcatggtattttcttgctccttagggcagttgttcacaaatctgaaaagacagcctcccttttttctcctgcttctcagaaggcctctgctgagcacgatctctgtgggggtaggagctcggcatgtgtgtattgacagacaggctcatgccctttctcgtggctattttcagctctctggctttatgtttcactttctcttcttaattagatactagaagaacaaatcttgaagaccaaattccctttctcctcccgtattcagttgggagtggaataaaataatttagaatttatgaggagcccagggtgaagagaaagttaatctacacaaaaaagtcagtccaagagggggaaattctggcagaatgtcccccaggtcctttccagcatctttagtcggacagaacgttccttcctttgcagaactcagctcactctatgttctggggtgcttccacgttgtttgaagaatccacggctccagtgtcgaatgtgtaccggacagagggacgggttggcttctgggacagtggaaagggaagaagcttgggttctctttccccagtactaggcttcctctagcttctgtccaagtgagggagtctggaagcagattcggggagaccttttttcctgttttactctagagctaacaaaaaaaccctgaagttgggtggggtcaaaaagggctcattccacatacaattaagtccagaaatcagtcccccaatccgggaaaggcgatcctttagagacccaccccccaagcccccgccccggagctcacccctcagttccctcagcccctagcccctgcttcgctgaaggggccgggcttgggggcagggcggggccgggggcggggcctcgccggctcgcggccggtcgccttgacgaccgcagcaagatggagacgctgccaggcttgctgcagcggcccgaccccggggcgcttagcgcagcgcagctggagcagctgcgaaaattcaaggtgggtgcgcccgcgcccccatccagcgtccaccaaagtgtagctgccccaggactggggccccagactgggaagagagccgccgagagaaggggagcgggagcctgttccctgataaagtggggagggcgcaggggagacccccggcggacctctaggcgtctgatcccagcacagagcgcgacgggcatctgagagtgcaggaagaactaactcagggactcggccagagaaatgggccgaaattactgccagacacatccgaccttagtaaaggcccctcatcctgaacaagcggcagaatgatattttatctgtaagaagatgggtggcttaaactttcaagcatcctggggaaagacttgggttaaatgcgcacgccgtttcccgcagcccttcacatctccagggctgaaccctgaatctgtctcctaatggaagtgaccctttgttcttgccccccagattcagactcggattgctaacgaaaagtacctaaggacccacaaagaagtagagtggctcataagtggtttcttcaggtaggtggttttccaggctctgggatttgtggcacgcagggttttcttcgttatctctagaggtttccttcagttatctctaaattcttaaaaatatgtctattcatttactttaaccataaggataaatacataccttatgacacttggaagagggaatttggcgttgcgaaacccaacagccatccactgggtgtagaacactattctcaaccataggagcttaacaaaatcactagttgaacttaaaacaaaaatcagttgtctggttggcccttccctacttgaaaacattactgtagaaaaattccaagggttggaagccactcttttcttggggaagagaagacaatttaccagcgtatcctggaatatgttctttccttcccccaccctcctttcagcctggcatttgcttgaatggaaacatatcctaatgggatgaagaaggagaattaaaaaaataaatcacggagcatcagtggatgaaaacaatagagctatctcaaatgctgtttggttatagacaaatagacaaggtttaaataattataatggcacccatctccaggcattgtgctgttcccctacattagcacttaccacactgtattgtaattgagctgtcaatcttctgttactggtccaaagctccgagcttgtggagtgtgtttgtgttctcagtgcccacgcagtgtgtggcatcttggaacacttttgctgatcctcccagcacctccacaaaagacaggtgattgtcatttttattttataagtgagaaaatttaagcttagaaaggtgaagtaccttcccaaagttgctgaaccaggattcaaacccctggttttcccactgtattgtgctgtaagcagtcggtccccatttcccctctggactgtgtgcttatagccagaggtgggccctcccttgtcttctcaaaagttggcgaggtcaggcaaggtggctcatgcctgtaatcccagcactttgggaggccgaggcgggtggatcacctgaggtcgggagttcgagaccagcctgaccaacatggtgaaaccccgtctctactaaaaatacaaaattagccaggcgtggtggcacatgcctgtaatcccagctacttgagaggctgaggcaggagaatcgcttgaacccaggaggcaaaggttgcagtgagctgggattgctccattgcactctagcctgggcaacaagagcaaaactccatcgcaaacaaacaaaaaaaagttggccaggcagatgcgttggctcacgcctgtgatcccagcactttgggaggctgagaggggtggatcacttgaggccaggagttcgagacctgcctggccaacatgaggaaaccctgtctctactaaaaatacaaaaattagtcaggcgtggtggcacgtgcctgtaatcccagctacctgggagactgaggcaggagaatcgcttaaacctgggaggcagaggttgcagtgagccgagattgcgccactgcactccagcctgggcgacagagcaagattctatctcatgaaataaaaattaaaaaaactcactattcatattatagacgtttctccaagtggcaacaaattctcagagggcagataggggaaggaaacagagaaaactgaaacctatccagttatgaaggttggccagggataagccttgggcaaaagagagtttagggatcctctgtcaatatcagacctgaggatcaggccgtcaccttttgcaacttttcttctaaagggaaataagatgatatcgttcctatcctggggagcttgctctccaagttagtagtagttccagcagagagattggggatagaagttaaaagctgaaactaaatcaacatttgcattgctcacaaacaacaggattagaatgcttggggttgatgaataagaatgagttgtttcagtcacctgtcagagatggccttgattctctctttgtccaggaacagtttccaggagcagcctgggtatctgagactggctgctgtgggaacagccccagatacttcctttcctttcttaccatgttcctgtcaaggccaggtaggccaccaggtttttctttttgctgtccctaaagctactctacctgaaattcttctgacctcttttcctgggtggagcttgcagagggtttagtgtttgaagttttagggtttacttttgtttgtttggtgtcattgttccctttgattggtaccgggatgaaccagaatcagcttctgtccctgctggccacctcacatggtccttcctatgagaaaagaagaagggagaagtgagggcagagtcctgagcaccgtgcctgtccttgtctgttctgcagatatctgctgttgatacattccaagccaaaagaagctctgaagggttctttctgggaagcaaactccccacttgggttttttagatcctaatgatttatggccattcagccacaattctccagcctatattggtaaatacagcgtaccaaactcttaacaccttgagttttggacctgaaaaatggaaagagtaggaatctgacttattttaaggtacacagaaacctcaggttttgtgctgcagatatgatagatagccaggtatgaaattgtagaaagtattttttttttttttgagacggagtctcgctctgtcgcttaggctggagtgcagtggtgcgatctcagctcactgcaacctccgcctcccgtattcacgccattctcctgcctcagcctcctgagtagctaggactataggcacccgccaccacgcccggctaattattttgcatttttttttttttagtagagacggggtttcactgcgttagccaggatggtcttgatctcctgacctcatgatccacctgcctgggcctcccaaagtgctgggattacaggcatgagccaccgcacctcgccttttttttttttttttttttggagacgaagtctcccactgtcatctgggctggagtgcagtggcgcaatatcggctcactgcagcctccacctcctgagttcaagctattctcctgcctccacctcccaagtagctgggattacaggtgcctgccaccaggcccggctaattttttgtatttttagtagagatggggtttcactatgttggccaggctggtctcaaactcctgtcctcgtgatctgcctgcctcggcctcccaaagtgctgggattacaaatacagcagtaatcatgtccttccttggctggaaaaatcttcagtagttccacaacgttgcttttttgggtttgtttttaaaaattctattgaaatatactgaaaagtgacatatcctaagctggatgaactgtcagagggtgaaaatacacatggtactattgttcagatgaagaaatagaaccttaccaacacctcacatcctttgtgcccctcccagtcactccccttaaaacagtagccagtatcctgacttctactagcacggatttattgtgcgcttttgtattttatatgaatggaattttacactatgtgctcttttgtgcctgtttccttttgctcagtcgtatcttgtagatcctccattctcactgctgtataatattccagcatgtgttatgccatgttttgtctatttccattgtctttcagattgagtataaatgtccctccccagcattcaaggctctccgtaatagaacctcttctgtttcccactactccctgcatgcgtccctcactcaagccagaccacatttctgctcattctgctgaccctatggagctcaggcacagatgcctcttgagtgctcttttggactcaagatagaaaggtgtctacaacccacttcctactctcaaggaagtcatagtctatagaacacaaactgtttctctttctgggcctttgctcttgctgtttccctggatctggaatgtttttgtccctcaaccctcatcctgcctactacaatcccatgtgtacttcaagggtcctctcaaatgccagctgctctgtgaagattgttggggtccccctctcagtaacctctctccccactctgatctcccagagcactatttaatactcctctttagcacttgtcagaggttccttggccttttggacatttggaaactaacctcttcctttttacttacctgtaaattatttgaggtagggctatattttattttattttgaaaaaagcagtcactcatatctagtgcaattacttgcacataatttgtgcccaataattatcaaaatgaattgaaggagaaggggggcaaaattcttgaaggttaggaaggaggggcttcttggggagttgggaggccttggccaagagaacatattatagagggcactgaccttggagtcacaagacctgggccctctttacttcatttaccaagtttatgaacttgggcaaatcattaatcttttgaaggcttggtttctttggatgtaaaatgggggcataataatggttgtttcacagggttgttgtaaagtgagacaatatttgtgaacatactttatgaaccataaaactctatgcaatgtaaggcattttcaactctctagtggcattggccctgcaggtgttaccacagtgtctccttgctggactgaggggccaataaccatctgcggtccatcttttagctctgtttattgtatctccctctgccccttgaattcatggttaagcttactcaggacattgtggggctgcatatctcccaccattcgtgggccggccggcatgttcttcatctttgcctcttgcccctggcttgagatctggttcagtgaaaatgatcgttgaggccgggtgccgtggctcacgcctgtaatcccagcactttgggaggccgaagtaggaggatcgcttgagcctgggagttagaaaccagcctgggccacatagtaagactctgccgctacaaaaaaaaattagccatcgcacatgcctgtagtcccagctagtcgagaggctggagatgggaggatctcttgagccagggaggttgatcgcgccactgtactccaggctgggtgacagagcaagacgctgtctcaaataaataaataaatgcacacataaacaagattgttgacggaatgacaagccccacttggctgcagcacagctctttctcgacgtaagcaatatcctagtgtattgccatttaggatgcttcactccttgccttagatacggagttgaaggaaaatcatgaatgaaagggtctttgtcaggagtctgcggatttattgactcccaagatggttgtgtctcaggttcatctgtgaaagtacaggacctgaaacagtagccacagcctgcgttaaagtctactttacc

SEQ ID NO: 463 - DNA, 8851 bp, Homo sapiens
taccttcataccagtgatacttaatggcactaggaaccaaatcatgaaagcaaattagcaaattctacagttgggaggggttaaacaggaggtagcttggaaggtggagaagggaagggatgggagaggaagcgggtggagtcaggagacggtggctctggttctggctccgtccttgattttatgaaagcctggaagccggtcactttctctctcaggatttgtttctctcttcatttgtagacttaggagggtggcctgggtcaggtcatcacaaagagtgcactgggactactagaggtacccaggattttaggtgtttccaggacacagaaaaatcatgttgagtcacatggtgagaaagttactctttcaggttttgggttttttttcattgttgttgttactgttttgagatagtgtctcactctgtcgtccaggtgggagtgcaaaggcatgatcacagcctcgtgatcacagcctcactgcagcctcgacctcctgggttcaagtgatcctcctgccgcagcccccttagtagctgggactacaggcacgcaccaccacacccagttaactttttttaagacagggtctcactctgtcgcctaggctggagtgcagtggcatgatctcagctcactgcagcctcaacagcccagaatcaagcgatcctcccacctcagcttcctgagtagctgggattacaggtgcacgccactgagctcagctattttttttttttgtatagacggcgttttgctatgttgctcaggctggtctccaactccttggctcaagcaatccacccaccttggcctcccaaagtgctagggttataggcatgagccatggcacccagccctcggttaacttaaaaaaaatttttttgtagtgatgcggtctccttatgttgcccaggctggcctcgaactcctggcctcaagtgctcctcctgcttcagcctcccaaagtgctgggactacaggtgcgattcactgcacctggcctcttttccagttctgaccatctttctcttttcattcctctcaaaaagacagtttcgggtcagtgccaattctttgacactcacacatctttctccttttaacaagaagccagcaaagcctcagctcaggggctttggccagcaacatcatctgggaagaacttaacaactgttaacgctgggagcagtggctcacgcctgtaatcccagcacttttggaagccaacgcaagcagattgcttgagcccaggagtttgagacgatcctggacaatatgatgaaacactgtctctacagaaaatacaaaaaaatttagctgggcatggtggcatgtgcttgtagtcccagctactcgggaggctgaggcaggagaattgcttgagcctgggaggcggaggttgcagtgagacaagatcacgccactgcgctccagcctaggtaaccgagccaaaccgtgtctcaaaaaaaaaaaagaaaagaaaagaaaaacagcaacaacaacaaacagaaaccaaaaaacaccaactgttcactgttcagctttcattttctttttgtgcgtatcatgactttatggaaatgatactgggtttccacttatggttctgatgtgcaatcttttaaattaaaaaaaaaagagagttagttttaaaacattatgtagaaaaaaaagcaaaagaaaaaaaaaaagaataaaacccattatgtaaatggagtataggtgataggtggatatagcagaaaacatgaaggttatacaggaatagctgacattttggaaacactggttcccttgcagctctggatataaggactcccggcagtaaggccacagtgctccttccctgcccttggccaggaggctgccaggcccccactctctgcctcttggtcaccctccaatcctgtgtgcccactggatgaagaactgcctgggaaataggattaagccccctttcccgagcccagttacctgaggggacttgccacttcctcctgactgtctagggagggtcagcaggaccccctcaaacagctggttggtttcctggttgtctttggtgatgtctgcgttctcatggaggccgaacacttctgggtgggctgtgatggggagattcctgagatagtcgatataggactggaagggaaatcttcagttgaaatcaacgagggaccccagaatcccacagatgactccaggcttagcagaacccaatcagaacaggaatcatactgtatcagtagcacaggacacacacacacacacacacacacacgctgggagaacacaaccctagccctccctcatacagttttctggggagtgggcatgaaagcagatgagactgaattacctctcgcccaccctggcttcctctctgctcccccagtgggcctggctttggacccaaacagaactgagtttggatcctagctccatcccaaactgtcagaggcattcgaaccagagcaactccatcttgtatagggactgggtaaaataaggctgacacctagtgggctgcattcttaggaggtgagggcattctaagtcacaggatgagacaggagtcagcacaagatacaggtcacaaagaccttgctgataaaacaggttgtggtaaagaagccagtcaaatatccccaaaccaagatggccacggaagtgacctctagttgacctcactgctcattacacactaattataatgcattagcatgctatgagacactcccaccagcgccatgactgtttacagatgtcatgacaatgtcaggaagttgccctatatagtctagaaaggggaggaaccctcacttcttggaattgcccacccctttcccggaaaactcatgaataatccaccccttgtttagcatataatcaagaaataactgtaagtataatcagttgagcagcaacccatgtcattgctctgtctatgaagtagccattctttattcctttacttttttttttttttgagacagattcttgctgtctgccaggctggagtgcagtggtactatcttggctcactgtaacctccgcctcctggattcaagcaattctactgcctcagcctccctagtagctgggattataggcatatgccatcatgcccggctaattttttgtatttttagtagcgacggggtttcactgcgttagccaggatggtctcgatctcttaaccttgtgatccgacctctttggcctcccaaggtactgggattacaggcatgagccactgcgcccggcctcctttactttcttaattaacttgcttttgttgtactctatagactcgccccgaattctttcttgtgcaagatccaagaaccatccctttgggtctggatctggacccccttccgataataaaactatgtacccttgaacttgtcatctgaaaccccagtttccttatctgtaaatagaaaaacaagtgtagttatgaagtataaaccaaaagtaaaatcttaagaccctccaaccatctgaatggacttcctccttgtccggggcactctaaaatttaacctgaaagcctggttcaggccatgacgggaagtgggggtcagacatgcctcattatgcccctccagcattaccatcaacacagaccttaagtctgataagaaacatttacaatctattctctctgaagcctgctgcctggaggtttcatctgcatgataaaacttgggtctgcacaacctcttatcataacccaggcattcctttctattgataactctttcaaccaattgccaatcagaaaacgtttaaatctacctataacctgctggcctccacttcgagttttcccgtctttctggactgaaccaatggatatcctaaatgtatttgactgatgcctcgcgtctccctaaaatgtataaaatcaagccctgaccacctggggcacatgctctcaggatctcctgagggctgtgtcacgggccatggtcactcatatttggctcagtataaatctcttcaaatattttacagggtaagaaagagactcttttcatccacagaaggaatcaggccttggcatgtgacaggttgtggtgtaatatacatatatatctactggttttcatccatggttcctggcttctaactcccctagcccttgttacagtcacctgttataatgttgggtgtgttaggccttaggggcaggccgcaggaaacagaatctctctgaccttctctttccctccttttacctgcccccaagcaagactcaaatcttcccctgcctttctgattgtgagtcctttttttttttttttttttttttttgagacagggtcactctgtggcccaggctggagtgcagtggtgggaccttggttcactgcaacctatgcctcctgggctcaagcgatcttcccacctccgcctcctgagtagttgggactacaagtgcatgccatcacacccggctaatttttgtatttttagtagagacagaatttcaccacattggccaggctggtctcaaactcctgaccccaagccatccaccagcctcagcctcccaaagtgctgggattacaggcatgagccactgcacctgacctgattgtgagtcttaagactccacctagagagagagggtgctgccctatactctggggaatgtcatacagctttcataaaaacccaagaagactgggtgcggggagcttctggatagctgaccacgtggaggttcctggagggtatttcacccagggagggcatggaagttctcactccttccgccatacttcaccctatgcatctcttcatctatatcttttgtaatattcctttaataaaccaataaacctaagtatttctctgagttctgtgagctgctccagcaaattaattgaattaatttcaattaaagggggagtggtgagaaccccaacgtgaagctggttggtcagttcttgaggctgggacttgtgactggtgtctgggttgggggaaagaattggggactgagccctcaacccgtgggatctgacactatcaccaggtagatggtattggaattgaattagaggacacccagttggtgtccactgcttaatgtgtggggaaggggtaacctccacacatttggtcacagaagtcttcttctgtattgatggtggtggtggttgtggtgagacagtagtagaaaaatacaatttcagagtttttctgttccacaggtcatcaataaaagtaagtggttttttttgtttgtttgtttgtttttttgagacagtttcactgtcactcaggctggagtgcagtggcatggtctcagctcaccacaacctccacctcccagttcaagcaattcccctgcctcagcctcccaagtagttgggattacaggcaggcgccaccacacctggttaatttttatatttttagaagagatggggtttcaccatgttggtcaggctggtctcaaactcctgagcttaagtgatccacccgcctcagcctcccaaagtgctgagattacaggcgtgagccacagcatccaacctgtaagctcttttctatccctcagattgttttcatcttccttttgtcattccctgcccagtttttctgttcctccctttttgccaccttctgaatcttcgtcttcaagtagcaatttccatcttgctcacttccaaggctccatcttaatcatcgttctctctccttcctccacccagatggatcctatattttgaaacaccttgtctaccaaataccgaccccctccttaaacagtagccatgtctctcttgcaggcttttgggaatattgggaatagcttatggattcaattcaggaagcccaaggtcacccctgggatccctggctacactgcagccctgtagccatatagagatgacggagccctgtgggggaaagaggtaggcctccctgcccaccccttacctggtaggagccatgaggagggatgtagtaagtgtctccaggagcgagggagtaatagtcctcctcaatttccttacagtagaacatggacagaagtgacagcaggagacgccggtctttgtcatcagtcactctgcctccgtaattacattcccctggggacaaccaacagaaggagaggttgagcccagggaaggtcatcacgagcttggtggttgatgtaaaacacggcattcttccggccaaagatctctgctgggacatagtgatagggacagcaagcaggaaaattccgggcagaagatggcgggtcccctgcaagggccccaccctcaagctgaaaagcctgaaaccatggcccaaagtgagaacttacatccctgttttcccacttgaatgttgccttttccaaaaccacccatgacctgccccacccccacaacccatgcccatcaaaaccccaggctcagccagcagagagagagaagcagctggacatcagagagaagaggcttgacttcaggggaacagccttttcagctccctttcccgctgagagccactttcttcggcaataaaatcccccacatttaccatcttccattcgtttgtgcgaccccattcctcctggacactggacaagagcttgggtgccatgagtgcaagtgccaaagtctgtcacgctgacccaccactgggcggttaatacttgagctgtctggaccgcagagctacaagagtactgtaaaccttcctctgggtgacagagggagactgtctcaaaaaaaaaaaaaaaaaaaaagacctgcactccagcctgggcaacaagagcgaaacttcgtctcaaaaaataaataaataaataaatataaataaaaacagaaacaaaaaaaaagacatttaaagagcgagggagagaccacattcatataacttttattatagcatattgtaattgttctattttattactgttgttgttaatctctcgctgtgcctaatttataaattaaactttatcataggtatgtatgtataggataaaaaatagtatatatggggttcggtaaaatccgcagtttcaggcatccactgggggtcttggaacatatccctggtggataaagagggactagtgtatatgttgagatggtggcagtaacagtggttggagcctttgctaactgtgcccctgatagagaattacaacgagcaaagactcttgctaattcatgctggaaatgtagagtgggcaagaaatggatctatgatgtcttttatacccttgaggtttgaggattgtttgttatctcagcctaactagcctatcctgactggaacagttggaaggtaactactctcaagctggctggtttatgaccggcaggcagttggtttatggcttgcaggcagttctctaagcagaccatatcccagggcaatcatgcactcatgctatggtctgaagaggaaccctaggatgtgcttctgcatgacctggaactgtgggaatatggttcacttctatttattattattactagttttagagacgggatcttgctgttttgcccaggctggtcttgaatccctgggtccaagtaatccttcggcatcagcctcctgagtagctgggactatgggtgcaagccactgtgtccagctccaggcgcacttctttggagatgttctttcaccaaactgagacccactgtatgcgtactgtgtgtgtcatttggggctttgttttagggaacactctactgagttaaggtcaatgtgaccttctggcactgaacttaatcactgtaaagaacagtctttcaaccttggcactcttaacatgttggactggatagttctgtgttgtggggaccaccttgtacatcgtagactgttcagtagcatccctagcctccactactataactgccagtagcacgcactatgacatccaaaaccatctccagacattgccaaatagccactgggggctgaaatcacccacagttagaaccactcctttaagcctctgtcttcccagctgtaaaatggggttattaacatggagctcataaaattagcatgaagactcaatgcattaatcacaggtatacagtgtctgccacgtgcctggggaagggattctaacaaactccttaacatatggagctgaagaggaaattgggtgtgatcttgatgccccggtgttttaattaagctgcattttgaccttcagccatgatattccattcatttagcacatgtctattcttattcctgtctctgggactatacggcacgttccttgaagttagtggtcacgtttttttggttgtatgtgtgtatgttttttaagagatggggtcttgctctgtcacccaggctggagtgcagtggtgtgatcatagctcactacagccttgacatcctgtgctcatgcgatcctcctgcctcagcctcctgattacctggggctacaggtgcacaacaccatatccagctcatttttattttatttctttgtagagatgtggcccagactggtctcagactcctgggctcaagcaatcttcccaccttggcctccaaaagtgctgggattacagacatgacccaccgcacagagcctatgatcaagttttacacatttacattcttccatattatgtacttgtacatatcgtggactaataaaaggttgctgattgattgctttaatacaaaacagctagtgccatttctacctcaggatcactttgctgggaatgttctccttcctctatgccccacccagtccattcttttccactcataaaactcctactcacccccaaaacccatctcttatgcctttaagaagtttgccacgatcatctcct

SEQ ID NO: 464 - DNA, 8871 bp, Homo sapiens
attctattcctctgcttataacagacccctatctgcccatctcacttaaacgatcaataactgcattgcccattgacccagaggccaaggccacggcctcaccaggtccccaccatgttgtgctgcacaaggtagcgaatggtctcacggatgcctgaactgatgaggttggatgtatatcccaggaaaatggtgcagctggtaagtgggcggcggctctgggtcaggtccgcgtgctggtcttcatcctgtgacagtggttccagcttcttctcgatctgtgagtaagggccaagtcaagttaagcactggccttaaatcccagactcaggactccaggtgggctccagaaacagatttcaccccaggccctgcacattcagggatacaggaccagttctacaggggaccaaggaacatctcctgtgtaaactctgccccttcccagaccagatctcaagacacacgttcaggatttgcccccacccttttttttttttttttggacggagtttcactcttgttacccaggctagagtgcaatggcgcgatctcggctcactgcaagctccacctcccgggttcaagcgattctcctgcctcagcctcccgagtagctgggactacaggcgcgcaccaccatgcccggctaattttttgcattttagtagagacggggtttctccatgttggtcaggctggtctcgaactcccgacctcaggtgatccgcccgcctcggcctcccaaaatgctgagattacaggcatgagccaccgtgcccggcctttttttttttttttttttgagacagagtatcgctctgtcaccaggctggagtgcagtggcgcaatctcagctcactgcaacctccacctcgcgggttcaagcgattctcctgcctcagcctcccgagtagctgggactacaggcgcgcaacaccatgcccggctaattttttgcattttagtagagacagggtttcaccatgttggccaggcttgtctcgaactcctcttctcttgatccacccgcctcggcttcccaaaatgctgggattataggcatgcgccaccgcgcccagccagcccccacccttttaggaatcagagagcatctcctttcagatccggtcccttccccgctgggaaaagcaaatctaaattcaagaaccgcccagacttaggctcctcctcccatatcctcccttaatttgtcttgccccaggctccgcccattccagaaagctttaaatgtacctagaacccgcccccacaccaagaatcagtcctcgcctcctcaggttaccgtaccagcatgtaactaccagagtgcaaaatccccttcccaggacagaaactcccgcccagaataggtcccgccttcctccaactattgggcaactcaaataaaagacatatcccctccactggaaacgctgcccccgtctagtaccgcgttggttctacaagccacgcccctccgcgtccctagaaattccgcccggtcctcaccatggcattgacttgctgtacagcgcgcccgaagttggttgcttggaagccggtggtgccgaaggcctccagcagtgcgcggtaattcacaccgcggttgaagtcgtagccccggacctgggtgctttcgggcggcaacgtcgagctgtgctttagcacggcggccagcgcccccgctggcgcctcccgttccagggaaccttccatgcgcctatagccggctctcgagtcaaagctgcccctaggccgggcttacggcggcccagaaacgcgttaaaccccgacgcgcgcgtctccgcaagagcacaggaagtagggaacgtgctttgggcgaaagaccggaagttggtttatcacgtgaccatttttagcccctgtaaaccaggtcgccgccatttttgtgcgtgtgttccgtaatacggaagccgcgaggagcctttaggccctttctttctttttttttttttttttttttttgagacggagtctcgctctgtcacccaggctggagtgcagtggcgcgatctcagctcactgccagctccgctttccgggttcacgctgttctcctgcctcagcctcccgagtagctgggactacaggcgcccaccaccacgcccggctaatttttttgtatttttagtagagacggggtttcacctggtctcgatctcctgacctcgtgattcgcccgcctcggcctcccaaagtgctgggattacaggcgtgacccaccgcgcccggcgcctttaggccttttcttcctttttttttcttttttttttttttgatacagggtttcgctcttgttgcccaggctggagtgcaattgcccgatctcagctcaccacaacctccacattccgggttcaagcgattctcctgcctcagcctcccgagtagctgggactactggcatgcaccgccatgcccggctaattttgtatttttagtagaggcggggtttctccctgttggtcaggctggtctcgaacttccgacctcaggttatccgcccgcctcagcctcccaaagtgctgggattacaggcgtgagccactgcgcttcggcctttacttgttttcatgtgttctcgacttcccatgaatgaagattcttttttatttttattatttatttatttaatttatttttgagacaagagttacacgctcttgttacgcaggctggagtgcggtggtgcaatcttgactcattgcaacctctgcccccctggttcaagcgattctcctgcctcagcctcccgagttgctgggattacagacacccaccaccaggcctggctaattttttatttttagtagagatggcatttcaccatgttggcgaggctggttctgccctcaggtgaccgcccgcctgggctttccaaagtgctgagattacaggtgtgagccaccgtccccagccaaaattcctattttaatgccacctgctggagacccactgcttggcccggcactcgcccattcgtttctgttctgtcccctcgggaggggaggatggttttgttgttgttgttgctgttttgtttgtttgtttgtttgagctagagtcttgcgctgtctcccaggctggagtgcagtggcacgatctcggctcactgcaacctccgcctcccaggttcacgccattcttctgcctcagcctccccagtaactgggactacaggcgccggccaccacgcccggctaatattttgtatttttagtagagacggggtttcaccgtgttagccagggtagtctcgatctcctgacctcgtgatccgcccgcctcagcctcccaaagtgctgggattacaggcatgagccaccgcgcctggcctgctgctattttttgatagggtctcactctgtcgccaggctggagtgctgtgacgcgatctcggcccactgcaacctctgactcccggactcaggtcatcctcccaccccagcattccgactagtgtgcaccatcgtgcccagctaatttttttatgagggtcacttttttttttttttttttttttgagacagagtctcgctctgtcgcccaggctggagtgcagtggcgcaatctcggctcactgcaagctctgcctcccaggttcatgccattctcctgcctcagcctcccgagtaactgggactacaggtgcccgccaccacacccggctaattttttctgtttttagtagagatggggtttcaccgtgttagccaggatggtctcgatctcctgaactcgtgacccgcccgccttggcctcccaaagtgccaggattacaggcgtgagccactgcgcccggccgagggtcacttcttaagcgtcacccatggacaagatttcggtcaccaggcagagttagacacagtttcatccttcctcagccacttttgtctaatgggatagtgagcccggttcgtgccctcacaagtctccaaagccttcacatgctgcataacgctctgttcttccttcccttatagctgcagctgtcacctccacctcctctgggaagccttccctgaactcccactgggtcagtggcctcttctgggacccagggctgacgtctctttccctcctgcaagaatgtgagaccctgggtgtcatctgtatctcaaacacaccctcctaacagtgcatacggccaacaggattattcactcactctacaattcatgtagtctattctctatggtgggctccgtgctaggcactaaggatttagtggtgaacaagaccaagatgtggaccctgccctactggagcccacaatctgattgggaagatagaaagttaacaatagtggtgagtgctatcaggccttttttgttttttgttttttttggagacagagtttcgctcttgttgcccaggctggagtgcaatggcgcgatctccactcatcgcaacctctgcctcccagtttcaagcaattctcctgcctcagcctcccgagtagctgggattacaggcatgagccatcacgcccggctaattcttgtatttttagtagagatggggtttcactatgttggtcaggctagtctcgaactcctgacctcaggtgatctgcctgcctcggcctcccaaagtgctgggattacaggtgtgagccaccgcgcccagcgcaatcaggatttaaacaggataatttgagtctttaggtggaggagttcgggattttagttggagggatgggtgaaggacgccaaggaggtgagatttgagccaaagccagaaggctgagaaaatccccgtatgtgaagatgcagagaggccatttcctgcacatgggaagacagaacagcaaaagccgtgaggctggaatgagcctaccttgttggaggagacagacatcctccttgacatcctcgcttggacctcaaagttgccccctcagctccctctccacctatccctgatctttctgcatctcagcaaacggccccaccctccactcatccactagactgaaaaatagggattggggctgggcgcggtggctcacacctgtaatcccagcactttgggatgccaaggagggcagatcacctgaggttaggagttagagaccagcctggacaacatggcgaaaccccgtctctactaaaaaatacaaaaattagccgggtgtggtggcgcacacccataatcccagctactcaggaggctgaggcaggagaatcacttgaacccgggaggtggaggttgcagtgagctgagatggtgccactgcactccagcctgggcaacagagcgaaactccgtctcaaaaatagataaataaaaattaaaaatgaggagcgcagcttgctgtctccccttttctcacaccccacatccatccttctcagcatgtctgccaacctctacctataaagtaggtccgaaatccaggtgttttctttatccccatagcctgcaagctggctttggtatcctccaacccatctcccacctaacagctaaaatcagagagcttttttttttttttttttttttttgagacggagtcttgctctgtcgcccaggctggagtgtagtggtgtgatttcggctcactacaagctccacctcccgggttcacgccagtctcctgcctcagcctcccaagtagctgggactacaggcgcccgccacacgcccagctaattttttgtatttttagtagagacggggtttcaccatgttagccaggatggtcttgatctcctgacctcgtgatccgcccacctcagcctcccaaagtgctgggattacaggcatgagccaccgtgcccagccgctgagcttttttttttgatgcagggtctcactctgtcaccagggctggagtgcagtgggacaatcacacctcactgcagcttcgacctcctggcctcaagtgatcctcccacttcagcctccccagtagctgggactacaggtgcatgccacagctctttaaccataaatcaaacatgtcactgttaaaacctcctaatggtagcttccccctgggagtaaaatccaagcttttcacagtggccttaaagggcacctctcaacctccctgctgccatctcccaccatgctggccctccctccctctctcctctccagctacacagacctctttgctattcctggaacccaccaagctcttttttgtccaaggagtcaggtacttgccgctccttctgcctagaacaccccatttctcagttccttctcctcctttgggcctaagttcaaatgtcacctcctctgagaggcctgccctgaccactcctctcccctttactttgattttattcttctttcatatgccctttcacatgtatactctttcactgagtacattttctgttgtccatccctgcctaactagaaaggcagctccatgagggcaaggttttgtcttgtttcattgctaatttgggtttttgcacagtgctgggcacatattagaatctcggggcagggctcagtggcttatgcctataattcctttggaaggccaaggcaagaggatcgtttgaggccaggagttcaagaccagcctgggcaacatagtaagaaccatctctacaaaaagttaaaaacataaattagcagggcacggtggctcacgcctataattctagctaatcaggaggctgagttgagaggatcacttgagcccaggagtttgaagttacagtgagctatgattgtaccactgcactccagcctggacgacagagcgagaacctgggcttaaaaaaagaaaagaaggccaggcacgatggctcacacctgtaatcccagcactttgggaggccgaagcaggtggatcacttgaggtcaggagttcgagaccagcctggccaacatggtgaaaccccttctctactaaaaatacaaaaattagccaggtgtggccgggcgcagtggctcatgcctgtaatcccagcactttgggaggctgaggcaagtggatcacctgagatcaggagttcaagaccagcctgaccaacatggtgaaacctcatctctactaaaaatacaaaaaattagccgagcatggtggcacatgcctgtaatcccagctactcgagaggctgaggcagaagaatcgcttgaacccagaaggcggaggttgcagtgagccgaaatcacgctattgcactctagcctgggcaacaagagcgaaataccatctcaaaaaaaaaaaaaaaaaaaaaattagccgggtgtggtagcatacgcctgtaatcccagctactcaggaggctgaggcaggagaatcacttgagcccgggaggtggaggttgaaagtgagctgagatcgcaccactgcactccaacatgggtgatagagcaagactctctctcaaaaaaaaaaaaaaaaaaaaaaaaaagaacgaaggcattggagatttgagcctgagcagtggcgacaacaggaggagaggcaaggctgcatgttggagatggcagaggctgacaaagcagatgtgttgggaacagttagcaggagatccagcaggccagggggaggccagggcctcctcactcccccagccaaggcacctagcccacagggacccaggtgacacatgacaccagaggagccacagggcctcctggggcagggaccccctcagccgaggcagcagctgctgctgcagctggtgacatttcactccatgagagccctggcttcaaagtctttgcaggggtagccgagggagaaaagggggttgaagaggacaggctgggttggggagggagccacagcagggtggccaccagaggaccaggcagccagaggtgacttgggccggagcccttagccgaggtgtgtgggcctgatgggtccaggagcagccaccctcatcctgcagcccccaaggaacatagaaggaggtgtgggaaccctcgggcagccctaggctccccctaggggactgaggttgggcctgctgcccacggcctgcccactttacccagatgtccagcaaggtggccatcaacagtgacattgggcaggccctctgggcagtggagcagctccagatggaggcaggcatcgaccaagtgaaggtgagggtcggggccagtgcaggaggcgggaagaggtgggaacacatgggccaggggacaggtgcatgcctgggtctggtctggctgaaccagttggtctgcaggtgtccaaagatggccgccgatctgctgaagttctgcacggagcaggccaagaatgaccccttccttgtgggcatcccggccgccaccaactccttcaaggagaagaagccctatgccatcctatgaacccagggcaatgccaccctgtggcctgggcaaaccagggggcctcaataaacatgaagtgaatacttctcagggcatggctgagctgggctgagatgggagaccagagggactttgggcttgcaggggccaggtgcgtacctggcccagcctccctccctgcctgcccccggggtcacagccacagcagcacacacacaccctggagccccagacggagagcacgccatccctcttgccctcgccagcacccatgggatagcctgagcaggtaccctttcccaccgtgcagacaaatggccaggatttgagtcataatctatacaccacacgcgtcacacatcacacacacacgtgacatcatagacacagatgcccacgatcctcaggactctccctcttcaaatgcacagcaacagctgacatgcacccccagcccagacttgctatctctcccagtcactcccatgcaggcccgcagccccacagccccaagcaggcacaggcagaaccccagcaggcaaaccacactcacactccaggccc

SEQ ID NO: 465 - DNA, 9145 bp, Homo sapiens
tctgtgaaaagacagcaaagttactttccataagtcaattttgtcacacgaactcattctatttgatagtatttttttctttagaataaataaccttaacaatgttgggtttgaacatctgaattgaatgctaatgactaaataataaaatttattttgaatgacaggaaactgatacaaagggtttgtttagtctggaaagtatttcaggctttagaacagtttgttttcagtgtagattagttgcttcttaagaaactttgttctgaagaaaagaatgatatataatcaaatgtaggaatgttacaggtaaagttatcttcagatataaaaaagttttaaatttggtaatatattttccaatatttgtagttttatctagggaatataaaaacccttgagagaaaaattttactcttaaagagattcttatgatgtttttaaaggtagtgaaacaggatgcatgaataagggtgttcgctgcagcagtttggtaatagtgaacaattagaagcaatctaaatgtctcttagtgatagatacaaatacattgtgatacattaatataatttgatactctactgcatttaacatgcataaactagatctaaacttatcaaaatagaaatgcttaaaaagcaaaagttgattgaaaagaagaaagttgaataacagtatatatactatgatataatttctaagtgtaaaatgtttagaaatcacaaaatgatactatatatttttgtagatgtatatgtagacatacacatttgtaaaaatatagttacacataactgcacacatgtagacgtacacgtgtgtatgtactacatatacactatacacatacatatatcaaaaatcaaagtgatgaattaaatatggcataatgtgaatattttaaaatctagttgttacattaatgttgattatattattttccatacttttttaatgtttgaaatatgctttctactttttaaagtatgtactaaaaaagtaataattctacttctagttagaaacactaaaaggaatcttgtatatgagcacatatacaagaatgctcactacagcattgtttgtaattatggaaatttggagacaaccaaaatagcagatgatgtagctacatagctaaaattccaaaaaaacctatttaatagaatattttagccaactccaaacccaaaagtcagttttagattgattatagtctaaatgtgaagggttaagcagtaaagcttttagaggaaaacataggagaacatctttgtgactttgtagtaggccaatatttattcctctcctctcccctcccctcccctcccctctctttttgaaataaggtcttactttgtcactccgctggagtgcagtggcacaatctcagcttgctgcagcctcaacttcctgggttcaagtgattctcccacctcagccccccaagtagttggtactacaggcgcatgccaccatgcctggctaattttttgtacttttgtagagatagggttatgccatgttgcccaggctggtctcaaactcctgagctcaagcaatccacttgctttggcctcctaaagtgctaggattacaggtgtgagctactgcacctgcccaatttcttaaaccaggcataaaaagcactaaatagaaatgaaaaattgataaattggcctatgttaaaaccaagaacttaatgttcattaaaaaataccattaaacgaattaaaaggctactttctgagtatgaaaagatattttcagtatatatgtccaggaaagtagtagtactcagaatatatgaagaattcctgtgactaaataagaaaaggacagtcaacccaatagaaaaatgagcaaaacacttgaacagatatttcacataagaggacatccaggccgagtgcggtggctcacgcctgtaatcccagcactttgggaggccgagtcgggtggatcacgaggtccggagatcaaaaccatcctggctaacacggtgaaactccgtctatactaaaaatacaaaaaaaaaaaaaaaaaaaaaaaaactagctgggtgtagtggcgggcgcctgtagtcccagctactcaggaggctgaggcaggagaatggcgtgaacctgggaggcggagcttgcagtgagccgagatcttgccactgcactccagcctgggcaacagagtgaggctgtctcaaaaaaaaaaataataataaaaataaacaaatgagaggacatacggacatactaatggccaataagcacatgaaaaagtgttcatcttgatgtgtcttatttttctagatttttaaattggaagcttgcatcattatggatatttctttttttccaatttaagtattgtatgttgcaatatagatatccatctaaggattgcttttgctgtgccttacaaattttgaagtgtattttaaatttttctaagttcaaaataattcctagttcctcttggattcttctttgaaagtagaactgtttagaagcattatagaaaaatgttattcaatgaaacttgttaaagtttggtaaagaagactatttaggaccatcatcataggtagggaccactgcagtcggattttgcagttggggagaaaattggactcaactcctaatacagcatgggtaagtgggaatttatagctaaggtagaggtcagtggattggaaaattagtaagaggaaacatcagtgggaagggagattctggctaaactgaccttatcaggattttgattgaagacaggctagggtgatcagatacagcctagggggtggtggaggatgaggaacccagttagatattggccttgatttatatattgtggtggaagagattcttgctaaactgacttagtggagttccttgctaagactggattttacaaggaagtgcacagatgggcttaggagaaggttcaggagagttgactaaagattggttaagcagaacctctttgtcagaaataggttctttagtttcaactattttgggattttgcagacgtccttctggtatttatttttaattttattattctattgtggtcatagaagatgctttgcatgattttaaaatgcttttagctttactgagaattgttttatagcccagcatgtggtcttatcttgttgaatgttccatggcacttgaaaagaatatttgttttgctgttgttgggtatggagtgttttataaaacattcagttaggtcaagttttttgatagtgtttttcaaatgttctgtatccttacttatttctgtccactttttccatcaattactgggagaggtgtgttaaaatctcagtttaaatatcttcagttttttttccatttttttaaattattattatactttaagttttagggtacatgtgcacaacgtgcaggtttgttacatatgtatacatgtgccatgttggtgtgctgcacccattaactcctcatttagcattagatatatctcctaatgctatccctcccccgtctccccaccccacaacagtccccagtgtgtgatgttccccttcctgtgtccatgtgttctcattgttcatttaaaacacttttttagcacaggttttagagtatcatttactagaggcttgtttatctctactcattagaatgacccatctgtgttctctattgaatgcctctgatgttcaactaagattctctcttctctgactggtcgcaactcaaatgtatcccaatcctgtgtgagaaatattctgggaatattctgtttatagctcctgttgttctttgcctggccttgttgtgtttcatactatgcacatgcaaaaaaagaaataaagattagccacatactcaaaggaattcttatgcagatttctttagcttttttccactgtagattcctcctcacttggtcatatgcctcacaaattctggctgttttagacttcctaaactgcagtctcttgtttcaactcaatgagactgtcatgttcttcttgggacccctctccctgtctggaaagtgctttcaggcagaaatcgagccatcattaagggctctctctgtttatttgctttctctcagggattacagttctgtgctgcctattgtccagtggccgaatacagttgtttcctatcatttgtccagtaagaaatagattttaaattgtggtcctcataccagagtataagaaacaccagtgtaagtggatagtaaatcagagtcagtagctagtcagtgctcatcctggtcaggagtaccagggctctgcctctgtcagctcctccctcaaacacacagtaagatatggtttgttggtgcttagtttgactcaagaacaaggtggtccctgatgtctgtaaatatttattaaaagtagggactgtgtgtgttctttccaaaagaaacaagctgtaagtataaagtatgttttaagaagcaagaaataacttttccaacaactgcagccctaccttctgttgggttagtgatctgagagccaaggaaaactaagttgaggtaagttacacctgctttttctttgtggggccatcttgcttcagtatgttccacgttcttaaataaacaaatcaggaacctaatccaagcttaatcattgtgtggttgagtgtatgtgtgtgcatgtgtatgtgttcctcctatcaatctgtaatggacctgggaagctgccagtatatatcatgggatcccagtttttaaaatccttatgtgtgtgaattgatgtttataatatatgaacaaaaaatgagagtatacatatcaaagtgtaaacattattttttttccaggaagtatactgagtgaggggaaggagaggctacctaatttttacttcaaataactttttattgtttgaataattataacaataattacaacaacttgtgttgttgagtacataaaagtctagaactaatgtattttcctggtaaatcatttttgatcattgtgtgatgactatctttatttttaatttttttcttgcacgttttattttcttatgctcctttttttaaaattatactttaagttctgggatacatgtgcagagtatgcaggtttattacataggtatacacgtgccatggtggtttgctgcacccatcaacccatcatctacattaagtatttctcctaatgctatccctcccctagtcccccataccccaacaggccccagtgtgtgatgtttccctctctgtgtccatgtgttctcattgtccaactcccacttatgagtgagaaaatgcggtatttggttttctgttttgttagtttgctgagaatgatggtttccagcttcatccatgtccctgcaaaggacatgaagtcatccttttttatggctgcatagtattccatggtgtatatgtgccacatgttctttatccagtctatcattgatgggcatttgggttggttccaagcctttgctattgtgaacaaacatacaagtgcgtgtgcctttatagtaggatgatttataatcctctgggtatacccagtaatgggattgctgggtcaaatagtatttctggttctagatccttgagaaatcgccacactgtcttccacaatggttgaactaatttacatttccaccagcagtgtaagagcattcctgtttctccacatcctctccagcatctcttgtttcccgactttttaatgatcaccattctaactggcgtgagatggtatctcattgtagttttgacttatgctcctttttaaaaatgactttcttgcctttgatttgatacagttttttttttcatttctcttctgacctctaatttttattttttatatttattttttattctttaaataattattcttgaaattataacatacatcatttatttgacaaagtctaaagttcatcactagctgtatcctcctacaatacaaggaccttgaaatgtttaactatggtatctttgatgatccaatatcgttttgttgttgagaatgttagttctaccttattttagctcattcagatattgctatgattgctttagataataaatgtttatttaattccttgtatatatctgttagtgtctttcttcatcactgcttattttgttttataccttgcttttgagtacattttcttcttaaaatatatattttaatgattttttcatctaggatctatgagtagtaaactttggcatgtgaaagatattaattattttccttctggctttgtttgttgatatgagaactctgctgttattccagagatctttagttgttagaagtgttttcttctcaatctggttcatttaaagattgtctctatctttgttgtcctgaagtttcactaagacatttttaagtgtgaacagagttttatttactcttcttgcaattttttgatactctttaaggctattaattcatatcttcatcagttctcaaatcctgagctattaatattttgactgttatctcccatctgtactcctgccttcagtctttcaattctctccttgaataatttctattaaatgctttctatacttcttattgcaacatgttttgtatacctctactgttttccttcctttacctccttctgctctcttccattttatcaatttccattagctttttctacttgctattgaacccatccattgagttttaaatttctggtattatgttattattattaattttcattgctttatttcatatttttagatatattatttgattatttttgtctattttctgtttcataaacccctgttcttttttaatatatgtttatcacttctttatctttttaaaaacattttaaaaactctaatggtgaaagtaattttgattattctcttatctctattttattgttttacattatcccattttgggcagtgggatatttagactgtcattcatggctttgaacttatttatatacttattgtctccatgcttgactcgagaattattttctgtggtggcttttctcccatacattttcttagttgtggaagcctccctttagggatgattgtgtcttcctgaaccctccagtatactctggccatatgtccagtttttgtattatttttgattgttcatgtttctgtaaattgtatggctcagttttgaacctattgatttaggcttgggattctgatatcatgtggttgactctgtcctgtccccatcctagggctggagaactattttagtgaaactctaaccagataagttcagatattcaggttttcattcagcagattgttttctcccagtttcctgtcgttagctcatttttatctgtcaaccaggtagggccatgggtctaaatgtccatctgatatggtttggatttgtgtccctgcccaaatttcatgtcgcattgtaatccccagtggtgaaggaggggtctggtgagaggtgacttgatcatgtgggcggacttcccccttgctgttccattgatagtgagttctcataagatccggttgtttaaaagtgtgtagcacctccctctgtgctcttttcctcctgttccagccatgtaagacctgcctgcttcctgttccccttctgccatgaatgttaagtttcatgaggcctcctcagccatgcttcctgtacagtctgtggaactgtgagtcaattgaacctcttttctttataaattacgtagtctcaggaggttttttttatagcaaagtgagaatagactaatacaccatccctactcaggtctcacattctgaggtccccatgggcagtatttggttctggtcaaatactcacaatggtagctcaattctgttttactggaaagtctttttgcctttatttggcatctaggaatttaccattcttgttttcagtgttatgtattaacatttttcattactattttgcctagaatatctctgtgttaggatgtggttgagcatggcgggtgttgtggctcatgcctgtgatcccagcattttgggaggccaagatgagtaggttgcttgagtccaggagttcagcctatgcaacttggtaaaaccctgattgtacaaaaaattagctgggcatggtggcacacacctgtagtcccagctacttaggaggctgaggtgggaggatcacctgagcctgggaggtaggggctgcagtaagccacgattgtgccactgcacttcagcttgggtgacagagtgagactttgtctaaaaacaaccaagaagtggttgagcaatttaatacataatttttaaaattatatagtctgtattttaagtgtttagcatgtttattgagataaagttaacagaaataacttacttaaaacatttgattttccaggtcctcagtaaattcaattgtagttttttggatttgggcatattattactattttttattttatggagacaagggcctaatcttttgcccaggctgtagtgcagcagtgaaattatagcttactgtaaccttgaagtcttgggctgaattaatcctgctgcctcagcatcccaagtagctaggactacaggtgcgcgtaaccatgatgggctagttgttattgttgttgttattattattattattgtaaagacagggtctctctgtgttgcccaggctggtcttgaacttctagtctcaagtgatccccttgccttggctttctaaaatgctggaattgtaggtatgagccaccatgcccagcctgtgaatattattgatttatttttgctttcattttactcttctccattttatatacattaaaatatctttactgactttgatatattatttagaaatatatttaaatgtatatgtttgatttttttaaataaaacaatatggttttaagtaaatgtttattgctttttcataggatgaatcttgaagaagaattagatgaacttaaagtacatatatctattgataaggcagcaatacaagaattgaatagatgtgtggcagagagaagagaaggtaaattttcagaaaataaatacttaacagaggaattttaaaattgtgtaattcttgatgttttagtttcaatttcttttaagaatcttaccctttttgtttcttttccaacactttattcatt

SEQ ID NO: 466 - DNA, 9323 bp, Homo sapiens
gcatgcttccttcccaattctactcactacacatcctagtcaatttttgtctttaaacaacctttttaaagactagacaccttatatattatcagatcaagagtgagtcctaatacttttttcagttatgagagcaattcaaaagaatatatctagaaaaaattattttacaaacctaagattctcaagtttgtatctccagcttatacctctcccttaaactcagcttatatgtatacacacacattacatatgtatgtgtacacattaacacatgtaacatctccatttcaatgttgaacagacatatcaaatctagcatgtctaaaaacaaattttgatcatccctcaaaacctgtcatttaattaaatggcagccatatcttcccattgtttaggccaaaacttttgaagtcacctttgacctctctttctcccacactccacttccaaatcattaggaaatattgccggttctacttttaaaacaaatccagaacctgatcacttctcaggacttcctccaccaccccagtccacactaccatcatgtttcccttggattactaaaagaacctactaactgcttcctgctttgactgtcccccatctcgaccaaaccagtctcaattcagtagccagaatgaactttttaaaacattgtcagatcacatgactcttcttttaaaaaccttttaaaagattctcatctcatgcagagtaaaatccaaagtcttcacagtgcctccttccctatgtgatctgtgtgccacacttccctgcctgtcatctcattccctacacctcccacagcttactctgctgtcagccacaaggatctttgtagttgtcccatctgtgttgaaaacacattctcatggctcattccctgttagcactaacatctttttgtgaggccatgactgatagtgctatttaaatcccaaccccagatttggggaaactccctgtcttccttctctgttttatttctctctatagtgcttatcaccatgtgacatatcaggcgtcttattatttacttacttatcatgctttcattcaaattgctgtaccactattacccagaacagtgcctgaggcataataggtaattaaaaaaatgttgagttaataaataaatgaatatgactaatttcatatctgtcatttacttcctcctctccagtctcttgaaatgctttacataacaccaccttgtatttggccaaatacttgcatcttcacacatatcatctgtcttagtctgttaggtctgttataacaaaataccataaatttggtagcttgtaaacaaagaaatttatttctcaaagttctaaagtctgagaagtccaagatcaagacagtaacagatttggtatctggagagggcctactttctggtttatagatggtgccttatagctatgtcctcagatgtgtaaaggacaaaaagctctctggggcctctttttaagggtcctaatcctatttatgggggctctgctcccatgacctactggcttccaaaagctccatctcttaataccatcaccttgaaggttaggtttcaacatatgaattttgaaggaacgcacattcagaccatagtatcaactcaataaatgcctatttcttaattcaggaaattggccatcagtttatattttctaaaaattttctaaaaagagagagagagacagagttccctgaagatttcctatatcacagtcttatgataattttaaagactgcctcttcataaattatctcaacaatttttccttggaggtcctcccatcctgtcataaatttacagcatgaaacattgaagtaaacattaaactttactaaaagaacaaagtcttaccaaaaaagtaaaccttttgagttaataagagagttgagcaaggttgctggatatgtaaacataaaaggacaaattatataaaatagcagtaaatagaaaacaaaaatagatgtctctcacaagaacatcaaacaacatccatatcctgaaataaatctaaccaacagatgtaagaaccctgcaccaaaaacaacaaaacattactagaaaaaaatgacttaagtaaatggattaggttcatagatttgaaaactcagtaaagatgtcagttctccccagattaatctatagatctaacaaaatctcaatgcaaagggtgaagaatagccaaggccatcctgaagaaaaaagctaaagtacatacactgctacatatcaagacctattataagactttattaattaagacagtgtgaaattagtaaaggatgaaaaaatagaacacagaagcagacccatgcatttatggtcacatgatttatgacacagacaacactgaaaatgaagaggagagagagtggtctttcaaataaaagcctgattaattggtcccatctggaaaaaaaaaaaaaaaaagacttgaccctcacctcacaccatggacaaaaatcaattctggtggtttacgaatctaaatgtgaaaggtccaacaataaagattttagaagaaaacataggacagtatctttgtagccttggagtaggcaaagatttcaaaaagtgctagccattaaaaaaagtaataaatcaagccaaattaaaattaagaacttttgtttatcaaatgtattattaaggaattgaaaaggcaaaccacagagtgagaggatagtcataatacatgtatctgaaaaaaaaattatatccaaagtgcacagaaaactacaaatcaaaagggagacttcccaaaagaaaaatgaacaaaaatcatgcacagatatttcacaagagaatatccaaacagcccaaaaaaattttaaattcaattagtcattaagaaaattcaaattaaaaccacaaccaatgtgatattactctgtacccatgagaacagctgaaatgataaaaatgttaaaatatcacatgttaggaagctatggatcaactggaactcttatatgctgcttttaggagtataaatcagtacaaccattctgaaacactgttcaccaatatcttttaaagctgggcatgtaatttggcaaggctaaagaaaagagaccagatgcaaaaagagtatataattccatttagataaagtacaaaaataggcaaaattaatctaggctatacaaaagtattgggtgaatgggtcctgactggcagagaacctagagcatttaagattctagtaacgttcttttccttgatttatgtgctattaatagttacataggtgtgtctggtttgtgaaaatttattaaggtaaagcaaaagtttactacaacatgatagaattcagtggtgtaaaaaccattagaatttcatattcaagaaattataagtacaagtttacattaatttaacactggtttgaacacagagattagccaatctttcactttgtagtgttatacagcagaagtcaatacttacagtaaatttagctctttcttccatcacttcataacccagtatagtaggtgtagatggtctatcttcccaattcactgtttccggattttgttcttcagtgtctcttggtctagtagaatactcaatggaagaagctgtacctgtaaatttagtcctaatgaggggactgctacagacagatgaagtattatccatttgatcaggaacacttgtctgtttaaaattacccatatttgagtcttctaactggcccttagaagaatttgagcttgttgagacactgccaaaagaagaacttctttgatttctgtttgttgtaaaactggaagcagagtttcctatgggcataggaactgggacataaggagttgccatcttcttttggcttttccaacaagcttgcacactgttgagtccacttagagaacaactaatatgcaatccattattttcttcttaggaattcactatctaaaaatgaaaaggacatattaaaaggttagtctttaatgtgcagcaggattcaaaagaaaagtattcttttcaattttatgacactattattttatttggaatgaaaacatacctcaaaccccttctcccagttgtctttaaggactcctatttgcaagatagagagagcaaaactacttcacactctttttccttgactccatgttacatgttatccctttttcctctactttattcccttgtgaagtatttctgtaaagttcattttaacctgatttcatgtatgtaaaagttggtaggagaaagattggtaaagacccttctgaagctttattccatgcttatcatcttgacagtactacattcagtacaagagagaaaaaagaaaaggaagaaaactatttacattacctctggatttaatcagaaagggaggaaatctattcacattacctttcaatttaattagtgaaactataaagatttacacagagtagtaacaatgaaccagatgctttgatgctacatagtataattctatagaacccaggattaaaaatacacacttggtcaagttactcaaataaaacccagtgaacactgaacttatatgcaacaaaattaaatagtgaaaattgtaaccgttcttcacagcttacaggtcatcactaattctgctctacgataaactgagggtatttaaatctttataacttacactcaagaatctgttatcaaacggaccagtatatcttgtgtcagaatagtatcataacacaaagaagaaatggtttactattactttgttaaataataaactcataagaaactgtaacaactacagaccaacaaaatgacaagactacacacaacaataactgcccaacttttcatacgaaactctactggtgggaaaggtaagaaatgagtcacctggacttggaaagatgctgaaataagatttttaactctgggctgggcgctgtggctcacgcctgtaatcccagcactttgggaggatgaagcgggtggatcgcctgaggtcaggagttcgaggctagcctggccaacatggtgaaaccccgtctctactaaaaatacaaaaattagccgggcatggtggcgcaggcctataatcccagctacttgggaggctgaggcaggagaatcgcttgaacccgggaggcggaggttgcagtttgccgagatcgtgccattgcactccagcctgggctacaagaggaaaactccgtctcaaaaaaaaaaaaaaaaaagatttttaactcaagtggctctcggcaacatttccccattatcaaagattcatgaaactttagctgctgattcaccgctcctcggttccgcctgacggcctccccaaaaacaagtaagtctgaaatctcaaccttctcaaggtccgagggatctacctggcctttgccactctactacctgaggccgcctggctggggggaggtcgcatatcaatacatatcaacacaaccactgacgtccgaagatgtgagcgctacccaagcgttaaaaaaacaaaacaagcaaacaaacaaacaaaaaaacgtgctgtgctcattaggagcgtcttcgcctctaccctgatgcggagttgctcccaggacgctcagttcattctcactctggaaaacctcaggtgaggtggcccgactctgagcaaccccgtgggcgggaggaaagaggcaaataccaggcacagttcgaccctcggaaggtaaggccggggtctgcgccggtcacgggtcttccgcactgcaggcggcgagacccgcagctccctgggatcacagactctcccgcctccgctgaccggtgcgcgcccagcgcctcccagacgcacagtggggtcggcggtggcctgaaggtggctgggcttcctgcggcgcctctccactctcccgcggagccccttgccgcccgccagacatcaaggttgcaggtgtcacccgtacgagaacccgggacagcgaccgcctgtcctgaggtaatgacccagtctttacctcagccccctcggcgatcccgaacgagcgcgcttcccggtgacggttaaaccggactctccttaaccgcagcttttcgcctcctccctcagcagcgagaagcctcacgtgacacccccgccccaaaagcagctgctccccgcctcagccagtctctgcccgggcccaagatccctgctgtgtggaaggaggggccgaactgggcggggggggggggggggggagagagagagagagagagggagggagggagggagggagggagagagagagagagagagagagagagagagagagagagacagagacagagagaaagagagagagagagggcaagagcgagagacagagagagagagagagagagagagagagagagagagagagagagagagagagagagaaagagaaagaaaacgagcgagggagagagcgagagcgagagagagagagagagagcgtcacacacacatctctgccggaagtgatgtcacggcatgggcgcccgcccaccggaggagcgactggagttgatcggctgggcgctcaggtagcgaagataaatgtaatcttgtggcaggaaatcgacattctctgcactatctttagttttccaactgaacttctgagaaatggaggctacaatacctagtttgccaaacaggagaagactacaattcccagaaggaactgcgaccaacattggtccgtgctcatactttgcatcatgggacttgtagtcatcaccagcttgcgctgattctaacaggttatagattgttttctagaattagcagcgctttaagggatgacaatcgattagaagagtaggaagatagaacactgcttagtagctgatccgttctacataattcagaagttctcattggcagagaacccctgaaattctgtagtgtctttttactatccggtgagcaatttgatcccgatgatggaatattagccttgttagacatgcgcttctgaagacctgtgcagtagggaaagccgagttttttgataggcaaatcccaagattcagaccggtctacaggtctgttcatcattagaatcagataatgtggttgaaaaatcattccacgatttctaaggcttttgtatagtcccaatgttacccatggagggtcttgactacaagtcatccaggttcttggtttttttaacaaagaattggacaaaacgcacaaagaaagcaaggaaagaatgaagcaaggaaagcagagattgaaatgactgtacactccacagagtgggaatggcctccagccagtggctcaagagccctggttacaggattttctggagtttaaatatccgctagagatttcccattggttacttggtttacaccctctgtaaattaaggagtagcctgcaaccaatcagaggctaaagttaagttacaaagttgtactcctatggaaatgaagactaggcccagataccaagggcctagaaggttgggcagggggttgcaaagggaatagcctctggtctttttgttacttgggcttggaaagttggagttttccttttgatttagttctaggaagtcagcgtgaatgggccttaggttccctgcctccggaccctattctactgcccgactaagagtgagaaaaggtgatagtggtcattttgaaatgaaggttggaaaatagtctggtttgtgacatgatgatggttttggtttaagagattctgcccttttagtgtgaatgaaataaaaatagaattctgtagaaacaatgttaggtaggagaatagggtctggaaacaggggacctaaggctgattcatgctgactgatatcagaggcgactccattttcaacccctcttttttctgcgtggcagttgctgcgtggcagttgcaaccctcctttctttgggtggcagttgaaaaatgaaagaacctctgatagagcccctccctcaaccaatcagactggttgagggcctacttttcactctgattggtctccttccacaaccaatcagactgggcataggccaatgggaaccctctagagggtatttaagccccagaaaattctgtagctgatgctcttgaaccccttgactgagtctgttttccttctgtggagtatactttcatttaaaataaatctctgctttccatgccttgtttgtgtgttctgtccaattcttcgttcaaaacaccaagaacctggacaactaccctcaattggtaacatattttggtgagccagccagaaggtaagcccaaagtttgggatttgtatttttctttttcctctttctctctctcccttttcctttccaagctgggatccttgatggacagtgcctaagcatggaggcaactgcaggtttctggccagggccactctctggtgaaactaaaaggtccatgtggaagcacctgactgccaccacctggttcaggtgaggaacctgagttcttttctttttcagtctttcagtggccatttcctagtagctccttggtaactgaaggcaactggggccactctctggtgttaactgaaggcccaggagtgaatggggatagctgccttgcccagaaaggggaaggactcttttctgtcttttccagttgtagtccctgatgcctatgagtgatgcaattggcagtggcagcctgtccagggaaaattcacacatgtttcaggtggcttaagccttctttccttatgttaaattcttccgtccccctacttgactggctaaggataagtcacagagtttgggcatattgtggtctgtgtaactcatggaggggattcatgaaagggaatctatgtacaatttaatcttgtccaaatttagaaagttaaagaattgttttaagtgtgataggaaaaaaaatccaaaggtttgtctgaaagttaattctagaagtagagaccttcatccagggacaagagggaaaactcacagtgggtcatcagtggtggttggaatcattccaaagtggtggtggcaccaatctaaggtcagagacgtctaatgtactaagaggggtctctggcactagaggattgactgcacccgctcccaccaaggggctcagttaggcaaaagtctagcagtgtgaaaggaggaattagatgaagactgaaggggcctagagtcttcctcactgcccctgtccaggaacatcataattactattgcagagccctgggtaactagatgtcatgggtacccaaattcagttttttttttccaatacaggggcgaattactctgtccttactgcttatgcaggaaaactttcctcccagtctaagagtgttccgggaatggaaggaaagc

SEQ ID NO: 467 - DNA, 9603 bp, Homo sapiens
accttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgtttcaggaagatttattttttctattttgctattgtggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaaggaataaagtgaatgttttgtttgtttgtttgttttgagacggagtctcagtcaccaggctggagtgcagtgctgtgatctcagctcactgcaacctctgcctcctgggttcaagcgattctcctgcctcagcctcccgagtagctggcattacaggtgcctgccaccatgtccagctaatttttgtgtttttagtagagatggggtttcaccatgatggtcaggctggtctcgaactcctgacctcatgatccgccagcctcagcctcccatagtgctgggattataggcatgagccatgctcccggccaaagtgaatgttttgggtgaagtttatataaggatttgacttttgtatcattattaaagtttctgtcaggtaatacagtgttggccctctgttgaaataaaatgttacatatcgctgggtgtagtggctcatgcctttaatcccagtactttgggaggccaaggcaggaggattgcttgagctcagaagtttgagaccagcctgggcaacatagcaaaaccttgtcactataaaaaatacaaaaattagccaggcgtggtggtgcacgcctgtagtctcagctactcagtcggctgaggtgggaagatggcttcaagccgggagatggaggcttcagtgacctgtgacctgtgatcacaccacttaattcctcaaaacatttatgtcccagttccctccatttcagagccatgggcaacagagcgagaccctgtctcaaaaaaaaaattacatataagcccggtttaaagagaggataatatgcaaccaccctagttgaaacagagtgtatcacttctttctcaccctaaatttaatgcctagtttgaaaatcagtagacaataataaagttgataagctttaggttggtaggaaagctatgtaatctatatagtgtactaaatccttatatgtttttggtaaaaaaagactttaatagctaatttggacttcagaaaatgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtgaaagatgtcttttctgattcattcttgtatgttactttcctgaattgctattccctctgccccctgcaagtccttgtctgatcactggtaccaatactttgtttagtatgagttgtattagcattaacttaaaaatttttaggccgggcgcagtagctcacgcctgtaatcccagcactttgggaggttgaggtgggtggatcacaaggtcaggagttcgagaccagcctggccaatatggtgaaacctcgtctttactaaaaatacaaaaaaattagccaggcatggtggcacatatctgtaatcccagctacttgggaggctgaggcaggagaattgcttgaatccgggaggcagaggttgcattgagccgagatcgcgccactgcactccagcctgggtaacagagcgagattccatctcaaaaaaaaatttttttttaacttaaaaatatacaaaaaaggcaaaatactgcacatgtaaatgtgataaatatatttggaagaaacctagtctattttttatttttttatgtctttgagacagtctcattctgttgcctaggccagagtacagtggtgtgatctcagcttactgcaacctccccctcctaggttcaagtgattctcctgcctcagcctccccagtagctgggattacaggcacacatcacatgtctggctaatttttgtattttttagtagagatggagtttcgccatattgcccaggctggtcttgaactcctgacctcaggtcattcacctgcctcggcctcccaaagtgctggaatagaggcatgagccactgcacccggccagaaaccaagtctcttttaaaagtaacttcaagtgtatttagtattaactctatggttcatgttcataaatgctgttcatcttgataccaggcaactttatatgctgaatatagccaaaagagaaggcaaacaactgactaggactttcttgtccagtctaatgaaggggaactgtgttaaaggttacaaataaattgtggggcccaattgtgactttgtatttgcatcaagaaatgcagtgacagtgactcttctgctgcctctctctcttgaggccgttatttgttgcttaattccttttgctcttggccttttaaaacctgtgaaggggcctggtgtggtttcttacacctgtaatcccagcactttgggaggctgaggcaggtggatcacttgagcttgggtgttccagaccagcctggccaacatgataaaaccctgtctctattaaaaatacaaaaatcagctgggcttggtggcgcacacctgtaatcccagctacttgggtggcagaggcatgagaatcgcttgaatctgggaggtggaggttacagtgagccaagatcgtgcttctgcacttcagcctgggcggcagagtgagactccgtctcaaaaacaaaacaaaaacctgtgaaggtatctaagaaagcattgctctacctctgatgggtagaaatggactttaggtttttaatgaaaggtgaaaagcggttggctaggaggtatgcctcttaagactaagggaaaccagttttggagcaagatagggttgcttcctcctgctatcgtttgaatgtgtctcctccaaaattcaggtattgccaatgtgctgttactgaggcagagcctactttttggagacagtgtctcgttctgtcacccaggctggagtgtgtggcgtgatgtgggctcactgcagcctccgcctcccagctttacatgattctcctgcctcagcctcctgagtagctgggattacaggcaccggccaccatgcccagctagtttttgtatttttagtagagacggggtttcaccatgttggccagtatggtcttgaactcctgacctcaagtgatcaacccgcctcagcctaccaaagtgctgggattacaggcatgagccactgcactcagccaaatttctcttctttataaagtacccagtcccaggtattctgttatggcagctcagatgaagatgccctttctccaaagaatctactcgtaataggagcctattatgaggaatacttgacattgcaacactttgttggtggaagcacatatgatagcaacagtcaaggaatactctccagttactcttgatgatctagctatacccacctggctctgcagtgccaaaggagtgggaaaggggaaatcctttcagaagttaactctgcccctgtttcttggacccagtggctgttgttcattgctgctaggggcaaagccatagtgttggaattttttctgatgaatttatgaaagcgtagagttgtgtcactttaggcttggataactatcatttggactcaaccaaattcatgcatctgatttataaaacatataacttggtaaatttactatgagaaatcactcagtagcatcctcaaggttggcatgatcattgaatttgctctgtagaagcccaacttagtgtacaatgagaaagatgaatttattctcacagactgcataatcatttgtcagatactatgccatgcactgaagacacatgaacaatacaaaagcatatttcttcctgtaggcatgcccgtgtgtgaactgaatgataaagtcagacatcattcagttttagggatgcccttcttgtgtggaagcaatactagaagctactctttcccttggaaagtgtttggctgagtagtgcttagatttccttctcagtgtctgcttttaaaagttgctaactggaggccctgtgtggtggctcacacctgtgatcccagcactttgggaggctgaggtgggcttatcacttgaggtcaggagtttgagaccagcctggccaacatggtgaaaccccaactctactaaaaatacaaaaattagcagggcatggtggcacgtgcctgtaatcccagctattcagggggctgaggcaggagaattgcttgaacctgagaggtggtgagcctagattgcaccgctgcactccagcctgagtgacagagtgagactctgttaaaaataataggaagaaaaaaaatggaagtttctaattggtaccttctttttttagctacattaaatacaaacactggcccacttcccctgcagattcctttagggagctttgcatgctctaagtgcctgcagatgtgtttataaatccctgaccacacagttagaaaatgagttgataggccaggcatggtggctcatgcctgtattcccaccactttgggaggccaaggcgggcagatcacctgaggtcaggagttcaagactagcctggccaacatggtgaaatcccctctctactaaaaatataaaaattagctgggcatggtggcgggtgcctgtaatcccagctactcaggaggccgaggctccagagaatcgtttgaacccaggaggcagaggttgcagtgagccaaaatcacgccactgcactccagcctgggtgacagagcgagactccatctcaagaaaaaaaaaaaaaaatcgactctgaccatcacttttacacatcttgaggttttctgtttaggaagattcttacctactcagcttacattttgctatggtattttccatcaaagaccttaatagtattttactttactccattttaggattctcttggtataattaaaaattaggagaggagttaccttataagtagcaattgtattttttgatagttatagtcttattgtattgtttttgtttatgcctcatctattaacttttttctttttgttttgtagagatggggtcttgccacgttgtccaagctggtctcgaattcctggcctcaagccatcctctagcctaagcctctcaaagtgctgggatgactccggcttgagccaccacacccagccattcatccaactttttttttttttttgagagggagtttcactcttgtcgcccagaatggagtgcgatggtgctgcaacctccacctcccgggttcaagcgattctcctgcctcagcctcctgagtagctgggactacaggcatgtgccaccaggccaggctaatttttgtatttggtatttgtatttggtagagacagggtttcaccatgttgatcaggctggtctctatctgacctcaaatgatctgcccacctcagcctcccaaagtgctgggattacaggcatgagccaccacgccctgcctcatccgttcaactttaacgtaggcctttgccgagagcttcatacccatgtattaatgtataatcaaatagttacttttcattcccatccagatatctcaatcttactgcaaacttaatatatccacagtcctaaacgtatccttctccaaagccctcctccaaatctggtcttcctcctttgtttccagtcttagtaaattgtattgttacaggaaatggggttcagattcagaccccaagagagagtttttagatcttgcacaagaaagaattcagggcgagtccacagtgcaaagcaagtttattaggaaaataaagaaaaaaagaatggctactccatagagcagccctgagggttgctggttacccatttttatggttatttcttgatgatatgctaaacaaggggtggattattcattcttccccttttcagaccataaagggtaacttcccgacattcccatggtatttgtaaactgtcatggcgctggtgggagtatagcagtgaggacggccagaggtcactctcgtggccatctaggttttggtgggttttagccggcttctttactgcgacctgttttatcagcaaggtctttatgacttgctatctcatcctgtgacttagaatgccttaaccatctgggaacgcagccaagtaggtttcagccttattttacccagtgcctattcaagatggagttgctatggttcaaactcctctgacattatgtatgatcaccataccacagcacaagacagaaaagagacctttgatgtctcacagatctaatcacttcctaaatcctttagattatactttatgtgtttttctagaatgtgttcacttatttctatctgctttcttaatactgtacttggatttttttgaactaggttaagaatacaaaagatggataattttgtgtgctctataatgctattatgtgtattttaa

SEQ ID NO: 468 - DNA, 9622 bp, Homo sapiens
tctgttcctacattaaggtttgtaggattgtattttctgtaggaggcagatttaaaacctatgcattaaaaccagctttcagaggcggttccaagatagctgattaggaacagctccagtcaacagctcccagtgcaagtgacacagataacaggtgatttctgcatttcctactgaggccccaggttcatctcactgcggcttgtcggacagtgggtgcaggacagtaggtgcagcgcaccgagcatgagccaaagcagggggaagcatcccctcacccgagaagcacaagaggtcagggaattccctttcctagccaagcaaagctgtgacagacggcacctggaaaatcgggtcactctcaccctaatactgcgcttttccaatggtcttagcaaacggcacatcaggagattacatcccacgcctggctcagagggtcccacacccacgaagcctcgctcattgctagcacagcagtctgaaatcaatctgcaaggtggcagcgaggctgggggaagggtgccctccatagctgagacttgagtaggtaaacaaagcggccaggaagctcttgagtaggtaaacaaagcggccaggaactgggtggagcccaccacagctcaaagagacctgcctgcctctgtagactctgcctctaggggtagggcatagctgaacaaaaggcagcagaaacctctgcagacttaaatgtccctgtctgacaggtttcaagagagtagtggttctcccagcacagcatttgagatctgagaatggacagactgccttctcaagtgggtccctgacccccgagtagcctaactgggaggcaccacccagtaggggcagactgacacctcacatggccgggcagccctctgagacgaaacttccagaggaacaatcaggcagcaacattcgctgttcatcaatattcgctgttctgcagcctccgctgctgatacccaggaaaacagggtctggagtggacctccagcaaactccaacagacctgcggctgagggtcctgactgttagaaggaaaactaacaaacagaaaggacatccacgccaaaacccatctgtacgtcaccatcatcaaaaaccaaaggtagataaaaccacaaagatggggaaaaaacagaacagaaaaactgaaaattctaaaaatcagagcgcctctcctcctccaaaggaatgcagctcctcaccagcaatggaacaaagcaggacggagaatgactttgatgagttgagagaagaaggctacagatgatcaaacttctctgagctaaagacggaagttcgaacccatggcaaagaagttaaaaacctagaaaaaagaatagatgaatggctaactagaataaccgatgcagagaagtccttaaaggacctgatggagctgaaaaccatggcacaagaactatgtgacgaaagcacaagcttcagtagccaattcgatcaagtggaagaaagggtatcagtgattgaagatcaaatgaatgaaatgaaacaagaagaggagtttagagaaaaaagaataaaaagaaacaagcaaagcctccaagaaatatgggactatgtgaaaagaccaaatctatgtgtgattggtgtacctgaaagtgacaggattaatggaaccaagttggaaaacactctgcaggatattatccaggagaacttccccaatctagcaaggcaggccaacattcaaattcaggaaatacagagaacaccacaaagatactcctcgagaacagcaactccaagaaacataattgtcagattcgccaaagttgaaatgaaggaaaaaatgttaagagcatgcagagagaaaggtcaggttacccacaaagggaagcccatcagactaacagctgatctctcggcagaaactctacaagccagaagagagagggggccaatattcaacattcttaaagaaaagaattttcaacccagaatttcacatccagccaaactaagcttcataagcgaaggagaaataaaatactttacagacaagcaaatgctgagagattttgttaccaccaggcctgccctaaaagaggtcctgaaggaagcactaaacgtggaaaggaacagccagtaccagtcactgcaaaaacataccaaattgtaaagaccatcaaggctaggaagaaactgcatcaactaatgagcaaaataaccagctaaaatcataatgacaggatcaaatccacacataactatattaaccttaaatttaaatgggctaaatgctccaattaaaagacacagactggcaaactggataaagagtcaagacccatcagtgtgctgtattcaggaaacccatctcacgtgcagagacacacataggctcaaaagaaagggatggaggaagatctaccaagcaaatggaaaacaaaaaaaggcagggattgcaatcctagtctctgataaaacagaatttaaaccaacaaagatcaaaagagacaaagaaggccattacataatggtaaacggatcaattcaacaagaagaactaactatcctaaatatatatattcacccaatacaggagcaccaagattcataaagcaagtccttagatacctacaaagagactcccacacaataataatgggagactttaagaccccactatcagcattagacagatcaacgagacagaagttaacaaggatatccaggaattgaactcagctctgcaccaagtggacctaatagacatctacagaactctccaccccaaatcaacagaatatacattcttctcagcaccacactgcacttactccaaaattgaccacgtagttggaagtaaagcactcctcagcaaatgtaaaagaacagaaattataacaaactgtgtctcagaccacagtgcaatcaaactagaactcaggattaagaaactcactcaaaaccgctcaactacatggaaactgaacaacctgctcctgaacgactactgggcacataacgaaatgaaggcagaaataaagatgttctttgaaaccaatgagaacaaagacacaacataccagaatctctgggacacatttaaagcagtgggtagagggaaattaatagcactaaatgcccacaagagaaagcaggaaaggtgtaaaattgacaccctaacatcacaattaaaagaactagagaagcatgagcaaacacattcaaaagctagcagaaggcaagaaataactaagatcagagcagaactgaaggagatagagacataaaaaacccttcaaaaagtcaatgaatccaggagctggttttttgaaaagatcaacaaaattgattgactgctagcaagaccaataaagaagaaaagagagaagaatcaaatagacgcaataaaaaatgataaaggggatatcaccactgatatcacagaaatacaaactaccatcagagaatactgtaaacacccctacataaataaactagaaaatctagaagaaatggataaattcctcaacacatacaccctcccaagactaaaccaggaagaagttgaatctctgaatagaccaataacgggctctgaaattaatagcttaccaaccaaaaaaagtccaggaccagacagaatcacagccgaattctaccagaggtacaaggaggaactggtaccattccttctgaaactattccaatcaatagaaaaagagggaatcctccctaactcattttatgaggccagcatcatcctgataccaaagcctggcagagtcacaacaaaaaaagagaattttagaccaatatccctgacgaacatcaatgcaaaaatcctcaataaaatactggcaaaccgtgggcgcggtggctcacgcctataatcgcagcactttgggaggctgaggcgggcggatcacaaggtcaagagatcaagaccatcctggctaacatggtgaaaccctgtctctactaaaaatacaaaaactagccaggcgtggtggtggggacctgtagtctcagctactcgagaggctgaggcaggagaatggcgtgaacccgggaggcgcagcttgcagtgagcccagatagcgccactacagtccggcctgggcgaaacagcgcaactccgtctcaaaaaataaataaataaaataaaataaaataaaataaaataaaataaaatactggcaaaccgaatccagcagcacatcaaaaagcttatccaccatgatcaagtgggcttcacccctgggatgcaaggctggttcaacatacacaaatcaataaacgtaatacagcatataaacagaaccaaagaaaaaaaccacattattatctcaatagatgcagaaaaggcctttgacaaaattcaacagccattcatgctaaaaactctcaataaattaggtattgatgggaggtatctaaacataataagagctatttatgacaaacccatagccaatatcatactgaatgggaaaaactggaagcattccctttgaaaattggcacaagacaggatgccctctctcaccactcctattcaacatagtgttggaagttctggccagggcaatcaggcagaagaaagaaagaaagggtattcaattaggaaaagaggaagtaaaactgtccctgtttgcagatgacatgactgtatatctagaaaaccccattgtctcagcccaaagcctccttaagctgataagcaacttcagcaaagtctcaggatacaaaatcaatgtgcaaaaatcacaagcattcttatacatcaataacagacagagagccaaatcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatggataggaagaatcaatatcgtgaaaatggccatactgcccaaggtaatttatagattcaatgccatccccatcaagctaccaatgactttcttcatagaattggaaaaaactactttaaagttaatatggaaccaaaaaagagcctgcattggcaagtcaatcctaagctaaaagaacaaagctggaggcatcatgctacctgacttcaaactatactacaaggctacagtaaccaaaacagcatggtactggtaccaaaacagagatatagaccaatggaacagaacagagccctcagaaataataccatacatctacaactatctgatctttgacaaacctgacaaaaacaagaaatgggaaaaggattccctatttaacaaatggtgctgggaaaactggctagccatatgtagaaagctgaaactggatcccttccttacaccttatacaaacattaattcaagatggattaaagacttacatgttagacctaaaaccataaaaaccctagaagaaaacctaggcaataccattcaggacataggcatggtcaaggagttcatgtctaaaacaccaaaagcaaaggcaacaaaagccaaaattgacaaaaatgggatctaattaaactaaagagcttctgcacagcaaaagaaactatcattagagtgaactggcaacctacagaatgggagaaaatttttgcaatctactcatctgacaaagggctagtatccagaatctacaaagaactcaaacaaatttacaagaaaaaaacaaccccaccaacaagtgggtgaaggatatgaacagacactcctcaaaagaagacatttatgcagccaatagacacatgaaaaaatgctcatgatcactggccatcagagaaatgcaaatcaaaaccacaatgagataccatctcacaccagttagaatggcaatcattaaaaagtcaggaaacaacaggtgctggagaggatgtggagaaataggaacacttttacactattggtgggactgtaaactagttcaaccattgtggaagacagtgtggtgattcctcaaggatctagaactagaaatatcatttgacccagccatcccattactaggtatatacccaaaggaatataaatcatgctgctatacagacacatgcacaagtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcctcagcaaactatcgcaaggacaaaaaaccaaacacctcatgttctcactcacaggtgggaactgaacaatgagaacacttggacacaggaaggggaacatcacacaccggggcctattgtggggtggggggatgggggagggatagcattaggagatatacctaatgtaaatgacaagttaatgggtgcagcacaccaacatggcacatgtatacatatgtaacaaacctgcacgttatgcacatgtaccctagaacttaaagtataatttaaacaaatttaaaaaaataaagaaaaaaaaacttctaaaaaaataaataaaaccagctttcatttgataaacaatttattctccaaagtgctaatttttttttaaattgcccttactgaggctttttaaacaaataaaaaaagaggagagaagacaatgaataggggcttttggttacatgagaagtatgcagcagtgtttgagagtgtggatgttttggtgtctttttatccatttaattactaagttggatttcagctgacatgacacttaattctaacttctttgctaccaaataatggctgtcacagtttgaaacacgtcatatttaccaaaaatgggcaaatgctttcttgagctgcctctgtaagacatatttcaaatgaaaaccagatgaggagacttcttccaaaaatattgtcttgtcttgtaccaacagaaaagcaccgaaaactgttttaagcataatcagaattcctaatagttaccccctatttagccaattttttggaaaccaaatgtgaatgtagattccttaaattaaaatttatgtacttaacaattactttcttgaaatgcaagcttattttaagctaaatttggggtgggggtctgtgaagcaaatgcagaaatgcattttcttgaaattgttgagtttgcattgtgctactaacacaattcccattttcactttccttgcacaccagttagctctgtccggtgtcatcgccagcctgtctctactttttaaaaaatcatccatcttaagaatgtgggtcattgactataataagccaaacttatacagcacaggtgcagcaaggacaatttattgctgtctgcagacagttttttgttgtcgttgtttttgagacagggtcttgctctgccacccaggctggagtgcagtggtgtgatcataactcactgcagcctcagactcctaagaccctcctgcctcagcctcccaagtagctgggactacaggttcatgccatgacatatgctattttttaagatttttatttttattattttgtagagatgagatctcactatgttgtccaggctggtctcaaactcttgtgctcaagcaaccctcccacctcagtctcccaaagtgctgggattacaagtatgagtcagctcgcctagctagacaatcttaaagtatttgctttaaaggtaattgattcaatacctcaaatttgaataaaaggtaggattattcacatttaacatttcacagcttaccaatgttaatactccaatcattttcactgtcttcgtttttttccttttttgtttgctgtaaaaaatagaattgcttcaatttaaaactgttacaaaatgttttacaatcaattgaacataaatatgtttagttacaatattcaactattatattttcaaatataagagtgatgttcacaaaatgtcaaaattattcagttcaacaaacatagcaagcacaaaagtaactgtcgaaggtactacaaagatacatggatacataagaaatggtcgcctgccttacagagctcacatacacaggaaagataagtatgctaacagtgtcgctaagtcaattaagttatttgttttctaaaattaaaaaaaatcatgatttaaaattaggaatgtctattcttctgaaggattgtggagagtggtgtcaggcaatcttgttggtgatacattcaaagtacatctagaatttaaccacttatcaccagtttcattgctgtcaccagtagggcagcctcctgcctagtctctccacttccacctatgccgcttcagtctatcttcaactagcagtcagagtaattatttcaaaatgccaagccatacactacttctttgctcaaaaacctacaatggctttcctttttcttacaataaaagccaaaatccttgcattaacctctgaggtcctacacgatctgtttgcttatttcctctctgaccacatccctactcccaaacctgcttactctgctccaaccagcctggactctctgctgttccatgaactcaccaaacatgtacctgactcagggtctttgcattgccagttaccttttccgggaatgctctccccttagatacccacacagctgtctcctctcatttctttcaagtctttgctcaaatattacctttaaaataagatctaccctaaccaccctacttaaaattacaaagtactccccttttgtactcctgatccccttaacctggattaatgcttttttccatggcgttaattaccttctaacattggctgtggtttacttatttagtatgtacattatttatgtctgtcctccgtactataatataaactctatgagggagtgtgtgtgtgtgtgtgtgtatgatgatttatatatatatgatgatttttacataaatatgatgcatttatccaggtaaatgataaagttttactcataagatgattccaaattatgtaaagtattgactaaaatcactggacaaacatctgccactaaatatgttcaaaagaatgtgccatgggcaatagcaacataattagaacaagaatataactaatttgattgaagcaggcttaacttcctttaaatatattatctttggtctgcttttataaaaattagtttcactacatttgatttcataatcatgtggtcttaacttattgttaactttctgtatttctcttttgagctgctttcttctttccagcagaagctgtgggcttcccctctgaggactttcctgggttctgaagtgttactacaccttttgtaggaatagctcctttgcacacgcatcaaatgttaagccagtgcaatacataaatagacttcttcatgaaaatgccatctattaatagactcacagtcaatccctgcctaaacagccagctgatgaaaaccatatttttctattgcgtgtgtaagtacttccattggaagtaacaccatctatcactttttcaattctacatggcaaaactaaattttctatgaaaaaatacaatggtgcttagaagaaatacagcaaggttactgcac

SEQ ID NO: 469 - DNA, 9731 bp, Homo sapiens
tgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggcacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttcttttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctc

SEQ ID NO: 470 - DNA, 9799 bp, Homo sapiens
ccaaaaaatctcaaatgcaacttttttactgcatcattgtgtatttaataatggaggggatgcatttttgatatgttggttataatattgttcagagcctttaaaaatcaaagtgcaaaggtttgcaaatattcagcagtggccatggctgcaggagagaggcatctcttctactggggacctgggggagggggtttcacagtcaagggcaaggggttccccatcattgaccagccctccctactgttgtccagctcccaagcttttaggctcttaaattctcccacagagacactaccacccaatcactagggcagcctcatggaacaaagccacaagctctacattcctccgccttctgagggtccttgccttgtaggatgtgtctggatggagttcatttaccctgtgatgtttcttccctgtgtatccacagcttcatcagctggaaatgcagctggagcaagagtatgaagagaagcagatggtcctccatgagaagcaagatttggaaggcttgatcggaaccctctgtgaccaggtaagggggagacattggcagacattcagaggagtatctcagggacctatttgagagatgggctcatggagagaacagcctgagggataccctctcctccatcagctctgttcccaccatattcactggctcttcaaaggagaccttcaggtgcctgcaaacagcagggtttttgtaagaacccatggggaataaagagagtggggccagccaggagcaatggatgaggctgtctttgccttcagcagctgttgggatcagagtccaccagacagtccttcctttaaggggatgtatgtgaatggccactgcacacatgactgccctcctgagaacatgacttttgctagaagcagtcagccttggagccaggcaaatgtagctttaagctccagagggaccacttctgtctgcacggctttgagtgagctagttaacagctctgagcttctggagagtggagccttatggggttgtggctatcactgtacaccagggttctcgactgtccatcagtgtacaccagggtcctcaactgcatcactatgaacatttggagctggatcattccttgtggtagagggctgtcctgtacattgcgggatatcacgcagcatccctgacctctacccaccacattgcagtagcccacacctcagttgtgacgaccaaaaatttctacagacattgcccaatgtcctttggggaaaaaaaatcaacttccctcactactgagaactgttgctgtactaatgtagccagcagagctcagaggcagcttccgatttcagagttgcaaggaatgactcttccacctcctagatactctattcccttcctgtgctgctgctgcatgaaatcccaacacgggagagaaatgcctgtggcttctatgatttattttaaagtatcaaaggagtgtattttaatgtatttgcttaacatgggttcgatgtctattaattagtaatggtcttgttatcaatatccttccctaaattcattaactttattcacaaaacaatgtgggtgcacttcaggtgatcatcttgggcagccatgccttggacaaaataaatgcttattatgtattaaaaaacaaattgatttaatgagtgaattccacagcagggacacacgcggcaagagtaagagttggaagctgagggagtcaatataatcttccttcttctctgggttttctaattttccagccaaacaattgagaccattgaattcagagccattgaggtgactttccttcagcatcagggcaagagagcacagcccagtaccagattctagaatgatagaggggaatcactgcgagaaggttgcattctattcagcatagtctgagaaaacagaatagataatctagtaaagcaaggtttttatacaaattgcaaaaataaattttacatgtaaagagaaggtaagtttaaatgaataaaaagccatctttgtgttagtcaccaagttggatccttttaataaattagcacttttgatgattttaaatgtttttgttatgacctttgccaaacccatggaaaagcagaacaaataatgtaatcggtgtttatgaaccaagcactcagggttcacataaattaacattttgccatttcttattcagatgtttttaaggaaacaaaacgttttaagaacggttggtggcctctttatgtcgcttcctaatctcaatcctggctctgcttttctctttctttcctccctccccagatgaaaccattccccggggtttgaggtgtataattcccctgaatgtatatttcaacttcagccacatgcagcaatatgattctgcactttactttgtccccctctatgttatgtttttgagattagtctataatgatacatgcagttctaattaattcatttcatttctacacagcattcatttttttaaaatctcctacttctattggtgggtagttagttacttccaccctaaaaccccaaactgcagtgcatagtctcgtatctgcctcactgtgcacacgggcgagtgtctctccagggtatgtagctggaagaagaattgctggctcctgggaatgtacaatttgggaattattaaatatcgctcagattattccccaaagtgattgcagcagtttccatcgtcactagccgtgtctgaaattttacttcttcatgtccccaccaacatgtggcactgtcagacatttttaaacattttttccaggcatcgggtgctaaatggtattgcgtggccctccacagggatgctgtgcatttttcacatgttgattgtggctttttcttttcttttctttttttgagacggagtctcgctctgcctcccaggctggagtgcagtggtgtgatctgggctcactgcaagctccgcttcctgggttcatgccattttcctgcctcagcctcctgagtagctgggactacaggcgcccgccaccacgcctggctaatttttttgtgtgtatttttagtagagacacagtttcaccgtgttagccaggatggtttcgatctcgtgacctcgtgatccacccgccttggcctcccaaagtgctgggattacaggcgtgagccatcgtgcctggccgattgtggctttttcttatgtgaattgcctattcatagaagtttgtctcctttttctctattgatcattcatgatctttatacaagatgcgaatccatttttggttacgtattttgcaaatatctcctacactatggataattgtttcactttgtttataatgtccttagcttaataaaaaatatttttaatacagtcgtgttaatcaagcatgttttatggtttgcgcttttatatcttaagatactgttctttgagttcacaaaaatgtcatcatgtgtcttaaaagttctaaagtattgcttttgacatttttaggtctctaatccatctagattttattggggtgcatagtgtgaggtaggaatctatcttcctcaatatggataaactatgttttagttcataatttttttcctgcaattaccatgtatgcctgggtgtgtttatgaactcctcattgtggctcattgggtttttttttgtctatttctccaccatatggtcttcatggctgggttttgataactcgtaggacagcttaccttgactgtttttaaaattgcctgttttattgaccctttaatcttcttatttaggttctacaacaaaacctgatgtaatttttattggaattgcattgatttacaagttagttgggaacaattgactttttttatattgaactattatattattgcatatgccctctccatttatttgtggctttcagtaatgttttattatatttttctatacagatcttggacttttttgttagatttattttcaagaaacttgtagtttctatggctattatgaatagaatatttttctgtattctatctatatttcaactagttattgtggcatatgggaataccattgattatcatgcattaatcttgtatctagcaaacttcctgaacgtttattatctttcatacttcatctgtaggcttttttgtattttctgccttgacaatcttatcatttgaaaataagaatagttttgactcttttttttttttttttttttttttttttgagatggagtctcgctctgtcgcccaggatgaagtgcagcggcgcgatctcagctcactgcaagctccacctcctgggttcacgctattctcctgcctcagcctcccgagtaactgggactacaggcgcctgccaccatgcctggctaatttttttgtatttttcatagagatggggtttcactgtgttagccaggatggtctctgtctcctgacctcgtgatccacccacctcggcctcccaaagtgctgggattacaggcatgaaacaccgcgcccggccagttttgactcttgaccatggattggggcaacaaagatctcaacaaatttaaaaaaaaaaatgttatactttctacttcttgtttctttttcttaccttatttcatttgcctccagtataagattgaatggtagagaaagatatttgacatccttttcttgttcctgaccttaataggagtgcttgtaaagttttgtgatacacatatttgcagtgtctttgataattacagtgatggattgcttagtgacagggatactttctgagagatgcatcattagacaatttcatcattgtgggaacatcctagagtgcactcacacaaacctaaacgggatagccttctacatgcctaagctatctgatatagtctattgctcctgggctacagacctgtacagcatgttactgtactgaatttgggaggcaattgtgacacagtggtaagtatttgtgtacctaaacatatctcaacatagaaaaggtacagcaaaagtatggtattataagcttatgggaccaccgttgtatatacaatccatcattgatggaaatgtaatgtggcacgtgactgtaactttaataaggttaaatcagtcttgtatttgtaattttctaatatcttaaaaaaagatgttttattattgaatattatatgttttttctgcaattgttgataatctgatgacttgtctcaatctatcaatgtagtatattttagatacttaaggtatcctgatatatttcccagataaacctttcttagtcatatgttttcaatacacagctctttcggattgctaacagtttatttaggatttttgaaaccaggcacataagtaagattgttttataatttttttctcttagactgtctttgtcaagtgttgtactaatctcataaaatgaattcacaactatttctgagacaattttttgtaaaatttggatcatgcagttcttgcagattagatacaatttgcttgtaaccctatttgattactgtgtcaaaatgctgtaatcataattgaacacaaattcaggtattattcttttccttattgagtgaactttggtaactaatgtttctagacatttattatttcatctaatttttcaaataggttgacataaaaaatattcatggtattttctcgttatttaaaaaattctactgtatcagattattttctttttaatcataataatgtttacttttgagttattttgtggttgatgatgattagtcttgttagagttttgtctgtaatcccttcaaataacctgcttttgttttattgtttctttgttgtgtatttaatagtgtctgaccttatgtttgtttctttttccttcttttttccattggtttagatttttgttcttggtcttcagttttagtattaaaatgtttaactcaccttcaatattttttatcccacttaaactgttttctttaagataatacatttaagataatacatttacctggaattgctgttttagtgccatctactaagtgtcttgttgtatcttttgttctttttttcttttaacctgtaagttatctagaacttgagtttcaagtttattaacatttaggatgatttggagtaactttctattgttaatttttaatttaatggcatttaggacagataacatggtagaatgcataacatcttttctttgaaattgttgagatctctttgttgctctagttattggtagagtttaataaaggattgtgtgtggctgggcacagtggctcacgcctgtaatcccagcactttgggaggccaaggtgggcagatcatttgaggtcaggagttcgagaccagcctgaccaacatggtgaaaccctgtctctgctaaaaatataaaaattggccgggtgttgtggcgggcacctgtaatcccagctgctcagggggctgaggcatgagaatcactagaacccaggaggcagaggttgtagtgagccgagattgcgccactgcactccagcctgggtgacagagcgagaccttgtctcaaaaacaaaaaacaaaacaaacaaagaaacaaaaataaactactgagtagaaaataatgtaactgtttatgaggcacagggttcaatacatggcaaatgaatcaaccttgttaaatttttatttcaacattacatacgaatataaaagcataaaccataaaggaaaagttttaaaatacatgattatgtattttttaaaactacctcctgttaactttggttttgagttcttaatctgtttctaagagagtcctgttatatccttaccatgagaatggttataccaaagtttgttaacagttctgtcatagtttctctttatgtattttatggttatatatttaggtgcatctaagttttgtattgctttattttcttgaagatcattgcttcgattcttacttggtgtctttctttctccatgaataagttttgccttattttatttcgcttgatttattttagtcagtttacctgcaagactttttctatttcattttaaagctttgtaggggtgtgtgtgtgtgtgtgtgtgtgtgtgtgtgtgtgtatgcatgttcatgtgttttctttaaacagctggataattttaatgcaatattttagtctctagcttttcatataaaaatttaatttatttacatttgttataatgactgatatatttgaaactattttgtgttttgttagtttcttgtccctttacattgctctccctctattgctttcctacttttggatagattgatgttttctatgttctcttttgacctattgattcagaagctataaactctatttctgttcttttggtggttactcatacatttccagatatatgcttaatcataattttttactaacattaattttcacagtaatgctgtgggatagatattattatttccttcatataaatgaaagaagtgaggctcggaaaagtaaagtaaagcaacttgcccaggattgcatagcaagttagtaccctaggcggattctaaatgaggtctatattatttgaatatctgtcattttaaaaacctattatgattctgcttaaaagcgataaggtccacttagctagaaccatatttttgtgcaccatctttttttcatagtgttctcaggcagccagttctgccattaatttgtgaagccctcagcaacacgcattctgtctccaagcctcaatttccccatctgtaaagtggtttggttatccctaacggcacttctagaccatattttaatagtgtttggagattcctttgacaatggacatttgacaagctccccaaacaatttgcctttatgataaatggtgaaccaactaaggttggaatatagttactcacaacaacactaaacatcatgtagatttattagttaattattcaccatctttatcaaagtttgaatctttgtgctttaaaagggaaactcgcagaatgacatttatttcccattaacctaatgagtgatattttttgccctcctctctgtagcaatttgttataaatgggaggatgactggtctgagattttcttgtgaattctgtttgcagtgcttcctctggaaaggagttagtgccagcattttcagggcctttcaggcagtgaagatcgtagaatctgagccatctctactgcatggtcagtgtcaacatcagggaatgtccctgatgctaactcgccccacaggagaattaaaggcactttaggatatatgcaaaacaaaaacagacacaaatataagaaatgtgcaaagcccactgcctaagcatactcatgagtctgggttctagagtaagtaaatctgagtttatgaagcagctccactaggcactgtggtgcagtagttacagacttacatcctaatgctgagctgtctggattcagatctctgcacagccacttagtagcaatatgacattgggcagatcatttgctctttcatatcagttgttcctccatgtaagagccctggataacctctttcactttgtaacctgcccctcaactcggggttttataccctcatggcaaccaccccgaaatgcatagcccagattatttcttgcctctccgcctttgctcattaagtgctttctacctaaaatgctcttcctccacctcccctagctaggagtagctacctcctacttcccaattccatcccagcctgagctgggtaatgctcttctgtgcccccataatatatattttttcagaattaaagactaaaacacacctatctaatgttatattttactaaaattaccactttccagccagaaaagctggattcatattccaactctgccacttactagctgtgtgatctgaggcaaattacttcatctttgcatacttcagtttcattatctgtaaaatgggaatcataatactatacacctcattgattcatcatgatgactaaatgcatcaatagctataaagtgtttagaatagtatatgacacttaaaactgtctataaatgtaagctattactacatttgtaaaggcaataataataaggtctatttaaggagattgtcacaggagttaaatgcaataacgtgacaaagagcctggcacaatgcccagcccttaactcagttcagcaggtgagattgtgtgtgtgtatgtgtgtgtgtgtgtgtgtgtgtgtgtgtgtataatagaacagcattttgaacctaccaaaacaatacatttcagatataaagaccgtattctgagaaccaactcgtttttcaaagaactcaaaaccagcagtagagaaatagaaatacaaaatctagaggaacacattcgaggtcttcagacaatactcataatcctttatatttgcaaagcactcaacagcttacaaagtgctttggaatccattatcacatctgatccttgtcttatctcaacacgaaggatagggtgttttttttaacctctctttttgtggatgagaaaactcaggttcagagatgtggcgtgactcagccactgctccatcatcagcaaatggtgagccagggtttaaagcctagatctgctcattctcaaccccatgttttttctagaatattccaggacattctgagcatcccaggaaatggttagcatttcatgtggagacacagatttccaggtgtgtaaaaaccacatcccagtgttgaggcatctgcaccctgttttccttgaaactccccatctgatggacaggcccgtattgtatcgtctggtctcctgaagagtccaagaagggagttgttagtt

SEQ ID NO: 471 - DNA, 10005 bp, Homo sapiens
gtgggatactcattgctttgaatacctacggggaaatcaattgtcatggttaaaattttgaaactagcttacatcctcaaacatatttttaatgtttcaaacgaattcttgttttaaatagcaatgagcagtacattttcagtattaatatggtatacttacaacttttattgtgtcaagtagatgaggagttatggctaactttcagtctttcctttctagagtcatgcctcctctaggaaacactcatggggcacattccctactcccacctagagggtacattaagtgcctctcctctaagctcctacagcataatctgtatgtctctaacataaccatctgtggtatgtgttatgatgtcagtcagtagaatgaatgttagttccctgaatcagaaaacatgtcacatgtaaacacattacccttgcattataggagttagcattgcgatggcacacggtagacatttaataaataatttcttgaattctgcttttgattatgacagattaactttgggagaataatgatttaaaaaaatagttgaaacattcaagaactactgacgcaggcatcttggaagggctaacatctcagaggaaagtaagaacaaagttaagtgaccagaagtcacttttcccctgagggatttgcgacttcttaccaaagggaggaaggctaagcatcttgaagagaaccacagctcagaaaagagatgttggcagtcttttgaaaccagagagacacagagttttggaaatgtaggaggccattaacctagagcaaaataaagtacagaagagtgagattaattcttaaagtgcatatgacaaaaacctaaagatctaaacagaaaaccctatggtccaggaaaaacaaaaactggagtgactaaataagaaagagccctagtacacacctcagtgtacggctgaagcttctggagggctacactctacaagtagggcaaatgaggggtaaatagccaacctagccttgagtcaactcagccctggatttaaatgacagtgatcagtcctcactgttatctatgtaccaaacgatagaatgcactttctgtgaataataagtcaaccacagtttctacaaattttttataaaatgcctgggtttttatttttaaaagtccaagcctgcaagaaaaataaacctaaaaaaattgaaagagatacatacataatctcgtaagtgtggttatcaaaaataaattttagaataactatgattgatatgttcaaaaatatgtaagaagaatgtaaacttcattaaaagctggaatttgttaaaaataaaaaattaaatttactaagtacatttagtaaaacatatttagcaaaaaaaataactagctaatgtggaaggagggagtgggattttaaaaacacattattaaaatgtattaattaaaattattataaataggtggtagagggtaggaaacaaagaaacaaatggtaagatggtaaatataaatgtcaacatgagaaattatattaaatgtaaatggactaaaattccaattaaaagacaaaagttatggaagataaatgccttaaatataagagcacagatagataagtgtaaagttaaagactagaaaaagttatacaaagcaaacactaaccaaaagaaagctggtacatatatatattatatatatatatgaaatatatatataccaatattagaaatattacactttaaggcaagatgcattactaaacttaaagaacatttcatagcaaggaaatggtcaatctttcaacaagattttaaaatacaattttaaatatataaagcaaaattgatagaactaaaagtaaaataaataaatcactataatctcattattctactctcatgaaaacttgactaccaatagaagtggccaatgaataaatccatattataggtaagttatttatgctatccaatggattggctcacacagttgcttgcatttaataggtcaaagcagtaactttctctcctggaaacccagacagagatcaatagatataaatgtaagttttcttaagaatgaggaataaaggtgacaggactttacattttcttaacctcatcccacatataccacaaactattgtaaataaagtcaaaacacataaggaacatccaaacaatcttattttaaaaaattgaagagggtattatcaacaagtattatagggtcaatttctaagcatgagatgaaaggtcctcataaatggtctcataatattttgtcattttcattctaatactttgtcacttttactggtttacttatctgtttcctctcttagaccataaaatatttaagggaagacaacatctttgaattcaccttttaatattcagtgtttttatacataagggggaatatatgttaactaatgagtttaaattggtaataaaataatttcttattcccagctacaatttgtataatttacaaattattaatatgtgttcctgctcttccctgtgctatccaaacagtacagattttcttaaatattgtttttgaatcaacatatactgttatcttttattcctttctaagcaatgtgaacaaggaactaaattctggtagttttatatgatcattaattaaaatgtagttaaaatatattttatatttccccaaagaaaggtttcacatacttttcataaatatatattttattagatcattaattaaaatatagttaaaatatattttttatatttccccaaagaaagatttcacatacttttcataaagagatacttaaaacatatgtttaacgtgatcaaggatctctgatcagggaacagagatatagctaattttatttagggattaaataaatgctaatttctttcatatttagttgaataattttagctttgtgaactaataattaaatatttaactttcccatgttaaaatctgctaacatttacaaataacattgtgttttaacaaatcttaaatgaagacatttatgatgtatttaaaagtatcatttattgctgacatcttttacaatggaagcagatttaaatgtactaaggctacagcattcattataatatgaagttacagtgtcataaccaaatggaatataatttgtgctcagcattcactcataagcaagaaataggttagttctgaaacgcctagcatatctgaacaaattctagctaatggcatgcaaataataaagtagcaattaccaaataatacacaatatgtatgtattttcacctaaaatattttaatatttttgaataaaaatttaagccttcttttaaaaaaattatgagatgcaaacattgaattattttaaaaaatgtttacagaatccctattaagtacccaacacagagttaaagactcttaaaaagtgtttgaagaaatgaaagcaagcacactcctcagtacacatagcatatgtgcacatactagaatgtaaattgttagcccgatttgctcaaccccgtgcactgcagcttaagagttgttcaatacatactcattacattgcttggctcaatacactaatctatcaattggtatccctttgcctgctctgttctggaattttttctttacaactttttattgcactaggttttccccgagtttaacaggagtttggattaaccttgatgcaatttttaaggaagtaaataattgaaccacatttttgtgaatttcagcacaacagatggtatatttttagaagtatggcattgaaacgagactcttggggttgagtcttgacttccatcattctcatgatgtatagaattgaacaagtcctttaacatttctatgcctcagtctccttaataaggtgggattaataaaatatatttcatagagatgctttgaggatttaatgagctaattatatgtggaaagtgctttaggaaactgcctgcccatatagcaaatgttatctacttctcatttcacctagtgttcaaattccatgagacagaatgtatctaaactcatagtgtccaagacggaatccactagccacatttgattaagttcaaattaaaattaaaattaaataaaattaaaaatgcaaagacctcagtagcactaattatatttcaagtgctcaataactacatgtggctagtggataatacatcgaacacatccatcactgcaaaaattaaaatttcaaacatataatgcaatagatataaataatctcatgagcatagttaatgggaaataaataatttagaggcagtgagtttgtagtatttgttatagttatttttaatatgatttttatgactacatgttcatatactttaatttttcaaaattactgtgtttcacaacctgtttacaaaattcctaaaaatttaatcagcactagagctggtcctggctggcttcagcacactattgcacctcggcaatacatgagggctcattcaatgtttttttagccactaatattcttctaccatcaaccctaaattctgaaatacataagttacactttccaacttaatagagatctgaaggcataagtggccctctatccctttaaaacatcagcaactaactcttttttaactgaaatacaagtaatggattatttcatatatacacaatatacttccatgaatgtagcctgattatgacaaaatgagggcaaatggataaaaagccaaataaatagctccaaaaatattttgtgggtgaatggggggtagtgatttgtatttaagtatattatgaaactatgaaaattgaaatcaattataaatctagagttggcattatatgaaaaatgtaaattaaaataactaatattgtaacactttaaactgccaatgaatagattgtgtaagttaaaaaaaagagggttaacttaattttgttaaatttaaaaataaaagtttacaaaagttagttaaaacaaattacaaaatttaaaatgtccataaatacgaagaatatttttcaaaaataatatttttcattccttttattaaactacatcagtcttcagagaagtgcaacataaaattacaaacaaattatacataaaagatattattaggtccagttacttacagtatcaaattcctaagagattttttcttagaatatagttccctattgtttcataatgtaacaaaaatattataaaataatttggctctttcggtgagaaagacccctctttttttcgttaaagcaaatgtcagttgtccatcaactgactaatattctatgatttaatttttaagttgaagggtcaactgccgaaacaatgtaataaatgaaataaacttgttaatatcagaagagagtgactgaagtatttaaagatgaatgaaaagtatacttaatatgtatttccccacaataataaggtggccaatatttattgaaatatatcctatgtgccaggctttatgttaaatctctatcatttagtcttcaaccctcctttatggaggtacaattatcagatccatttcctaggtaagaaacctgtggtcaggttcacatacaaaagattttatcttaaggctacttgactccaaagcctgaactctttttttttttaaattatactttaagttttaaggtacatgtgcacaacgtgcaggtttgttacatatgtatacatgtgccatgttggtgtgctgcacccattaactcgtcatctagcattaggtatatctcctaatgctatccctccccgctccccccaaccaacaacagtccccggtgtgtggtgttccccttcctgtgtccatgtgttctcattgttcaattcccacctatgagtgagaacatgcagtgtttggtttttttgtccttgcgatagtttgctgaaaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttccagttctagatccctgaggaatcgccacaccgacttccacaatggttgaactagtttacagtcccaccaacagtgtaaaagtgttcctatttgtccacatcttctccagcacctgttgtttcctgactttttaatgatcgccattctaactggtgtgagatggtatctcattgtggttttgatttgcatttctctgatggccagtgatgatgagcattttttcatgtgttttttggccgcataaatgtcttcttttgagaagtgtctgttcatatccttcgcccactttttgatgggttttttttcttgtaaatttgttttttaacgattacattttcacagtaatcgctaaaaaattcactatatttctctaatttttcaataagaaatgtataactgaaaaaattatatgaatttgtcattcctaacccacttagaatatgttatattttaatatattaaattcatacattctgataaaatagattttgatatattctagccactctactaacaaaaatagctggttattataattaataaattaactttacaaaccaagaattgttcatgaagcatttaaaaaacactgaactacatcatctggtttcccaccatgctatcctgccacccgagaactaaggtagttggtgcattaagagaactgcctccctattatcaacatcctctccatagtggtacatttgagtacatttattacaactggtgcaccttcaatgggtttgcacaaatttattatgaaaatagcatcataggactacagcatcatacacaatagtttctttcactgtcctaaaaatcttcttaatctccatatgcatccctctctcaccttctccccagcaatcactggtctttttagtgcctccatagttttgccttttctagaatgccatacagttgaaatcatacaatatacagccttttcagattggcttctttcatttagtaacatatatttaagttttctctgtgtctctccatggcttgatagctcctctctttttaatcctgaataatattgcaatatctgtatgtaccatagtttatttatgcatccacttactgaaggatatctcaaaaattttggtgattatgaataaagctgctataaatatccatgtgcaggtttgcatgttaacgtaagttttcaactctttggggtaaattgccagatcatatgataagagtatgtttaattttgcaagatactgtcaaactgtcttccaaattggctgtaccattttgcatttccaccagggaagaataaagttcctatttctcctaatcctgtcagcatttggtgatatcagtgttctgcattttggctgtttggtctcctctgaatgtttgtgtctacgcccccatttcattcaattcgtatgttgaaaactaaccacaaatgttagaaaggtggggtttttaaaaagtcattaggtcatgacttaggaggtgattaggtcatgaggagccctcctcaattagattagttcccttaaaaacaaccccaggagaaataccttgcccctgtcacatgtaagacaggcacagtaaaaagcctttacctatgaccagaaagcagcttatgagcatatattttttttattatactttaagttttagggtacatgtgcacattgtgcaggtcagttacatacgtatacatgtgccgtgctggtgcgctgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgggaattcccagcatccagaaccaagagaaataatttttgttgtttataagccatccagtttatggtattttgttgtagcaaactgagcagactaagcattctaatagtatagtggtatcccgttgttgtttcatgttgcatttccctgatgatacatatgaggcatctattcagatgcttattttccatctgtatatctttcttggtgagatatctgctaaggtctttgtatcattttttaaatgggttgttttcatattgttgggttgtaagagacttttggacattttgcataacagttctttatgaagtatgtcttttgcaaatattttctcccagcctgtggcttgtcttttcattttctttcaagacagtttcctgcagagtagaagttttaattttgtttctgtgtttgttttgagatgagagtctcactatgctccccaggctggtctcaaactcctgcattcaagcaaacctccctcagccttctgagtagccaggactacaggtacatgccaccacacccagctcagaattttttatatttgatgaagtctatcttatcaataatttattttataaatcttgcctttgattttgtacctaaaaagtcattgtctaaccgaaggtcatctacatggtctcccatgttatcttcaaagagttctgtagttttgtattttacattgaggtttatgatccatctttaattaatttttaatgggtgtaaggtttgtttctagattcacttttttacatatggaagtagggtggtataaatatcattcgttgaaaggactatcccttctccattatattgcctttgctcttttgtcaaagataagttggctatatttacgtgtgtctatttctgggctctctattctgttccagtgatctattgtctattattttaacaatatcacactgtcttgattactgcagctttacagtaagtcttaaaatcaggtagtccgagtcctccaactttgttgttctatattatgttggttaatcttttgcctctctatataaactttagaatcagtttgtcaatatctataaaatagtttcctgagattttgatttgggattgtactgaatctatagatctaattgggaagacctgacatcttgaaaatactaagtcttctatttggaaacccggaatatgtctctatttatttagctttttttatttatttcatcacagtttcatagtttttctcatatacatattatacctatttcattagatttatatctaagtatttcgtttttaaggatgcaaatgtaaatggtatacttttaatttcaaattctaatcatttattgctattgtaaaggaaagtggctgacttttgtttattaatcttatatccttttttgccaaaattgtgtattagttccaggagtttttctgttgattctttggaattttctacatagacaattctgccacctgctaacaaagacagttttatttcttccttctctgtatacatttcctttccttttcttgtcttataaattgcatttgtattctttttaaggtgttcccttccctacaaatattgtatcacttggactattttaagattattttaataggcactcaacaagattttgatgaatttcaaaattcctggccttcagtgatatgcttaaacaaagtagtaaaagtcaccaaggaaaacagttctaccttagtgataatgaagaattatctgcaagtgaatatccttttttaaattttactttttaatatttttactttgtaagtacatggtatatatttttttaattttactttttaaattttttaatattgtgggtacatagtacattcttgaggaacatttttaatattaattttcttgtgtattcatcctgtgatttctcatctttcattcatctagaaa

SEQ ID NO: 472 - DNA, 10091 bp, Homo sapiens
atgccagagaaaccagttttaaggtcttcatacaaggttccaaatggtctattctaaaagttacttgtgctagttttaggttagagggtttaaacaaaatcagagtattagcttttgttttgctcaacaaaaagggaaagagaggcaggcagaaagtcaggcaggctggaatgcctattggaaactcctggatctgcaggtttcccctgaaatctgggtgataaactaactcctgttgttttccgttgatcctagagatggtctcgaggactagaacaaaaggtccaaagcagtttttgcatagacttgaagtggtaattatgcttttgagagagaagcacaataggctcaggctgtgggcttgcccacgtggtgtgagagggacaagagcacaggctccctttgtagtccattcctattgctctacttagagcaggtgctccgggaggccctgaaggaaataagcacttggctaaagcctggccagggtaaccacacttatttttcaaactgagaacccataccaatcatcttttctaattttgggagtgcagacacgtatgaagctttttgtgaaaatgatcctgtttataatactgcatttttttcagagtcattggtgtagttaactgattcaatcaacaagaatttattgagaaggagtctcactcatttactccacaaacatctactaaagttcttctaggtataggttctgtgctgagtgtttaagagatacagacacaaacatgattcctactctaccagaaacttaacagtctagaaggtgagacagactctgaagcagctacccaaatgcactgtggaaaagtgcatagttccaggcttggacaaacatatgcacttagggatcccagaggaaagggtaataaactgcctggggactagggagggcttcgctgaagagctgatggctgggagagtcaatagagtttccatcaaagaaagaaacagcagaaccacaggtgtgtgggtgggggatcttacctaagttttggggctgagggagtggtcggggaagagaccagtgtattaagaccttgtgggccatgctgtggggtgtgaagtttatctgtcaacagggcctcggggttgttttcggcatgactgctacagaatcatatcttgtttcagaaaggctggcatgcagtgcagaggaaagatttaggagtagattatagacacagggaagttgggaggaggtaagggttgctgagcaaaggcagtggcagagagagagaggcaagagatgggtgagcgaattcaggggaggtgcccctaagtgatgacagattctctatgggcatgagggaaagggagggaatgggacaaggtcaggtgctctggctgtggtggataggtgggcaatggtgccattagccgagatagcctgggatcttctcatcactcatccttttaaagtctgtttcccagtcctggccacatgttagcatcattaaagcttcaaacacatacccatatttgggccccatcccctactaatcgggctctatgaagatgaggctcaggtgttgatgtttataaaggctcatgcagccggggttgagaactactgacgtgatcccctaggcagagatcattcctccctgctctgcatatgcctttgtcttccagacctctgttattgctctcccatgagtatttatttatttatttatttatttatgagacggagtctcgctctgccacccaggctggagtgcaatggcaccatcttggctcactgcaacctccacctcctgtgttcaagagatttttctgcctcagcctcccaagtagctgggactacaggtgcgcaccaccacgcctggctaattttcgtgtttttagtagagatggggtttcgccatattggccaggctggtctcaaactcctgacctcgtgacctgcccagtttggcctcccaaagtgctgggattataggcatgagccactgcgtccggcctcccatgagtatttattagcagtggagctcaccaagaacaatgacaagaatggacatttccagggaaactggctggacctgatcttggccttcaggaattcttttgtaaaaccgtcatatcaccaggcccacagaggacaacattttacaggcatttcagtcaattacacagtgataattcactgaacaaatcctttgggatcacagctgctttattgagatcaggtctgtgcacaaagaggaggcccagggaaaacacagtggggctgtgtcaggtggcgtccagagggcatggtgcagctgtgggcctggcttggggcaggacatttctgggattacagggccctgccccaagcttctccgttgagggggtagggagggcaatgcagagagtgagagggtgccagggcaggctataagctaatttgcctcttgagaagtagggtaataataaggttggagcagagaggaaatctttgtcctaaggcagtgcttctcaaacttttgtgggcccaggaatcaccttgttaaaatgtggattttgactgagcaagtgggatctggaatactgtgtttctaacaagtgctgatgtgacgccaatgcatctggcccaaggaatacgcttagaatagcaggatcccagaatgcatctctatttttctatatgacttttagatcagttgtgtatttagagaacataaagtttttaaaaagctctttaaaattttatccttttcaagattgtctcggaaaactttgcattatttgaaaagatacttcgaaaatggaaactgaatgaatagcactggagtgcagtggcgaggtctcagctcactgcaacctctacctcccaggctcaagccatcctcccacctcagcctcccaagtagctgggaccacagcacgtgccatcacacctggttaattttttgtatttttggtagagatgaggttttgccgtgttgctcaggctggtctcgaacttctcagctcaggcaacccacccgccttggccttccgagtgctgggattataggtataagctacctaccgcacctggcaagaacatataaactagtctactatgttctaattataaaacttttttttaaattttttttccttcctgggaatttgagggatcaggattgaccttttttactggggaaatcacctgtgatttctggaaaggtggggagggctgctggtcccttaatgtcccttctaaccagcttgtcaatgcttagtattcctttgacagtgggcaggtctttcattttgcaacaaaggtttgcctgaggcactagctcacagacttcattcatactaaggtgtgaatgacagcagaggagcttaggctttgttggggtgatagagagagaaagagaaaggaagaaagagaaagacagctgaagacaaatgaggatgctggttagccagaggaggtgtatatggtggcacagaattattaaggggaatgagagtggtggaggagcaattaaatatatctacctctaacttcccaatttttcgacttttctctttttttcttctgccctgtcatcagcacgttggttgctctctcctcctccactctgtcatcctcttgctattctttcccttcggccctctaacagttcagtttcaggtgtaaaatattttggttcaggagggactggatatcaactagacctaagattttgtgatttacattccccgtcctaagaaaaggaattatgttgagtgaacaatgaccaaagctggacagttccccctggtggtcagcactgcgacaacacgattttcctctatcttttattcattaattggtgaatttgaaaataatctgttaagccccaaacatgacagacattgtgctaaggacagacatgacacctgtccctgtggggcagaaagtctgaagagggagtgtgttactaaacattgtagagcatttagcattttcaaaagccttaaaaaataagccagaaaacttgaaaggaaaaaggcttttaccatttttaaagaaaagcaggtagaaaggttttgtttctgacattttttgtaccactaagtcttcaatttgggtttagttcttcaattttcatcgtaaaatttccccaaataattttttcttataaagtgtgagtatcaaatcagatcatgtgtagtataatttttaactccgaatgtgtaacattcacagtccctttattagcaaaattatagtaattaaataatactggctttataattgaatagcactttgcaaaataatatgtctggctcatctatattgctatagaatactactgccccagtgctgtatgcatatgaactggttaatcctcacaacagcccttataaggttcaggttatcctcattatccacatttttagatgaagaaactgaggctcagagagataagcaatttgtaaccctagccttaaccactttgccataacaagacagaagaatgcctgcagtaagtgtaaatgaacttactgtatcctcactgcagacagaggactaaaaagagtaatggggtttgcaatctttctgggtgtgtgtgtatgagaatgaagttatcacttgcctccagtgatcaggttgttaagagcacctcagaggccactgttgtcctacccttcctgtaagtggtagagatggctaatgagcatctgttggttaactgattgatgatttctcaaggctttttacagccttagaattctattagtcactctacaagaaacaggttgtatggaacgaaaggtaatttatcttttaagaattaagtgaaatcctttaaactcttgtttttgtgcctaaagctatattctgatggaaatgctctttctctagctatgtcagtggtacagtaatttaatctggttcttgaaattactctttatctcatacatttatttaagtaaagatagccacattagatatggagatgctatgaacaatgcaacagaatcatggaatgtttgtaaagctgctgcagtgattacaatgaaaatattgatcatttccttataacacacacacacacacacacacactatatgacccccatctaaaatctttgaaatatatccagtatctctgggtctggcactgaacctggcctggcatagcacagatgctcaataagtgacaaattgagtgaaaaccaatattagattaaaatattaaaggccaatatgcccatttctactctgtatagctgttccagtcaaagtattttggaaggatgagtgagaattacagtagggaaaaataatttgttccactgaaaaaagaattcttggcctggaacattttctgaaagttaagtttaacttttaaaaatcagaattttaaaataatgcgacttaatttgggctgaagtttatttttgagttatctgtaaatagatggtaaggaaatgaataaattaataattataagatgttactcagtctaagagaaagaggcttgtacaggtcttgagcacattgtagccaaataattatgtttaatataaatattactcatatcttttaattaaggaaaacaattaagtttaagcatattactatattgtttaatataaattaaacattaatattaaaaatattgcttaaaataaatatttagcaaattatattagtataatatagtaattatattgttatatactaatataatttgctaaatatagtaatatttctaattaatattagtaatatttctaattgaaaacatttttaggagttcatctgtgcctgcatatagtaatatattttttatttttatatttttgccattcttattcaaaatagtaatgaagttgtacttgtttttaaagctagtacttaaaaatggcagacagctttccccctagttggtgcaaaattgtagattttcatggtatgttgtttaaatggaatttgcactgctgcagtgctaatgaaattccttattaaggagagagatgagtgccttttatgttcaagagaaatgttcaatggccattaaaatactttgactatttgattttttttccctcgaggtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggtacatcccaaaacttctagaactgtgacctgatttggctttaaatatttgttttgctgtcttttgtgatcgtgtatgtgttgtgtgtgtgtgtatatgtgtggtgagatttgccctagagaggatctcagctatggaaacttgatggccaccattgagcttagttcttcctatccattctggagaatgttgggaacacttaataatttagctctcaatgaaaaacaggacattaaaaatgaatctacattttagaagcatatttataataaaaattatgatgttaggacaccatttctcaaaatatgtgctgcagaacatgtgtcccatataattatccaacaaaagaataagttggggaatgccgtatactaaattaatgttaaataaaggctcccaagaagtcctgcaataaggaaacttgttaaacttagttaacccagtttttcccaactcattggctattgtgtcttgtctttgtgggtatgtgtatgtaaaacacttatccctatcttgtggaatagtgttctgtggagcatgctttaggaaatgctgagttactctattatggtagttttcagtttttttttttttaagacggcatctcactctgtcacccaggctggagtgcagtggcattatcttggctcactgcaacctccgcctcctgggtccaagcgattctcctgcctcagcctctcaagtaactgggattacagccacccaccaccacacccagctattattattattattattattattattattattattctatttttagtagagatggggttttgccatgttggccaggctggtctcaaactcccgaccttaggtaatctgaccctctcggcctccccaagtgctgggattacaggcgtaagccaccatgcctagcctattggtagcttaaagttttattttaaatttttaaatagagatgggatctcactatgttggtcaggctggtctcaaattcctggtctcaagtgatcctcctgcctcggcctcccaaagtgctgggattacaagcgtgagccaccgtatccagcctggtattatggtagttttaaatgtttgccatcagctcttctgcattcttaggcagatgaactaaaggaggacatacacttacatctgtttctaaacttgttttcccttcttatcctcaagtttagtagatatatggatgtctcctgccacatatttcccacagtatcttgaaatggtgatgcatcttgctgattttgtttaaaaggttttctttattttgagacagagtcttgctctgttgcccaggttggagtgcagtggcatggtctcggctcactgcaacctccgcttcctaggttcaagtaattctcctgcctcagcctcccgagtagctgggattacaggtgcctgccaccacgcctggctaattttttgtgtttatagtagagatggggtttcaccatgttggccaggctggtctcgaactcctgaccttgtgatctgtctgcctcggcctcccaaagtgctgggattagaggtgtgagccaccacacctggcctaaaagtatttttaactagaaaatatttcaaaaatcacaaaaattaaatagtgcattacagacaggtggttcagtttagaatgtatgtttcccttctgtctttcacatgagcaacattttataatttctaatagcatttattttatttttaaaaatttaaattttgcctgttacacagccctcaggaggtcctgagaacatgtgcctctcaaatagcattttaaaatctatgtgttgcttgacttgcagcaaagattaatgccattctgattttctactaatttatttctattaaaaatagtgatattatacatgacatcgctaatatcaactgggtttcctatactatagtaatgtgagtcaggatttttctttattttggactatctgtttagaagtctatgtttgggtccagttatctttttctactgataaaagtaatgataggtagtgctgtcctgtgcagccccttcagacctgaaggatgtatttccccagcaggtgggaattgccgccgctgaagatagctgcctttcctgaggtcatgcctccttcctggaatctatgcaggggtgtataggcccctttgcatcaacttgggctaacgctgtaggtcagcccagcttcagctctccagggcatggacagaagccttcattctgactacattgcatcccagcttctctctctgcccatttagcttcatttcctgcctcactcccccatgaatgttgaactcaacggcactctccagtaaactttctgcacacagatctccatctcagagtttatttcttggggaacctgacctataacactaggtatatatatattatgtgtgactgaaatgtgggtcaagtggcatggagactgtgtttatacttattttcctattcacagggcatgccaggttcatgcaattttagtggacaattaaaaattactttacaaagtatctcttgctttagtagcatttactagttgatgtgcacctggtggcagtttcaaaatgttttcttccatttagtaattatctgttgccagatactgctccacatgcagggacacagcagtgtgaacagagagacaaagtccctgtcctcatggagcatagtttctagtgggggtaaacgaaaaatagttagtagataaataaataaataaatatgatttcaactaataacaaattccaagaaggtaataaaatagggtaacgggatagagagtgactggagggctttatcaggggtagtcctggaggacctccaggaggatgtgacatttgagctgagacaaaaatgatgaagagcagatggtttactattaggttgctgcaaaagtaatcacggtttttgccattagttttgcagcaacctaatagtttgtaagatggcttgtttcaattagataattttgggtgcattataaatcttaagggggccaatggctagatacatgatacagccatatattcaggtagagggataattgatcatatgtctagtcagatctgtaaattttttttcagtatacatattctgtatacattttataaaaactacgtttgacttagaagacagttttggtgctcttgaagacttgaccctggcggggaggatttgaggggctctgttgttcaaaaggagagcagagcgcctcacttggaagctactgtaggagggtagagggctgtgtctgtgtccaaagggtgaggtttgtgcagtctgtgccacatgtataaaataggactgaagaggtgtgagtgctgtgttgcatttgttaatgctgcctgtgttttgcttttgcataacaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgta

SEQ ID NO: 473 - DNA, 10532 bp, Homo sapiens
tgggggttattcatttattgtaatgtttatagaccttacctttaaacctttaggaccagataaggtgtttttttgagtcagcttcatataattgattaaatgtgttgatatttgtaacattttaaattatccttttgaaattttctattttttctttttttgaatttttaaatttagaatgtgtaatatagtcgcatggctcaaaactgaacaagatatagtgggaaacaatgaaaagttttaccttaattttgtattaatatcaagggcatttccttcagagaggagttctttttttttttttttttttttgagacagagtcttgctctgtcgcccaggctggagtgcagtggctcaatcttggctcactgcaatctcagccttccgggttcacaccattctcctgcctcagcctccggagtagctgggactacaggcacccgccaccacgcccggctaattttttgtgtttttagtagagatggggtttcaccatgttagcctcgatctcctgacctcgtgatctgcccacctcagcctcccaaagtgctgggattacaggcgtgagccaccgcgcccagcactatttttgttttttaccttgggagcatgatttgtgggggcgcaccataaatcatgcaccagatttgcggttcactgaccttccaaaaatggaaacccaggctggaattctgtgtgagggctagctttaggaccacctgtactaaggggtgcattttcctccttcgttttctttctttctttgcttagtattacaaatgaagttctgttacttattctggattccattctagtaatttaggtttttcatgaaaattgttctagatttgtatacttactggaaaacttgttctagtattttctaatgattaaaatacatatattatatccaccagaagctgacatttggatttctgttttcagcctatctttcttgtagtctgctttatcatgatgaatggatccaccattcacctctttgctcccaggccatatccctacgagagatctttaattcctgtttttatcttgcaactccacagacacttatcaacaggtcctgtcatttttaccttcagaatatattttaaatttgactcttcatcacctctgttattacttatcaagccaccatcagctttggctggattattttcaataatttttgatttggttcctctatgtctactcttcacgtaaaatagtagttttttcattttagctgcctggttgttccatttttgcttcataatatttgtctattttagtatattctgtatatttatagtccttttgaattggttcccatatttgcattttgctaggatagtgtcccctccctccctcccttccttccttttttccttccttccttcctctctctttcctttctgtcctttctttccttcctttctttccctccctccctccctcccttccttcctttctttcctttggtgcgatttcagctcactgcaacctccgcctcctgggttcaagcgattcttttgcctcagcctcctgaatagctgggactacaggtgcgtgccaccatgcccaactaatttttgcatttttagtagaggcggggtttcaccacgttggctaggatagtctcgatcagttgacctcgtgatctgcccgcctcagcctcctaaagtgctgggattacaggcgtgagtcactgcgcctggccagataatgtttatttctgattgttcacttcattgactctgtttttgaaggttagattttgaagggtgtgtcttgatgggaatgttttaccatcctctatttctaccctggtgttcgtttatcgcttttaagctattttgaggttcctggtactttttggtacctcagtctggagctagatcttctttccagcctgaggcatcttgtccctccctgatatttggcagaaatcagattgaatcttgagatgagcagctttacccagatcctatctgtggtgtgttaaaaaatttcttctgtgtctccagaccatagtcataatctgtttttggtttcttttttaagagtatgagagcccttctgtagtccccagtttcattttctgagtttggattctttcccctgctaagcataaaaatacatttactcctaactgtcagtagttgaacatctgccacctctgtatatgttgggcacaaagatagagtaagtttttaaaaaggcttgctttccctccctccctccttctgcccttattttctcccctctgtcttcctctccttcctccatctagttgtttataaacctttgttatttatctatcattgtcttttctttttttacagataattaggaatttctagtgctttatctaaaacttggtgtttatgtttggaaataatgaatgtatggtgtttctgttggcatactttatttagatatatatttagttctttgcaaaagtaattaaaattaattttataatatatttaaaacacctaattttaaaatcctttcacaatgaaaaatatttagagaatgatcaggaggaaaagatcagctttcaagaactttaggtaaatttcaccacagtcaagagaattgaacacgatctgagtctcaaactctgaaaaacttttttgatgtctttgaagcactgtcctttcttcttgaaatgtatctgtgtatttgcacttcaaacagagaaaacagggaaataagtaaatgtctataatttgttgtgattaatgttgaagtaaatgagttcatttttgttcagctaatgtattactttattgtacaataatttaataactacattttttatacatatcttctagtttatttgcttcagattcttaacttttacaccaagaggccatgatgtttttaagtttttgaaagaaaaaatctgtgactggtataaaagttattgtttgtgttaaaattattttaagtaagtgaaaaaattaaaactatttttctctgtcattttgtagaataattaaatataacagatgttttgttacatgtagtatttattatgtttgattattgatataagcactctaattttagacctttgaagacaatttaattgaagcaaggaaagaagttgaagtatcacagagtaaatacaatgctctatcattacagttgagtaataaacagactgaacttatccagaaggatatggatattaccctggtcaggcaagtatattcaatttttaatttaacatcatagaaatgtcattagttattcagaatgataccatttatacttattactaacaccctaaaataataactatgttttctgtggttatatatgtttgtgcattgagaatctggagttatttacactaacttgaaaaattgcctggaagaatgagtgggtctacaggattggacgagcatggtcaaggggtaccctagtttcagtttttaacaaggatattgcaatgctttcattcattgttttcttctaacatttctagccatgtgttacatgatgctcatattgttacagtgaacaatagtaactgagaaacaaattttgactttaattttattatattctatatagtttgttttaaagcagtctttctatatcaacataattgattttgtaatactattcataaagttggattacttgaaaaaggaagcacgatactcttgtatttctgttttttaaagatgttaaaactattaatttactttgtaattaccttttccagaaaatagtatgagagagaataaattaagacagaacttttccttggttcatagatcaatatctatctatctatctatctatctatctatctatctatctatctatctatgtatctttctatctatccatccatccacatgcatgaaaggacatgcatgcatgtttgtatttattttgcatgcatgtgtttatttattttggtagcaccagagcatgggatcgaagatatgcttctagaggtatataatagagtttgattgtataatttattttaatttaaaaactaagtgataaataaatgatggatacatcactgccattctggtacacattgggtggagttctttggtaaaacttgtctgggaattttccttcatgttagtgggcattggtaagggggtcaagttagtgctgtttatgacgtagtttttatagttccattaggcaaaatacagttttgtaaatttaaatatgccattgtgaatttagtttggatgaaaactgtttaccattactgaagccaataaagttaaaatgaattaggacattaacagattccttgtatcacattttaaaaactttctcatcataagggtgaggaaaagtataaactttatagatgatagactggttaacatatcaactcatgttataattatttttaaaacaataacgaagtcagaaaagtaattctaaataggaatagaatcttagatttggatgaaatttaaaaattattatttattcttatcctcttcctagtaagattgcatagcgtttagtctttccttgaaaacttagtttaaaagtttctgatgcttttcaagactgctattttcattttatattgtttaaatttttgaacattgttttacatgtacttagttgaaatttgcctttttataattcccacccatttattgtagttttattatctggagaatctcagaaaccatctaatccctattctgtaacatagctcagtggtctcagacatttatcaatgacaacattttttcactaattgatcaactactcctatttcttacataaactctccatgtacatatttcacagatgttatcatgttttgggttacctttctgactgttttccatattgtcaatcttcttaaaatataacatctggaactgcataaaatatttcaacaaagacctttacattttagagtatgatggtgctaggctattagaacaaacatggtgttcattctaggatacagtgcagtgttaaggacatgggatataacaactatgttttcttctacattttgcgtgagtttgtatatttaaatttagtgtattgcaagagctgtaagttattataaataaagcaagaatatccttgcatgcactttttcttatacaatagtaaaagaataatagctagtgggccatgtgtaattctaagagtttgattataaggacctatagaggcatatggcctatgtgaattaatgcaggaacaaaaaaccaaatacttcatgttctcacttataagtgagagctaaacattgggtacccatcgacataaacgtaggagcagtagacactgtggactactagacggtgaagggagtgagggtgcatgggtggaaaaatctacctgttggatactatatttaccacctgggtaacaggatccataccccaaatgtcagcatcaagcaatatagccaggtaatagtactacacatataccccctgtatctaacataaaagttgaaattttgaaaataaggactcacagaggagaagaataatagcacagagttggtagtttggagcagtggactttctcttgaatcctcattatagggtagtagttgagatgtctacagtgtgtctcctaagttatcttgtatgaggattactgttggatatactgtgtgtcttgtttctttcatcattatttcactgggagagggtggttatgatataccagtcccagtttattgaatctttatgttgtaatcaagacatatgaagccataattgtggaaaaagtggtctaggcactttcttatttggatacacttttcctcactgataaatgatggagctactgtttctgtatggatttccttctttgaagttcatagtcatttatattttattgaatatttgatccatgtcacccattgtgctaaaggatatttttgtgaactctacctcaaatgatttttgcctaggttacagtataaataagtatatacagtcattccttggtatctgtgggggattggtttcaggcctcaatatggatactaaaatctacagatgctcaagcccttgatataaaatggcagtatttgcacataacttatgtgcatcctcctgtatacttcaaatctttagattgcttatattaatagtatcaaatacaatgtaaatgctatataaatagttgttatactgtattttttgtttgtattgttttgttgttatatttttaaaattactgtttttgatctattgttggttgaatttgtggaagcagaaaccacagatatggaagtccaactctatgcatatataatgatgtacatgtctgtaatctgtatagagcatatgaatatatttacctagccattgcattaaaaaggataactaattaaattgcctaaccaaaacttttacctgatggtaatgatggagctactgtttctgtatggatttccttctttgaagttcatagtcatttatattttattgaatatttgatccctgtcacccattgtgctaaaggatatttttgtgaactctacctcaaatgatttttgcctaggttacagtataaataagtatatacagtcattccttggtatctgtgggggattggtttagatggggtagatggggtagaaccattacctaatggttctacaattgagatgagaatttttgttagaaattgagtcaagacagtgcagtcataattttggttcagaaaatcttcagacagaatcctgaaattggattaatacatctggattgctggttttctcagatgcttagcagaagcaagtgagttttctttggagaatgataaaataatctggacttaaattatatctaaagttttacaaaatagggtctagcacatagtcagaaataacaagtatgtagtaaggaaagaagaataaaaagatataagacctagaaatgaaagcagaaatcctagttatttggtaaaacatgattaattcacgtagagaacccaaaataatttatatatagtttaaactaataagtttatcatgcttggtggatacatggtcagtatataaaacttaattgcatcttttataccagcgaaacatattaggaaataagaatttacaatattactggaggtatgaagtgcacatataatgaaaaatgtgtattacctctattcagagaattctacaaatgttgagaaaaatagaaggtgtaatatattcagggaaatatcaaagttcatggtttggaagactcactatcataaagataccagttctctctgaatagatattagattcagaaaatgctgaccatcgattatcaacaacaggaaaccattaccacccttagccagaagggacaagaattagtatcctgtgacggaagctgcccaataagaccaataaccttagacagaggaacacaggcactatcaaactgtggctcagcagagagtgagctgggtaaataaatatccggacctctttctcctttaccctggaatcaccagctagtgcctccaactgatgaaattcagtcacagccagagaacaaggagcagtataactagtctgtagagaggttgggctcttaggctaagcagagtagagatgatgaagactggcccattctcagttactactctttttcagaacttttctggccattattccctgttagtttttgcatatgaactttagagtaaacttgcttattttttctttggtatgttagtagcacataaaatttacaataatctaagaagaattgacatctttatgatgttcagtcttcttgtcccagagtgtggtgtgtcattccatttgtttcagtctacctctgtgtctttcctcaaacagattttgaacatttctcatcaaatttattcctagctctttcatgtttcttgttactattttaaatgtaatttttccttcccatataattttcaaatgatttttcttttactgcatatagttttactgtacagcttttttggtggataaaaataagttgttttgtttttactgtgaactgtgctatagttattttggtataaatgataaacgtgaattatgtaaaaataaatacatgcagtacagaaaagtacaaagaaggtaaaagaaaaaaacgttagactaaaaatgcatccctagagaattaacagccataaaattctgtgagcattgttctacatttttctcagtcctgatttataaattgaagattgggtagacagatgtttttaaataaaagggactatattgcacatgttcttttggtaactaataattttaggtttttttttcatataatgaaacaataaggctctctgatgtgaaattgaggagattattacatcttagataattattttttctctataaggaacactatctttctaaaactaagaacaaactgatacgaaaaaccttggcgattcatgttattatttttttttaaactacatttcatctgtagttgattttggcactctgctctgtatactctggaaataagcacataaattcaaccattttgactccccccaatttgtatcttaagaattacagcatttatcttctcttgtataaccacagtgaacacagatgtttaggcataattctatatagtacttcagtgttcatcactaaacttttttactcttgatttgttcattccatcctgtttgttttgattcatctcatgagcccatttttaccagggccttccctattgctaccatatgcttttctgcccctgttggcatccaatttagccatgtgacttattttggccagtgaaatgagaggctttgcaaatgttttaaaggagccgttgtttgatttgcctttgcttttcacctttttccaggagaacagcctatttccactatagtctgatgctccagtttggttcttagaacagagaaaagcaaatgtaatgtgaagaagccatagatctttgtttttggaaggtgtcaggtttttttttttttcctgcagaattatgtagagcagctgctcgaaaccctctgttagtgtttcctgtcaaacctggtctttaaagggatagtcctaatttaatcacatggcctactcaactcctgagacagcatcactgcaatggtttgaatatttgtcccatccaaagttcatgttgaaatttagtcctcagtgtgggacattgggctctgccttcatgaatgaattaatccaattctcatgaatgaattaatccactcaggtattaatgggttattatgggaatgcgactgttggccttataagacgaagagagacctgagctagtatgctcagcttctttgccatgtgatgtctggcactgcctcaggactctgcatagagtccccatgaggaagaaggtcctcagcagatggaacccttcaaccttggacttctgtaagaataactgtaagaaataaattcctttttctttataaattacccagttttagggattctgttataagtaacaaaaatggactaaaacaatcactagtaactgaaagattattagatttatatttcagcagtaaaatatattctacagaacttaacatccttcatgaggtgggaagaagtattgttggttctcagtatcttctctttcaactaacctagattgtccttaattccctttgatctgtatctagaggaacttctcaagtttgaacctaacaattttatgttccataactttgattttgcttataactactctcattatggatttaaagctatgatggcatttttttttctttgtatcaatccttttttattatctttttcatttcattcattcaacaactgtttttacatagcctagtaaacagggcctgagtcacggattacatactgattacttgggagattcacttccagtacagagtgggcaaaagtacaagaatctgaggcagggaaggataaaaagtaattcgaggtaatgcattgttgttctggccattgcttcatgataaaccgtgaagacatcaggtcactgacttagccacccaagaactgagaaactgtgccctagagcaagccatcagatggaagaagataatttatctctctggtttccttttgtgttttgtcttccagtttgttgttcataccatcccctgtatagtagcattgtttatcccagtctggaaatggtaaatgcagaaaaagactctaggcatgcagctggttatcctcacgtgatggagtcatttgaactgtatatatctggtaggctgatgtagcaattagtaggctgaggcagagagatggactcaaaattctagtagctagctgaggttgaatctcaaaagatgcataagacacatatttaataagagacaggaactgtcctaggtgctctgtttatagcagtgaacaaaaaaagttcctgctctcacagagatgtccttacatcttggctttctattggtatttcacagcggcataatggcttattttttgtactttttcttcacttttcttctaagttcttatgttactcctactgagaggtatact

SEQ ID NO: 474 - DNA, 10607 bp, Homo sapiens
acttgagttctgtttctataaacttcttgaattaataattcaaaaagaattgaaaggtctttagtgactttaattttttttattgaggcatgaatttctatatggaaaaatgcgcagttctttagcatacaattcaatgagtactgacaaatgaatccacctgagtaacccatgtatcatcaagatagggcaatttggccaggtgcagtggctcatacctgtaatcccagcactttgggaggctgaagagggcagatcacttgaggccaagagttcaaaaccagcctagccaatatggtgaaaccccatctctactaaaaatacaaaaattagcagggtgtggtggtgcacacttgttatcccagccacttgggaggctgaagcaggaggatcacttgaacccaggaggcagaggctgcagtgagccaagatcaggccactgcattccagcctgggtggacagagtgagactctgtctcaaaacaaacaaccaaccagagagggaaatttccaggactccaggaagctctgttgtgtacctctctagttgactctcactctccctctgagaagcaactcctgagtgccatcactattgaataataattttgcctgtattagaacttcgtatgtatgaaatcatgcatatgtactcttttgtctctggtttcttttactcagaatgtttgtgagattcattgatactttgaatgtatcagtaagttgttgttaagtagtaatccattacatgaatatatcacagatttgttaatcctttaactgttaatggatatttaggttatttctagtttggggctattatgaatggggtttccgtgaatattcacacaaatatttttgtgggcatatattctcatttcccttaggtaaatagctagaagtggaattgctgggtcatatggtagatatatgtttaacattataagaagctgcaaaatgtttttccaaagtgtttgtaccattttatatttccacaagcaatatatgagatatttgattgctccatatccttggcaatgtttaatattaccggaatttttaatgtcagcacttctagtgggtataaaatggcatctgattggagttttatttttgtactttcctgatgactaatgacattgaacacatgttggtctgcggattgaccattcacataccttcttttgtaaagtgtctgttcaaatcttttgcccatattttgattaatattttcagttgagctacaggagttgtttacatatttagggcacaggtcatttttcagatgtgtgtattacgaatactttttcctgaaccgtggctttcatttttgttttattactggtgaatttgatgaccagaagttttgaattttcataaattccaaattatccatttttaaaatgtaagtgccttctgtagcctaagaaatcaacgcctacctggaggccataaagtatcctttacttttttcctagaaatattacagatttagtttttacatttaagtctgtcatccatctcaaattcatatgtgtatgatgtgagttaggggttgagaatgtagtttttagtcatttgcttcagcacagtttgttgaaaatactgtcctcactgaattacctaagcacctttatttgatgtcaattgaccatatatgtgcagctttatttctgcactctccgtttcatgatctgtttgtctattctaatgcttataccatactgctttgattaatttgatttagaggaaggcccaaaatcagaaaatgtgagtccttgggcttttttcttctttttaaaaattgttttgaaaattgaggtctcttttacttatatgtaaaattttaaatcagcttttcaatttatattaaaaatgcttatatattttgattgggagttcattgaatttgtagatcactttgggaagaacttgcgtcataaaatagaattctccaatttttgagcaagctatctctctccatttatataagtcttctttaagttcaaacaaatatttgtggtttttagtactttgtagtatacaggcattgcacatagtttaatatacacctattatagtttaattgatacctgttttattctatgctatcataaatgctattattttccagttcaatttccaactgttttgtgttagtatattgaaataaaatggattttgtgtatttattttgtattctgtgatcttgttaactctctttaagttatattatgtgaattccttaggattttctatatagacaaaatctatgtagaaaagtaaaggtagattttttcccttttcaatacctatggcttttgtttatttatttgtcttacagtatttgccaggaccacctttacagtattgaacagaagtggtaagacaaccttgccttattcctgatcttagggggaaaacattcagtgcttcttcatcaatataatgtcagatacatgtttttttgtaaatccttttcattaggttgaagatatttttccttatttcaaatttcctgagggtttttatgatgaacaaaaattgaattctatcacatgctttttctttatctatttgatgttatgattttccttctttgttctgttgatgtggtgaattatgttgattaatcaaatattaaaccaaccttgaattcctgggattaatacagtttggtcgtgatgtattatccctttatttataggtggatttgatttaaaattttgttaagatttttgtatctaggcttatgagggatattggcatatagttttttttttttttaaagttcttgtttggtgtcaaggttaggctaccctcattaaattagataggaagtattttctcctctaattttcctaaagagtctatataagattgtttgtatttttttctcatatatttgatagaatccatcagttaaggcatatgaacctagagttgtttgtttgttttatcatggctattaacagtgaaatcaatatcttttgtatttctagggccagttatattttgtatttcttcttgtgtccattttgataatttctgtttcccaaggagtttgacatttaacctaagttattgaacttattggcataaagttgtttgtaatattcccttatcctttcattatctgtaggatctggagtaatgtttcctctttcatcccagatactggtattttctgctttcttactttttttcttaatcagtctaactagaatttcataattttgttaattatattaaccaaattttggtattattgattttttcctgttacttgttttgttttaaatttctgtacttatctctattactttattccttcttttaacattgagtttcatttattcatctttttaataccttgttaaggtagaatcttaaggtagactatttatcttgaaatttttttcttctatattataagcttttaaatgtgtaacttcttctctaagctctgctttcgttgcatctcacaaatattgatatgttgttttcattatgattaatttcaaaatattttccaatttcccatgtcatttttttccttgacatatgtattattaataagtattttgtttaatatccaaatctttagtctatttgcaggtatcatcttttattaaaatctagatatcaatgatatttttcatatcaatatcatacattgatttctaaatttagctcattattatcagagaacatagtatgtggatttcagtcattttaaatgtattgagacttgtttgatggcccagtatatgatctagaaaagaatgtgtgctcttcagttgttaggtatggagttctataaatgttaactaggttaagtttgaaagtagtattgctacaggaccaacccccaataaaaatcctgaatgctgagtctctgttagacaccacttccaatgtattattacaactcattaatagaagaattaagtataatctctgtgattgcactggggcagaactcttggaaggttgcacctggattccttgggactttgcctcatgtaccccttccctttgttaatttttatttggatctttgtactataattttaaaaagaacaaatttttggtttcattgatactactgattttctgtttttaatttcattgatttctgctttgcagaataaaaaatatacattttttctgcttactttagatttaatatgctcttctttttctagttttctaaagtagaagcttagatgattgcttctagatcttcttttctcttctgatacatgtgttcagtgctataaatttccttgtaagctttgcttttgctacatcccacaccttttgataggctgtgttttcattttaatttttaaaaaaattatcttgagaattcttttaaaagtatgttgtctaatctccaaatattttgggatttttttcagctatcttttttgttattgatttccagtttaatttcattgtggtctgagagcagacaccgtatgatttccattcttttaagtttgtgaagatgtgttttagggcccctgatgtggtctatcttgaatgttccaagcaagcatctttacatgcttaagaagaatgtgtattcttctctttatggatgaagtattctataaatgtaaattagatccaattgatggtattgttcatttcaactgtattcttaccagtactttgcctcctgagtctgtcagttactgatacaggggcatttaagtctttaactataatagctagttcatctgtttctccttgcagttctatcagtctttgtttcatgtattttaacgctgtgctgttagatgcatactacattaaggattgctttgtcttcttagagaattaacctctttatcattaagtaatgcctgcctatcttattccttgataattttccctgctctgaagtctgttttgcctgaaattaaaccaactaccctcactttcttttgattaatgttagcatggtatatcttcttcatccctttacttttaatatatctgtgtctttatgtttaaagtgggcttcttatggacaaaatatagttaggtcttgtattttaatctactctgccagcctctgtcttttgattgatgtatttattccatgctcattcaaggtgattattgatatagttggatttatatgtaccatatttgtaacagttttctattcactaccccaggtccgtccatcttccttccttcctatcttccttccttcctatcttccttccttccttccttccttccttccttccttccttccttccttcctttctctctctttcttttcttttcattcctttctttctttctctttttctttccttatttctttctttttttcttctactctttttctgccttctctagttttaattgaacatgttatgtgacttaattttctctcctctcttagcatataaattatgcttccttttacagttattttagtagttgccttaaagtttgctgtatgcatttacaactaatttaagtccacttcaaataaccttacactacttcatctgtagtgcaggtatcttataactgagtgtcttggccatttgtgctgctacaacagaatacctgagactttataaattcttcttaatttataaagaaaagaaatttattttctcacagttctggaggctggaaagcccaagatcaaggtgctggcatgtttagtgtgtggtgtaggctgctctgcttccaatatgatgcactgatactgtatcctcttgaagggaagagtgttgtttcctcacctggtagaagatagaatggaaaaagggacagactttctctgtcaatccctgttataaggacatctaatcccattcatgagggaggagccctcatggcctattcatctcttaatgaccacaccacttattactgtcacattggaacacctaaaatttggagggaacacattcaaatcatagcacagagtattccacattcctccctccggtttcttataacactgctattattcatttcacttatccatagacagtaatttattactattattattttgaacaagctgttatatgttagattagttaagaataacaaaatattttatgtaccttcatttattcttgctctaacactatttttttttttttttggtaagacagggtctcactctgtcacccaggctagagtacattggcacaatcatgactcactgcagcctcaacctcccaggctctggtgatcctcctcgttcagcctcctaagtagctgggactacaggcgggtgctgctgcaaccgactaatttgcctgactaattttttttttttttgtagagacagagtttcaccatgttgcctagggtggtcttgaactcctgggctcaagcaatcctcctgccttggtttcccaaagttctgggattacaagtgtgagccactgtgcctggccaaacattcttcctgtcttaatgcagatgagaatttctaaactatatcattttgcttctctcttaagaacttttaacaattcttgcaaggcaagtctactggcaacagattccttcatttttgtttgcctgagaaggtctttatttctcctttacttgtgaagggtaatttcatgggatacagaattctaggttgatggttctttctttgaacactttttaagtggttcactccattctcttcttgcctggatggcttctgaagagaagtctgatgtaatccttatccctgttcccctacaggtaagattctcccaccctctttctggtttctttcaagattttctctttttctttgattttatacagtttgaatatgatatgtgtagatgtaaatcttcgtaatattcattgtgttcagtgttctctcaacttccttgatctgtagcttgatttttgtcattaattttggaaaatactcagccattattatttcaaatatttcagtttccattcttctcagtctggtgtcccattacacatatgttacacgttttgtgattatctcacaattcttggatattctgttccctttctattttctcttctttttgcatttctttttggggagtttcttttgacacatcttcatcctctgcaattatttccttggctgtgttcagtctactaatgaaccagcaaaggtattcttcatttctgttacaatgtttttgatttctagcatttcacattgattctttcatagaatatccacctctctgcttatattacccatctgttcttacatgtccgctttttccattagcctctagagcatattaattgtagttattttaaggttctgctctgttaattccacccacacctgccattggccatctgatacagtagatttaaggacagactcaagatagatggcctgtatttgaattctggctttccttatcagctgtgtaattttttgcaggatgcatacattctctattcctaagtgtcctcatttgtgaagtaggaatactcataaaatccacctcataacattgttaggagaatcagatgagttaacacatgaaaagcacttagagtgatttctgacacaaagtaagccttctgtatatgtgagatgatgatatagccatttgtaaatcatgccagcacactcccatctgagggcttttcccttgctgttctttctcggatgtttccctgatgcccacaccactggatttctcccctcatttaatctctatttgagtgttgccatcgcagtgagaccttctcaaacaccatgtataaacacacagtccttctgaagctgctaatccctttaccctgctgtattatttttccatagcaagcatgatgatctgacgtatatttgcctgttattttttgctgattttcagcctccttcaacttaatataggctacataaagtcagggtctctcttcaaaatttaaagaattaaaatgtttctagggcagttttctctatatgcacataagaaagtactgcgttgccccttaacatttatgttttctgggagtatttagtgacattggaaactatttatataatgctatctcacccatgcaaaagcagccatggacagtacataagacataaaaagattatgtgagcagatcagggtccacagtgtaagggatggcacatggcctgtgcccaggtctaagtgagttcacagccctcttccctaagccacatgtaatgttttttgactttgtctttcagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaaggtaagactcccagccactgctccttttagaaggtgaagaatcagggggttgagaagcaggggctggctggtttgggatatagttttggtttgtttcattttttttgaaaagcacagttataagctgagtgtgtcaggtatcaactggataggtgaagcatgtacctgttctgcctggagcttctgggcttgctgtttctctggctggttgtttacatcaggctctctaacatgtagaataggggttggcagtttctataaaggaccagatagtaaatatcttaggctttgccagccatagagtctctgttgcaactactcacttctgctgttcaggcacaaaagcagccaaatggctgtgttccagtgaaatttatctacaaaaagagatggctggatgtaacctgcaggctgtagtcttctgacccctgatgtggtacctttgttttcttcttccagtttgtggaatggcatttaagggctggagagctcctaggggtgcaatggaaacagctggggtcttttcttagagtataaagcagcatggaccttaacagaattccttatttccaggcttgtgtgcctcaaatccagtcttcacataaactctagagtttatttttccctaagttcccatctgccaattccagttggaattatagtggccaaggactgggctctgacatcggatggattctggtcagaccgtgttctacttctttctggctgtgaccttgggcacgtcacctcatctttttaggtctgaattttctcatcttatgatgtgaataataatcatatctacctcctgggggtggttttgagggctaaatggaatgatgtttataaagggtttaagttgttttcagcatctttatcctattgctatcgagtagtagtttgctctgcttggtcatacctaaaaaacttctaaacaaagaactatcctcctagaaaaataagccagaaagtcatggaatcttcaaagtaaaaaatgtgccacattgtctcccatcaaggtttcaaagatatcaggggccagtttccaaatcatatacaagagctcagtagtcaagagcaagggctatgggtttaagtcctgatcttcctcttgtaggctgtgtgatcttaagcaagcaactttgcctttctgaggctcagtttccctatttgtgaaatagggataatgatgctgcctccgtcagagggttagtgagaggatatgaaatgatgtgtgtgtagcccttaatacaacagtaccatacagaaagtgcgcagtgcattttagctgccgttgtttttattggaaaataacgtgaatacaaattgcacttctgaaatgttctaagtcactatttaaggggcttggtcagtgattaaagatattccaactaactgtctctgaaacatttttcttacgcgtgttggatattaggtatagttggatacctaatgtctctttttcctggtttacctgttatccatccttaagagtcagtggaggcagtaccccattcattaactgttctgatagttactggggattccgaggtgaatcagatgcagcccctccctcaagaggttcacagttcatatagggaacagataatgagataattagaacaccatgtatcacatattggccacagtgtggacagccaggggacagtgggagtgccaaggatgggacctgtctacttcttcacatgggcagggccacagttcatctttttttcttttttcctcttagagaaagtgatgtgaatctaaacaaatcctagagggctctggactgggccatatcctctaccctactctttactttgggctcttccttagaaacaaatggaaccaagacatagagggctgagctcagcttcatttagtggagtttagttctctagaatgatcctgtcagcagatgaaatcctaaatgaaactgcccctttttgtgcgatgtggccaaaagaaagccatcttcttggcattcaatatattcccaactgaagatgaaaaattaacatgattttacagagcaatttcagacataaaacaattcagaatgatcttttaaaatatgacagctgcttcaaggtttcttgagccattaacaccattatagagatttaattgcacctctagctttaaaggcataattgtgccttttaatggtagtaacacgtaagggacccacaccaccactgatcacccaggctatagaatc

SEQ ID NO: 475 - DNA, 10786 bp, Homo sapiens
acgaatcaaaggtcaaggatactacagttgtagactgtatggagactagatggtagacttcctccttggagaagaagccaaagaggaacacattctttccaccttgtgtcatgcatttatgagtggcttttccacaaattaaaaagtgatgtcatgaagaggtacaggtgatgcacctcagttgaaaactggactcctcacatgttgatcagtctccatttctaagcacattttaagaaggccagagctttaaaaggctcaagagaagaactggggaggggctcctcctgcctcttcttggggatagaaattctggcagcatagcacccttcaatagggagagatggttttgcctgtctgttgtttgccatcatggtgagaaacagctgaagaggtgtcttgctggtaggggtaggacaggattctcgggtccagctaactcatatggtggttctgagaagggcgcgtggtgatgaagtgatgcagcttagaaatctgcctctcgccactgcattcaatctgagccccgacaggtgggacctttctcttgcatctcctcatcagccgggcttttcctgagtgaggagactgcagtgttccctccagggcggggccaacagtatagacctagagctaactggtgatgccctgtggggcacgtgatgctgagaacagcacatgtgcttaacatggccttaatttgtctccaagcttcttaggagtatttgctataaaaaaaaacaatgggaggcccactgcagtgactcatgtctgtaattccagtgctttgggaagctgaggcagaaatattgcttgaagcaaggagtttaagaccagcctaggcaatatagcgagatcccatcactccaaaaaaacttaaataattagccaggcttggtggtgcatacctgtagtctcagctgctctggaggctgaggttgggggatcacttgagcccaggagtttgaggttacagtgagccgtggtggcgccactacactccagcctgggcaacagagtgagaccctgtctcttaaaaacaaaacaaaacaaaaaaacccccaaacaacaggcacttgtttaggcaaatgttccaaagtattttgtgcccctaaaatagcataggccttgtttaaaattggcattccaaaaaaatttttaaaaactcaaaaaacaaaacaacaatgaaagcaaaaaacaaaccctggcactgcatcatttttaatttagccagatgggaaggctgaggagggagtcagcacaggaaggcaaaatgcaacctgctcctcagctgagcactgaatgtagaaaccgtgtctcctctcggaagacctccctccccgactcccccaacctgaagaagggtccgttactaaacagttgcagtcccccaggccgaattccctgctagagcaacctttgggctattgatcaacagaaggctgaggtgatttatctaaaacactttagtgctaaatctattgcaagttccacttttaattcaagatcgctttctgcttcctccttcttaaatcaggattagtgattcaattcatttcctaagttgctaggcaatacatttatgagtttataactaggcctctaaccctttcccatgaattcagccaaacccatttatttattataatcaaaggaaagaaatgcttcacggagggttaatctttcacaaagtctaatgggggctaataggaagggaagagtaattaacacacaatgaattatcacacaatgaattagtttgcacttcaaactaatttgtggaaggtagctgtggagtaacagaaaaagcattaggttagggaggttgaaaatcaagttttagtcgttcttcacgaccaacaggctgtgtgactgcagggcagcactgagccaagggactgaggccttcaggtctccagctgcccagggcagattaaacaatcacctctctgaccaaggcaggggtacgagatgcaaggttaggagagtactgttgaagaataaagtacgatgaaaacataaaatatgaacagtaggctgggcgtggtggctcatgcctgtaatcccagcactttgggaggctgaggcggatgattacctgaggtcaggagttcgagaccagcctggccaacatggcgaaatcccatctctactaaaaatacaaaaattagccgggcatggtggcacacacctgtaatcccagctactcgggaggctgaggcatgagaatcgcttgaattccaggcctagtggcctctagtacctgaaatggtgagatctttaaatatgcttgcatattaaaagttctttgcttcaaatcaaagtggcccactgacacagcactgcccagtgggggaaatccctggtgaaaacagaaagcaggactctggagtttatcaatctgctccttttctgctgtgctctttgctctagaacaaagtagcatacacaggtgtcctcgcacacactgctagaatctaggtatctgggcatggttcctttcacaccacaacttgaggatgatccttcaactgtggatcctccgtcccttctgaagccagtcctcccaccctggctgatggtagtatttctcagtcttacccagtcaaactccaccaatacggccttccactattttctttcttctaacctgctaaacacaatctctctacttgggctccctacacagcaactactagactattgccctgagtcacccacactctccctacccactgtcatactgggggagatcagctaccttgcaggtcactgggatgtggaccctgtatagccagttgaaattaacatccttcagttccttaaaaagccaggcacatgttgtcatacattcacagactggctccacttgccaccaacataggcactttgcctttgctctagattctgaaaatatgttgaggaccacactgcaaagacttgaaaaaatatgctgaccttctttatttagcatctttatttacatagaattatcttttgcatatctttctgtgcttttgcttccaagagtagtcatcagtgagcagaggtttatggttaactcatctaattattggcaattgaagtagaagtatctccttgaggcacaggagcatcaacttctgtgtctcttgccgtgtcagtaagcaacatacaatggaaccggcagagctctctttcattcctctgattgtggagagtgggttagagaaaatgctattaatacagctgcatccagccatacccccaaaatcatgaaatgattgccttaggactgtaggaacttctcagggcaaataccacttgtttagaaattgtcagaatccaagtctgctaaagttgttcatctaagagagtgtcaaattcatccactgaaaatatactgctattcaagctttccaagcataaatgggatagagggagttgtttcaatttagggaaaaaaaaatccaggtgccaaagtctttcttaagatttagatacagcaatagcaatggtatctttgccattctataatgtgttccataaagtgttagaacttttaaaaccaactgactataatttaaggataaagtaattttatataccaggaactaaagatgcttccaagaaataaaaaagcaaatcaatcagcattgttcttatttgagtctccacaattattatctgtcaacaaccatcaacaatattttgcacagttggaatcaccattatgctgatattattggtcagcatgatgctgggttatatgctttttgcctgggtttcagaactttttctataaccgggaggttgttttcccaagcagatttggggaacttgggtttacctaactactgaaacaacaatctctttcgtcacagaaaaccaattggaaaaacttccgattcagatgctggggtttaatagagacaccaaagagtcactgcccgtgagacttttccctggaacctaaatccagttgccttggccctaagttgctgtttcttaagttcacctgtttcatgacttctgttccctttctccaaaacggagggggtccaggtgggaggtctgggtgagaggtccagagaaagaccagcattcaccaatggtgatcacctcttttaccctccttctgtacttgattagttgaaaggatgcaggaataaaacacatgaacgtttggggttttgtgaggaggagtcagtcagctttgagtttatggagagggacaatggtcacacccaagctttctacttcagcaccacgatgctgttgtctttgtcaagaaaggaatgctttttcagtaaaatgcaaccccactgaccacgcttgacatcacagcccacaaactattcccactgtgaggaagaagtcacagcggagccacagcatggcctgggctcttttctgattgtgtctcttaagaaaacagtacagctgaaactctctcccatctcagaggctgggaattaaatgtagttataaaattaaaaagtcagaaaattatcaacagaaaagacacatatatatctctagataaacagaaagacaaatgttctagccctttatctagtaacatctcctctgatggaggagtgatgacattgttgacttttcaatctacaagtgatttttgttttctgtttcaatgttctccagatccaaagggacatgctggataataagtggccacagtctattagagaaagcatcatgacaaagtgaaagcacaatatttatagaaaccccagatcaagcccttcccccaaatggttcctttctgtatgtatgaaggtgtgtatgtgtgtgtgtacatgagcgtgtatctataggtatatgtaggaagcatgaaggttgggggaaagggatgattacagtggggagtgctgggtattataggaagcaaaggattttagatcatacactcaggactgcatctggtgtctaaaccagagagaggagtggtacttaccttatttgttgcatcaataaatttgactcctttatatgagacagaaagaataatagtagggaccttcttcatttgctctgtagacttctgaaattaaaattagaaagctgttagagcagtttgtgttgcgtggcaactgaagcacacaatttttcctcctgaaagataaagatgagctcaaattaaaaacaacaacaacacacacacacacacacacacacacacatcagatacacaccacgcacactctaattttaatgtctgcctctcctctcttgggcttagctatacttcgggcttataaagttatccgtcttgcccttgaggatctaaaaagagtttgttccgctactttgtgtggatgaaggagtacttcttttccctgacactaaagggtgaatgaagaggtctgtctcctactgcaatttcaagtgactgttcctttcacaagagttaaaccacatcggacttaactccaagggtgcatttgacattaacaaaatatatgcacccccccttttcctagttaccttcattcttccaggcacagataatgcttggatgtatacttaaaatagggatgtaaaagatatcactatgtattgttcttgaactggaccaaatccataaatgctgatattatatttacagcagaatcacttgtgaccacaagggatgtaatgatgctctagaacaatgaagccctccaggagcagtctgggttttgagccacagcaaaatgctggacagcccaggtaacctactttatcatttagagctgctacattcccttaggccaagttcttgtgatagatgttcacactggctgaatgtgcttagagtttgcagcttgtacagttttatgcatctgcaaaaagtttctctataatttagtatgtgcctttcctgtttagctttatcattcatcaccagtcaccagcagtcagtttacttcattgccctctatatatactagtaataatcacactaaacatcaagaagaacctacctgacagttagcctggtggattttccagttaagacagatgggaacataataggagagaaaacatataaaaggtgagagagaggaaaccatttcaataattcaccaacagtgtaaattcattaaaaaacaaaagatgccacaaaagaacaggcttcagagtcatcaaagatgcagtgccactgttattttagaaatgctgcaggctttcaccggcccctttctttctctgtttctcatcattctgtttactgcaccgcacagtcttaggactgacacacaagaaccttccactttgagctttcaacaactagttgtcttatgtctattaagggaatcaggaaaaaatagaaactttcttgatttattcatttatatttcccaattttctagttttaaattctggaatgcagccagaattcaggaaggcttttaattggatagtgtgagtgaaactcattgaactcaatgatgagacttcaattgcatcttttagttgagctgtgaaaaggggtgtttcacattttcctgattgttttggcacaacatctttttgagagttactacgcctgtttcaaaaacaatggcttactaaaagtattgttatttaatatctgttgttgtatacaggatgtgaaaaagcagctctcttgctttttaaccagttttgaaattccctggatgcatcagtgttcctttgtgattgccaaaaagagagattatgaaaataaaatataaggttagaaactcgttttaatgcttcttccaaccacttcttaaaaatgtgcaagacacatcaaaggcaggctagaagaaatcatgtgcaatgtgttgattttaaggcaacgcggtggctgaactctgtaaagagggagggctggggcagcccaggcgatagttggaataactgaatgcatatgtgaaaaattttctgcaaagcgtcacagtggatttcggtaaatcacctcacttatcttttgccatgaatccattctcctggacagatctatctgtaatgcaaagcaatatacagctaatattcagatgaaaatctattcgttatttgttcagcaatcgagttgttactttaggcaacccactgtgcttgtcactggaaaagctcgagtctagttcagggatggcagacagacctcaaactgtgtgcaaacaccagtctgctgaaagcactgtgttgagaaagattctgagctgtgtctgagctcagtagaaaagagggctggaaatgatgtctgccatgggagaagaagaggacgaggcggcccaggggctacacatgaacatgcctgctaggtctgataggaagaacagctacaattacaatgttgacaaatgtgacaggagcaatatgaacaacatgcctccaggatagtgaataaaaacagccttattttgcttgacagagtggggccagtcttcattcattcattcaaaagacaatgacggcctattaggggtgattgagctgactcttgatgaataagcattttccaagtagcaaagaggccaaaagaggctgttttagcaacagaactaatacatgcacagaggcctagaaatgagaatgtggtgggtttgggtaactggtggagatgagagtggtagagtaggtttggaaggttgtgacttactctgccaagttagggtccgttggaagcttttcactagagagtgacacaatcagacctgtgttgcagaaagattcttctggtggttgtttatgaaggagggactggaagagctagaggctggatgcagggagtcaggaagttattgtgcaaatccaaaggagagagagaccctaagcacctgagttgaagtagaggcattggagaacaggaggaggcaccacaatgtcgatgaggaagaactgagaggttctgttgattgatctgctatggaagatgaatgggtgggaggattccacagatgaagaagccactgagataaggaatactggaggggaaagtgtttttgcgtaagcataatggaaatgcttttgcacatgctcagtttgataagcaggtggagatatccagtaggaaatgagaatcagatctggaaatccacctacatacatggatggccaaggaggtgggagtggacaaggtggtttaaggagtgaacaagaaaagagggaaggacacacttcaggggaagatgaaatcccaaggggtggggcagaaacaagagctaatgaaggaactggaattgaagttggaagatgcctacaacacagtatcacagaagccaaagaggagagggcttagaaggtaggagcaatgccccatgccatgaggactaacaaggcctaaaatggtgtgcctaccacagtggctggctcacacaggagctgctactttcattgggcttactgggtggaattcctggcttttgcaacaagaaaaaattgttgctgatttcattaagagtagcttcaagaaaatggtggcagcagctggagaggagaacacagtgagctgtgcaatggatgccagttaaaggaagcagaaagctggaacaacaggcaggtcaggacacagctcttgagctgacatgaaggcatcagcggtggttcctgtgatggtacaaagatcccacatcagatgctcggccaagttgaacaaaaaaaagaaaagatgaaggatagtcatttctttttcttccatgggtcccaggaatctctgctctcctaactggaggcagcactatggtgtcagtgatgcaggctgtgcacaggcctctatgaatggcagtgttgggggtggccatgctttccaatctggagcccaaactgtactgctctctccactgagtcatttgacaagaagctgatggatcctgaccagccagagagttcaaagggagggtgggaaatcttctgggtagagcccctccttgaaggcatttatacaccctacaaaagataaggatccatcgtcttttaaaggggttttctgatggtgtactttgacaagagtttccaaagaggtcttttcatacataatcttagcaaaagatgaaaatgcatagaaagaaggcaaagaggctaggcatggtggctcatgcctgtattcccagcactttgggaggctgaggtgagcagatcaccagaggtcaggagtttgagacaagcctggccaacatggcaaaaccccgtctctactaaaaataaataaattaaccaggcatggtggtgggtggctgtaatcccagctattcaggaggccgaggcagtagaatcacttgaacccaggaggcagagattctagtgagccaagatcgcgccactgcactccagcctgggcaacagagtgagactccgtctcaaaaaaaagaaaaagaaaaaggaaaaaaaaggcaaagatcaaagttattgagtcttcagggagtctaatctgggaggcaagaaatctagtaagtgcccacttcatttcatgaaggctttacaggcatcaaaatgtgagcacggggcttcagtccaatcacaggcagtcaaagtccctccttccccattttctcttcggtgttatgatcatcattcttttctccttcccagggacgaaggcgcctactctgaacatcaagttactgagcacgtgctctcaggcaacactggtttctatgacctatctatctgcatgctctgctgggtgtctgtataattaatactcccatatgtttctgttaaaaattcaagctttattgatttgtataaacagaactctgtacttcaggcccatttccccagtgaaagatgctcaaggcgaaccttctgttatcgttttctttcgtttctagttgcttttccctatgccatgctctttgtggcatttttcaggtttcccaatgttctcaaatttaccccccttcagagccagctttacagaagagactaatttgtaatggagacctctgagtacataagcagataaatactcctgggtaaggctccaaattattttaatttttacagcatcttggtcacctgcaaaaagcattatagtgatattcaaatgtattttgttcacaatttcccaaattaagaggatcatacttttatttttccaagagaaatgatatttagttatatagagatgttacgtttctgaaatctaaaatacaatgcaacatttgaatcctaaattcaaaggcagtcttctctttaagcacttgagtttatattgtctataaccattaaacagaaacaggaatcagaatttcatatctggaggtggccacctgaaatattgttcttagtaagtcactgaatgcttttagagcatttttaaaaagaagagattttgaaatcaccaagagaaagaaataaccatctttcttcttctcctttttaattttaaattatgaacggcttggtatcaggtcagaaattatcattggtgcttttattactgccttaaagcatgttctgaaaataagtaggttttctattttgaatgcagaatcagtagtatggagataccctttccagagtgcacgaactctaatctcagagcaagacttttccgagcacgaatgaaagcagaggggtttatgatggggagcacttcagttgtgagctgtaatgctctttgagtctggagtggtgttaatgttccgagtaagaatcattagtgccccatcatcagcacagacagggaaaacagtgaggctaatgtggggaggacgccaccaacccttcattcttacaatgccccgattgctcccagtgtatctgaagcacaggctggggaagggatttccggttggtctgttgccatccaacttacagtatatttttaacc

SEQ ID NO: 476 - DNA, 10852 bp, Homo sapiens
cctcgtctcagtcaccactctcacatctcatgaacagagacacgagctgcttcctcatgctccctgtgcccgtcctgggagatccctgcctttaaaccccagccacgaactgctgaccccgcatttcctcttccctccctgggcaagaggggcagaaggggcagggacgcacaccctgggccgcaggcagaggcttggccagggtcgtcctcccggcagtgcctccctggagctctgtctacctcaactcctgatgccagaggatccctctgcgctccccacacccttaagaccccagctcagggaatctggtctcggtcatcactcccaggggactgcagggccccaggacggcacacattcaggcccaggagagctccccccatctcaaagcctcctgtgggtggagatggaatgtggaaaaaccgcatcctctgcagctcccccacagtgagagcgaggactgagggtgtggataaggctccaggaagggggtgcaagcctgagaaggtggaagagctctgggtgggtccatctgctcctcacctgccccaaccctgcctgcaggtgaaggccggtccagccgcagaaggcccagcccccagcccacttacagaatccgcactgtgctcctccagccggcccggcccctcgctgcccaccgagccatcatgaccccagcaccgctgcacattcgtatttgttgaatgaatgaatgaacccttgccagcccagccacttggtggctgagggcttcagagctctcccagggtcccctggggtcattcagccactcaacagtttcccagcagcagcagcgaggatccgcacatcattgccagtgctctaaggagcgggcgagccccagtaagcggccgctctgaccgcgctttgtcagccctgagctccgctcgggaggagccggcaggtgtctgcggtgctggaaagaccacggtgtgggcggggattccgatccgccggcaagggtggcctgcacccggccaggcccgcgggttttctcctctccggggctggcctcggcccctccccctccccgcgccccgcacccctcccctgaatccccaggccacgtggagaggacacaacaaagccttccccgcctccgaggcggacccgaccctcagcaccgacctgccggccgcgccgaggagggcgcccgggcggaggggaggcgggagagacccggccctcaggtcgctgctgaggcctggggctctgaccccccgcctcccctcctctggctcccaccgcggtcgggcccagggcgggcggcgggccctgagctccacgccggggcaggcggcaggcaggggtcacgggctggggctcggcgcgtaccccgggaggggcgcgggtgcactcaccaccctccagccgcgggggcgcgggcgcgtccgggccgaggcagcgtctcccaggcgcgcggacacggtcgactacccgcttcctccttatggcgccccgcgcgcttcctccttcggccccccacgcccgggcccgccccggcccgccccggcccgcccccggcggcttgcggggacccggggagcccgcgccggcgcggggctgtggagcggggcggggagccggcagcgcagtgagaaccaggctttccacccttaccccttacgcgactgtttcagacagtgtcgtccaactttaagttggccacttactccagcgccgctgggataattcctaatgattctctgggaaacattcagaatccccaggctgtttctggaacagtctggggtggtcattctaggtcctcacggaaccaggggtttggaaagtgggtgaagccatgtgggttgcagagaatctggcccagcccctcaccagtccctgtgcttgttgtttattctttaattatttggatatcaactctgatttaaaacatcagtttaacatatagataatgctgggactacaggcgcacaccacacccaactaatttctttttcagtttttagtggaggtggtggggggggggtctccacctctggaggtctcaggctggtctcgaactcctgggctccagcgatgcttcccacctcggcctcccaaggtgctggaatgacaggccagtccatgcatccccggatgcagctctcaccggcagtgctgctgcagagccctttgtgggcgtcttcacttctcttgagtgtgatacctaggagtggaaatgcgaatcatagggctggacgagcttcatggtattaaaaactgcctgctttccaaggtgatgcacaccgttcggcacttccaccagccctgttggagcgtccagttgctctgcgccctcgcgtgggctcactccctgagcccactgtggctcctccagacgccctcacttctacccgggctccctagactcttgcctcttttataaaaggtcagaggatgtcactcacgctttaacatcctctgaataaaagccaagttcctttcagtggcccgcagagtcccacgcgacctgccctgctctaagcaaatcctaccctgtccctgttcctcctcggcagccccatggcctctggctttcaccaggcctcacttcattttcctccacagccagcatcgcagcatgacataccacggagtcgtttgtgtgtgtgttgcctacctcccctctcggaatgtagcctccacgaggacaggggcttgtttcctgcatgctcttcactcgggctgggcactctggggggctaacaaatggaagatcctgtgagcagggaaaccgtcagatggcattaggggccggtgccctgcagaagacgaaagggaaacttcatggactgaggccaggtcatctgcagggtggtgttcaaattcatggtacaatgtcagcaggcgcccagatgggaaaagagagggacgtgcacctgggcacaagaagctgcaggggcccctcccagggcaggcgagagcttggacagtggggcacagtgggcaagaggccagtggggtggcctgaaggcaggaggctccagcagcctggatgagcagttggattttatcctcagcactgtgggggccactggccctgtcatgcagggcaggacctgtaccaattggcccccacagtctctgcctctcctgttggctttttgcaggtctctcaagtgcttcttacagtcagggtagagcctccccgcctcaatcctccctgtcctgatctgctgcctctatgatgctttgggcttcaaaatctgtctgcagtatttgtaaaatgagagagggtgatgtttcctgcaaaacaaccacttcaaaaagaaaggggggcggggtgccagaaaacaattcagggggtgacggactggggggctatggaagggtccagggaaattccggggatgatgggattcttctatacagggattgtggtggatgccacacaattgtacacttttgtgagaactctgcacgaagaatggtgagttttactgtatgtaaaattataccttaattaacaaatgaaacaatatacacatacatgagagaatgatgactttatttttttttttgaaacaggatctagctctgtcacccatgctggagtgcagtggtgtgatcacagctcactgcagccttgacctcccaggctcgagtgatcctcctgcctcagcctcccaagtatctgggactgcaggcatgcaccgccacgcctggctaattttttaaaaattttttttagacggagtctggctgtgtcacccatgctggagtgcaatggtgtgatttccgctcactgcaacttctgcctcccgggttcaagtgattctccagcctcagcctcccaagtagctgggattacaggcacccaccaccatgattggctggctaatttttgtatttttagtagagacggggtttcaccatattggccaggctgttctcgaactcctgacctcaggtgatctgcccgcctcagactcccagagtgctgggattacaggcgtgtgccaccacacctggccttttttttttttttttttttttttttttgggacagggtcttgctatgttccccaggctggtcttgaactcctgggctcaagtaatcctcccacctcggcctcccaaagtgctggggttacaggcatgaaccactgcacccgacctgaatgatgtttttggcaatgaaaatgaaacacaaaatccagcaaggtttgacggggaaggcgagctggcgaccacatagtcacagtcggcctttgcttccgctttatgctgcagtttctcactgtcacttcctgccaccgggctcgtcttcctgtgaaaattcagcccctcttcctcagttacccctttgcaacagaacgaggccggcattttctaaagcgtccttgaggagtccagttcctaaaagattatttcagagtccactgttgtgggctgacttgaatgctctcaaaattcgtaagttgaagccctgacccccaggacctcagaacgtgactgtgcttggacacagggactttccagaggtgattaaggtgaagtgaggtcactggatggccctcctcctatctgactggtgtcctgatggggacgcggacacccacacaggaacggacccggggagaacaacacatcgtctctgcgccagggagagaggcgtccggggaacccagccgtgcccacgcatttatctccgccttccggctcagaattgtgaggaaacccgcttctgttgtgcaagtcccgggtctgtggtgctcggccatggcgcccccagaactgcatccccaccttctgctctgagccacccatcccctctggaagggctgagcttctctccctttccaccttctgttctgagccacccgtcccctccagaagggctgagcttctctctctttcactgcctatgctctgggaaactttcagaatccccaggctgtttctggaatagtctgggatggtcattttcggtcctcacagaaccgggggtttggaaagtaggtgaagccatatgggttgcagagaatctggcccagcccctcactagtccctgtgcttgttagttattctttaattacttggatatcaactctgatttaaaacatcaatttaacatacagataatgctgggactgcagcttcgccaggtggccttcctctcccggtctcgggaggcgtcacccccatcttgtccccccaagatcaagcgaaaagggcaaagttatcttttttttttgcaaaattcaaacctttccctccttcccaggtctgggtcacttgcgaccctcctctcaggctgcttctgacaggcccaagtcacagccaacttcaggggagctgtgttggatccctccaaactccgggaatgatgtgacctccccggcgctcaccctgggcctctaggttagactcagcccagaccctggctcacagggaagcagagcccatggctggcctccacccgctcagacgcccgcacacaggccaggggagggcttgggggcagctctgggagggtccctgtttgcgctgtgggtgtccaaggctgggtgtgcagagctgaggttgccacacacctgagggactctcgcataaggatggcgcagggctggaagctggactgagacagtgaatgagacagcgctgccggctctctccgcgccgtggactggctcctaggcagtctcacgagcaagtgtgctgttgctcgtgcacgtgtgttttaactgagatgtgagctggcgcgttttctccacccggctccatctgctgggtccctccacattgctgcgcgtgtgcctccagtgccatggggtccccactgtgggcagccctgcattttgcccaactgcctcccaaaccatggaaccccagtgacctccaacttgccgccatgacgagccactctcattcatatcctcaaacacggtgctctgagcccgaatgagggtttctttagagagatatctggggaccaaactgtagggacagagctcccgtctaaggtgggcctgtggtgaggtctccccagtggtacactttaatcccacagcagggcttgcaggccgccctgctccatccccaccaacactgggcaggatctagcctccaaacctttgccagtctaatagtataaaatgatagctcggtgctattttggttttgcatttccatggtgaacaatgagtttgagagtttttgttcaaaagtcctttgggagttcgagaccagactgggccaccaggagttcaagaccagcccgggcaattcagtgagatgttcatctctacaaaaaataagaaagataaaaaattagccaggcatgtttgtgtgtgcctgtggtcccagctcctcaggaggctgaggtgggaggatggcttgaccccgggaggtggaggctgcagtgagttgtgatcgtgtcagtgcacggctagcctgggcaacagagtgagaccccgtttctaaaataaaaataaaaaacaaaagagaaaagtcctttgggtttcgtcttggtattactcagcagaggacagaggtgtcagtttccatcctccggcaagcagatgctgagacaaagctcggtgggaggtgacacccaagaggaaggggcgggattggacagggacagccttcagatcacaatggggatcggacccctgggaggggagagagggaggaagagaactggtcggctgtgaagcagatctgatagggccctgctgcgacaccaacagcagctcagggccaaggatgctgttgcaggaacaagggacagaccccccataccactggctcagtgcctggagcacgtggcctctgtggctgcagcccgaggctgtcggctgaggcactccacacacctggagagcacgttctctgtggaaggagactgcagcattcccacggctccagagcagtagtggcggcacctggagaaagaagtccaccaccttcctgatggcggactctttctgcaggctcgctgcagtaacagactgggagctccggacctggcgtattgctagctcagtctgacggggtcccggctttcctctgaggttctcctcccaagagtgccgagattgatgctgtcccatccagcgtctccgcggtcaccagctcttcacatccctgggtgaagatggggagacagtgcgcgtagcttactcccgagtgacttgggatagaagccacggcacagaactctacaagggacactggtgcactgaagagcagggtgcggttctgaccagaagcatctgtgcatctggagggcagagggtgcgtgggcacgggggtctgggcaggcctcccagggcagaggtcaagaggagggcgggaggcctctagcttggtggttaagagctcagccttcagagtttgttttctcagctctatccttgacgagcttcgtgagctgtaactggccaggggctgcccccagaaaagctggcctccagctccccgcatcctgaggccccagatcaagtttcttgggccccaatttcctgtcatcaaagagatgatagtacattcctcagaggcgggctgtgaatacatgaaacgcaaggtcttaggcacccagcatgcgctcaggaagcgtggcttgtgattacccggcagtgcggtgggaggctcctagcagctgtgtgtgctgtgagtggggtggctggggtccctgtgggaggtgcttcagagtgggggctggatggcggctcccgaggggcatggggagaaagacaggagcagaggggctgccacgcactgcccttttccccttccaccccagtccccttctcagtgcacccttggaacttcaccccctccctgccagctgcccccaccgccttcccctgtcctgaagcccctgtccctaccatccgccccagacacttccatgctcttcttgagggtgggctgtctccaggtgccgctcattccccggccgggctgctgtgctctcactgaagctcaggtgctctcagaagcagaaggaatgaggggtggaggggccagtgtcctcctggcctgaggacagggctggggaggcaggggcagaggtggcctgtcccctgctggccagggctgacacgcggtaatggctattaccaagtgggccatttctccctcctgcccctccaggcatctcatccccccacactgcaggaggtgaggtctgcacaaggcctctgctcccctgggaataagcccatgcgttccatggtgcctcctaagcccctgaactggagcccaccccagtactggcgggggcctgattgctggagtgaaggcttcctccttcctggccaccccattcccctcatctctgggacagaaaccgacaataaacgcctgcccgagacctgggttggaaaaacagagtgaacacacaccatcacatggcaggaggccaggtgcacagagccctccctgcagttagttccccaggaactggggctgcagggatggcccagagctctcagccaacatcaaagggccacagcaccggggctggtggctcctggccaagtcagcaccgaccacagagctcccctctctgcctagacccagggctctgccctgacagcctagagaagggcctggctggtggtgcctggctgggtggctccctgcctaggaggtgctttccccaagcgctgggccttgaagggccggtgggttgtgagggcaagagtcttgctagaggagaggggagagatggcgagatgcaggaccagagcctgggggggtgaaaatcatgttcacccccatggtgaaatcacggccatggtgaagaccagtcccacccactgagcggaggcaagtagaccccaggaattccccagccccgctgctgggtgggtgtgaccctgcagaagctctgggaggctggcatgactcagctgttgcagaaagaccagtctggggtttcccatattgcttcaagcagccttttccctgggactgctctatctaatgccaacaaccctcagctgctagtgagccctcgccaccaactttcagagggctaactcctaaggcccaagggctggaaaactccaagcacagccctcccagagtctggctgtggctcagaatgggtgctggggcagggcgagcaggatttcccagagggagctgggccctctggcgtccgccccagggctggcccagcccagggacccccatgatatccttcctctcaccctgccctttctgaagtgaactctttggatattggccaaatcacacccagcagagggaagggagtggaggtcccggtgtgggggtcccggcgtggggtggctgtgcccagctggaatgttttgcatggtgatttgttagagggatattgagcagagggcaaaccaccactgtgtctagcattctgctcaaaggtgcagaaaccaagactgccacgtgcagagtgaacggcccaggctgtggccccccggggaggggctgagtctcagcactgcagccttatgctgtgcgcagttcagacctgcgataggcgagaggccagcagacacacgcctcgccttacgtgacgtttctgccatcttcattcctgtgttcgcttctgtaccaaatctcccccacacacgatctgaccccgtggcatccttcctttcctacaaactgcactgagacccaggtgtcatcgtgaagttcatgccagccagaggagccactgtggcgtttccggccataggcctgggcaggagccgctcccaggcgtgccgtgggcagggccgggtcagccttcagggaagagatgcctgtatgggaccaactcaggcagccacagagggatggcccagcaccccacaaaacccaaagtgctcagcgtctaggatctgtttacggggcagagaagtggatgttcttttcctggttcaaaggtagaaacaggcttggagagccgcacccggcatcagccagccaggcagacgcctggtctagcgcttggttctcacaggcatgtggcctccagtaaaagatcttcctggagagagggatgaaggctcttgggatcatctttagaggtgctgatggagaagcggggggggggggccttcaggtgggtgtgtatccctttatctagaatgcttgggaccagaggtgtttcaatttttcagattttggaatctttgccgacatgatgctcaaaggaaatcctgcattagggagtcttagcctgtatctccgctggcgtggaggaaaaggacaggaaagttttgaatggcggatccacccaggggacttccctggatggggcgctgccacccctgggccctgtgtgggaaagcttcagtactacacggtgccaccggctcccagccccagctgagctcaccgtccagctctcaaagccaagggcaattctttggcacctgaaaatgcatctaaaactatgacgtttatagctgccttagccctacttaatctctatttctctacaccaaatctctctactgcatgtgcttacgcctacgtgctctgctgccatggtgccttgccaagagcgtggctgtgctttagttctccccggggccttggaggactctccagggaggaggaaaggatggtgctagggggaggaggctgggggtggaccttgttctgatgccccttgtctcatgcacgaagttcttcaccctcctccaaaccttgacctggtgggagcagagactaccccctccctggggccagggataggatgctcatgcctgggaaggccagcaagccttccccgcttactcaaggctctgcagggttctgggggccggtgctgtctttggtgccatccgattgcttctgcttgtgggcctcaccctagggctgttcaccaaagtcc

SEQ ID NO: 477 - DNA, 10955 bp, Homo sapiens
tttaaaagttaggatgataggtaatgaaggcagaactcttgaatgtggtctagaaggcatgcatggggttgctctgatcacaaagggatgctatttatatgggagaaagggaatgtattaggattagatatttagctggcagggggactctcttgtcagtgaactcagggaggacactgtaggaaagagatgacagaaagagggagagactgcagagcatttatttattttgtttaattacaagcgtgagataagccagcaacacattacaacccgggggatcagagggtccctctgagacagactgcgggagccacatctggttgctacagtaacgggcctccttataacgagaagagccacaagtgcccgacataaatggcttggggcagaggagcaacaagcggcctaccttgctgcctcttggggaaggcagtctcggggaggtttcgcagtgggtaaagaatgagactctcgtggggagggtctcgggttgtcttgagtctaggagcttgagggcctctccgggtcttactgatgaggtcgaacatagggaaaggaagtcctcctggcttcacctgtgctgcctgcgagcccttactgcatgggaggagccccaggacaagaaggcggtacagcagcttttttgaactggcttgggatgctgagagatttgggcatcccttggccatcctgaggagggccaggcccacatgatgggatcagtgcaggggggggtggtcactggggccctcctgtggtccttcttgccggcgtcacccctgtagctgcaggaacttgaaacccctgccccaaacttgcattctccttcctgccccagtatgcctcctccttgctttgctgttccctgtgcctgtgagtttctctccctcttgtcatctagttcatgcttcttatcctggaagggtcaccaaagggtcttttccttcctgctgggtcatgtgccccttgaataagctcttctgtcactgtgtgactttttagtagcattttcccaattgatatctggtattttcaaggccatttgatagttccctacactggatggtgagccccaggtggggaggggtggtgtttggttttgtccatcctgtgtcctggtgcctactgcagtgcctagatacaggaggtgcttccagaatgattcttgagcaaacaaatgaatgagacagtccccagctgtttgtgtaaacgagtgaattcccacgactcgttttgggcctggttttttttcccagtgcagcagagcacagggaatgaaggggagaggagggcctggggagcggggatgtggggtgtgcgtgtgaaccatgggaggaagcctgcgttttattccaagggacacagggaccgactggagggctttgagcagaggagtgatgggatctgacctacattgctaaaggatcattgtggttagtgtggaaagattagccaggtggagggagagggctgaggagaggatggaggtgaattagaggggtggtggcatctggaagattgggctggactgggatctgtccggaatgtagagcccacgggtgcagcgttctgggcgtcaggatcccgtgatgtgtttgttgctctgatccgtgctgtaacttttcacaggtgagctatgctggggccctgagtttcccacattacaacacacacacaacttttcaatcaacaaacctttgctgcccccaaagccaccccaggagcccctggggcccatgtgtgccagttgaggccacggtggccccacctgcagctggctggccgttcagactcctgctgctgctcccgctgcctccttccatcacagatgatactgagttgttaccagtcaagacagggaaaaggcaccctcaaagcctcagctcttcaacctgccgttctgggcctccgccatccaccgccactcttgttttccagtgccattttgcacaacttccaccgtgctcgcgcgctgtggccaaacagcactactccttgcctgcttttgggggtgctcctcttctcacctggaatgccctctcctccagttttcacatgtcaacctcctacccatccttcagagttgtattagtctgcttggtcgctcacaacaaagtaacacagactgtaggtcttaaacaaaagacattaattttctcacagtactggaagcagacattggagtcaaaatcaaggtgttattttgggaggttgaggcaggagaattgcttcatcccaggagtttgagaccagcctgggcaacacagtgagaccccatttctcaaaaaagaaaaaaattagccaggcgtggtggtgcgcaccttgtcccagctactgaagaggctgaggtgggagggttgcttgagtgttgagtttgaggcttcagtgaggtatgatcatgccactgctctccagccttggcaacagagcaagaccctgtctcaaactatatgtgtgtatatatatatatattcaccttgtatcttcacatggttatccctctgtgtgtgcctgtgtcctaatcttttcttatatggacatcagtcatactggattagggctcaaccatatgacctcattgcaccttaattaccacttgaaagaccctctctccaaatacagttacattctgagacattaggggttagggcttcaacataggaagggagtggcggggagggacacagttcagcccatgactagagtctcagtgagatgccactttcccctccagcacccactgtgctcacacaccatagcctgttagtgggcttctttctagcactggttgctgtgtcctttggtgttcgttcgttcgttcgttcgttcgttcgttcgttcgttcgttcgttcattcatccatctaaaaatagtactaagagacatctagtccagactcctggactgtattattctttgagtcctgaccacaccaactatatctgacacaggtcacctgggacatttaattttttgttaattcatcaaacaaaatttctgaacacttctcatatgtaaggcattgatccagatgctaggcagcaggcacagcagaaggggtctgaatgccagccagctgctggtggggccactgatttgcctttccttttaaatgcaaaggcgaatcagagttggcacttccagttagttggagagacataactggcatatacagtcatacaagagaggacatagacaaaatgcttggaatttagagcaacaccaaatcacatttgtctttgtaggtgtggggagatggcagataagactacaagggtgaactgacatttgatctgggacttaaagatgggtaagatttgtgtagataggtggccttttgagtttaggcttttttcacttagcatagtgcatttgaaatacatcctttttgtgtgtgtgctattcattcacttttattgctgagttcattctttctattgctgagtactagtctaatgtggggatgcatcagtttatgtatccactcactgttgagggagagttaggttgcttgacttttgctgttacgaaatcaagctgccatgaacattagtgttacagatgtttgtgtgaatacaaattttatttctcttggataaatactgaagagtgggattaatggattgtatatgtttaatttttaagaaacttcagcactgcaaagtggctgtaccattttgcatttccgccagcaatgtattagagttccagttgctccatatccttgccagcacttgatactgttttgttttgtttttaaatttttagccattctagtaggtgtgtagtgatagctcttatggtttcaatttgcattttcttaatgactaatgatgtcaagcattttttcatgtgcttatttgccatccaaatatcttgtgtggtgaagtttttatttaaatatttggtcattttttattgccttgtgcagtttattattattatttgttattaatatggacatcatttgttatttttaacaaaaataacaaagaggctgggcactgtgactcacgcctgtaatcccagcactttgggaggcgaggcgggcagatcacctgaggtcaggagtttgagaccaacctgaccaacatggtgaaaccctgtctctactaaaaatataaaaattagtcgggcacagtggagggcacttgtaattccagctactcgggaggctgaggcaggagaattgcttgaacctgggaggcagaggttgcagtgagccgagactgtgccgttgccattgcactccagcctgggcgacaaggggaagactccgtctcaataaataaaaaataaaagtaacaaataataacaaaaatggttattattcaagaattcaagattcaagtcctttatcagttttgtgttttgcagatatttcccttccagttgatggcttgtcttttcattttgttgacaatgtcttttgaagaccataagttttaaattttgacagtatcccattaatcaggtgggtttttttgtttttttatcttagttattttattgctcatatttttggtgttgtaactaagaaatctttgccttactcgaggtcacaacagttttctcctgttttcttctagaggttttctagtttcaggtttcacctttaggtcaatgggctgtctttaatgtggaccagacactgggcccacaggtgtggaaccacagaggaatgagacagagcccttcactcagggaccatctgggcaagggaggtgggggtgggagtcacacagggaaacagtctttgtctggtgtaaggcctgctgataagcctgggtccagggtgctgtggacacactgtggtgtggaagcaggtctgtgcccagacaaggggctgtgaactgaggtttaccagacagtagagggtaagtgaaaagcaggagttcaggctgggaagcctgttctgggcttagagtggccttgggcaggcctggaggctggatgatagaactcagcatccctgcagctgctggtcatttgctgtgcctggggtcaaagtgcaagacagctggcaggagtgggcagaagggagcaggggcctgagcacttggtgtgccttatcctccaacaaagaggaggtggaggtggcttcatggcatggctcaggctgtgctctttgagggtcgggggtaactgtccctctttattttgaaagtcagatgtgtctgtgtcataaagggcacatccatagggggcagcggaagtgctgttacataaccgtttctgtccctcacgctggaaacagatcgcacagcagttgctgtacttgctgttccttgtagacttactcctgtgcaaggaacgtgtaatgacaaggtaatcccaggagcagcctgcaaaattatccgtcgtatttgtggttcctgtgtatatttaaaacacaatgctagaagcgattgatgctgacgaaggatagggcatattccaggcactgaataaattaaccctgcaaagcacagcagttgctttcattagccagctggcactgcaggaatattgctaaagcctgtgggttagaaaagaaaatctcaggaatgcgagaacaaaaaagaaatcagccacattcagtgatttaacttaatctggcaacaataaggaaatccagaactcacggtgctctgagcaatggcggactcccgctgcatgtgcgagtggatggatattccctgttcagtggaggggatatccaccacgactctgggtacccacggcgggatgcagatgtgagttagggccatgcggcgatgatccaggttttgttcctgcatcctctgcaactagagaagctccagcaaagttctgtgttcccctcttttcttcctgatgtccccaaggagtgaagcaaatgaataggcctagctaatgtgccatctctctctcccttctctacctggccaggcactttctgggatggctgctgccatcatgtccatgacactgaaggcctctgctgcctgcagtcccactgctgcctccgccaccctgggcaccactgctgccttgttgccctgtggctgtgaggtgccatagtgccaagtcttcagcacgccccagaagccatgatgagtatggtggaggcctcagaattttcctggggaagtagctctttccatgttgccttgatggccctgttcccacctcctgtctctccccctaggccaagtgttatcccaggagacccttcacttccacagacagacagacagactgccagggaccctcctcagccagcctcttcacatgccgaggccacagcactcagtgtggttgggtccagttgagaccctgctgctcatgacttaaggcttctgtgcattgaattaagccactaggggacttatgagatcaccctctggcttctcttgttgggtcccatacagccagtatgtgtcaccaggggcatgtggcatgtgtagcctgcctctcctgagtttgcagagctgggctggctcctccttgattttatcttcctctggaccagagtggctgaagtatagtgagcagagggaggggcagtggacgtggtgaggggccagacctctccatccatgggtgggggctctcgttatggagggtcccttttttgcgtctgtgctcagcagtgcgggggaagagggtttgtccccttcctcccaggtcctcatcgttcaaatgcacggaagcatgttggtagagcacacagaggttttgctgggtgggtggggcagcatgccctgcagttcttgcattgtttccagaggaaatagaatagaatgcaacagaactggcctgcctgttgcctgggaagctgttctcctgacatcacagggctgtgcccatatccccgcttggcttaggggcccctaagttaggaacaaagaagcagaaaaggttggataaaagataaggtactcagacttgatactttaaattatcaagttcctaagtctatggttaccatcagttcatactttacaaagcatttattaacataaattcatttattatgtttctgtgaagatgcctggttaaatctgaaaccatagaaatgtaaagtattgtttactatttctgtgaaactagggtgtaaaccaaaagttttaaaagccatccctcaggaataaatttaggaattatttctcaagcatgactgtgagttaagaatattaagttttataacactgatgcttacacatcagcatgaatgttttcaaggtagtagtgctggaaggctctatattcacatccatggggctctcatcctgaaagcagtctggggactttattattttttttcaaccatttagagatatttataagtattatgggagaaggattgtcattgccttccagttctcttttgtgcttgcccgttaattcagcacctatttagtgagtggctcctgcctgctgggactgtgtacctttgtagaagctccctggctggtggggcagggccagggaggcacccatatgcatgttttcagtgaaagccagaatctaagtattcattaactaatatttgttgaacacttattatgtgccaggaacacaatggtgaacaagggaggtaaaggccctgctatcacggaccttccctagtagcacaggaaggcagataacccatgacagaaaatcaatggcagataatcgatggcagtgagagtcttcatttggtgataaaggctctgaagaaataaaccaggggctgtttggtggggtgggagagctactctagagagtataagaaagacgcctcctagaggaagcaccttggagcagagactgacctaggagaaaggagcccactgtgtgaggagctggggggacattctggacagagggaacagcagggtcagagctcttccttgggaactagctgcacatgctcagggagctgggagcggcccacatgaagcacagtgagcaggggagagtgatcagagctaggcgaggaggtgggcagggccaggaagcctaggagcttggggctgggacaaagaccttgggctttcactcccaatgcagtgagaagccactggggggttctgtgtagggagtgatgtgatctgatttttgtgtacgtgtcttaattttgaaactttaattttagtgaaaaaaagtcacataacatgaaatttaccatcttaaccatttttaagtggacagttcatgatttgtgttttgaaaagactcctgtggctgctgaatgggcattaagtggtaggcaagaaggggcaagagcagaagccaagagccagtgaggggaggctgcagcacccgggtgagaggcagggctggcccaaggggtgggcagtggtcacagacctaggagttccagaagagagacgattttctggaggtttagagctgggagtatctcatcagaaaggtttttgcaagaaagtcttgattggcataagcctaaaaggaggggataaaacattcatacagggaggccctcagattggtgaataccccaagatgagaaccgcaagtttcattggaagtgcagagaagagtcctgtttggctacgctgcagggtaaggggtcagcgtggctcagccgagctcaggcaagccgtcatttaatttggtggatgctattgtctgaatgttgatgtaccccccaaaatttatctgttggaacctaaaaccccatgtgataggattaagaggtggggcctttgggaagtcggccatgagggcttcaccctcatgaatgggattgtgcttgtgcaaaacaggcttgaggagctcccttgccccttctgccatgtgaggcgcagcaagaaggcaccttctgtgcggcagagtgagccctcaccagacactgaatctgctggtgccttgccttggacttcccagcctccaaaactgtaagcaatgagtttgccttgtttataaattacccagtctacagttttttgttgtaggaacccaaatggactcagacggtgtgtaaggggagcagtaggccagggttaggcacacagcctgaagtggcattgctgagggtcccgttgggggagttagcaaactcctcgacattcccttgttgctgaactataaaatggggatgacagcagctacctcacagggtagtcagaaacatgaaagaagacgaaggaaaatgatgaacatggtgccagtctcttagttggtgttgctaaatgttagcttaaaaatacagtaaaatgggctgagtgcagtggctcatgccagtaatcccagcattttgggaggcttgacgcgggaggatcacttgagcccatgagtttgagaccagcctaggcaacaaggtgagatttcgcctctatataaaaaaaaaaaaattagccaggcgtggtgacacatctgttgtcccagctacttgggaggctgaggcaggaggatcccttaagcccagggggtcgaggctgtagtgaattgtgattatgccacagcactccagcttgggcaatggagtaagaccccatctctaaaaaaataaatgagtaaataagataaaatgcaggattttgagcagaaaatgactgaccccagctgaattttcagaaatctgtcttgaatatgtggaacggatgagcccaggagggccttaatgccaatctgtgctggagaaaaaggcagggctcctacaggaaatgttgcaggcatctgatctgctggcctggacagccgtgaatttgagaaatgggcgccctagagaggagtccaagatgactgaggttttgagtctggaagagcaagagaaaggctgtgccgatgacagaaatagggaagtccgggctgaagctggttattcagggtttgttctgtgccccaggctgaggctggctgtacacaggcagatgccaggaggctgcccctgggaagggcttaccaacaaggagaggcatacgtatgagaccgtctcagactaggagaagattttctggagcggagagacttgagcacactttggaaggtggtgttgaagttagccgggccatgggagctgggcaggtttcctgggcctcctgtttgccacaccacatctctgtcttcttcctccagctctgcaccagcgcaggcgaccgtagacactgtacctgtgtcccatgccttccctgagcctgtgggcagcactggctgtcaggttggagggagggagaggatgcgtatgaggtgtttcctagctctggggtgctgcactttccgttttgcttctccctttcattacaagccctgcccacacctttgtaaacacttcctttctcagctcacctcagttccccagctggcgtcccaggcagaggcagttgcatgtgcaaaggcccggagccaggacttgataaatatggctcaagatgctgcagcctagatagatatgaaagtctctggttccctcctatactgtagtttttattctgtttactttgcactagaccattttacactattccaaaaaaaaaaaaaaagggctcttattttatttccatctccttttcctactgccttggctcattcactttaatcctttgatggaagccatgttacaggtaagggaataactacttattagtggtcatttagctctttgggatgctggttgcttgaggcagctttggagacagaaggacgtcacagaccagtgattgtgagctcttggtctcaatatagctgccagattatagcctctctcttgggtctgcatttcatatttgggacttgcctcggcctctgtttcttattccagattacaccctattccttatgggtctccatattataccctattccttatgggtctccagattacaccctattctttatgggtcttcaccttctggcaggagtccatagtttcttactccactatcaaagtttgttttcaggtttgaggtggtgtggttagcgatgtacaaatgttcttttccatttagtttttgtttttatcacttctttttttccagtga

SEQ ID NO: 478 - DNA, 11092 bp, Homo sapiens
aaattcaatcccaaatgggtgtgacagagaacatttctatatccagagcagagaagtcaacaaggatgtctttctacctgtcaagtatccatttcccttcgtcaggccaaacagttcaggtgggaccaactccacctccttgctccaagaaagaacaggttactcaggcacagccaatgagaaccagacctgggccttcccctggaatcactgggcatgagttatgttgttttctccctgggctgccaagacagcagaatggaagcctggagctgctgatgactaccatgccaatgcaaggaagaacctacccaagaatgaagccaccggaagaagcccagctcacacaggcagaatcttgacactatcatttggaaacccctggattcaaccagacctgaagccctgggcctctctgtcagataagccaatacacatccttttctgcttaggatattgtgggttatattacattatggtgacctgcatctgaagagccatgacttgtaacaggagcaagcaaagcctaagaacctttcctccttttttcaagctgaaggtaccaggggtctctgtagcaggcctagtggctccaggaggatcccaggcccagagaaggctgagtaccaccttcaggaaagagaggccccttacctgtgctggtttggccatggtctccggttcgcagcagaatccactgtagagaagaaagacagcatgtgagattccccccaactctaaccatcccctttctttcccttacatttcctccctctgctgttttccagctgcccccagcccttcaggttaaatcagacccaatgacccagctcaaggccaatcacatttttttcagaagacaatggacagactagatggtgtccagacattcacagcagtatgggaaagggacgcggatccccaagggagggcgggcatggcactgacccaccactgaccccttgactcctccacactaggcagggtacctgtctcagcaccgtctcagttactactctcagaaatccttccacacatcagattctccttttttatagagaggaaactgaggctggagcatcgcaataaatgagccaagatcacacagcttagaactgaattcaacaatttctagatcccagagtctatactatctgcaccatgcatgcccccttttcaagtcaacaaggatggcttcagaacccagagcttgaccgcctgcagataggactcaaagtgcttccaaccacctgctgcaatatctgaaggactgtcattcctgaacaagtgagtatgcactcatttagcgcctatcctagtcaggcattgctctgggcactgtgcatgcagaaatatgagcaattttttaaattctgtttctctagagcttatgctgtaatgggaatgaataacaaatgcactcatcaggctgagataagaactacagagaaaagacaaggcttggtcaggaaagtgacaaggggtgtagtcccaggtggaggggtcagaggatctcacgagtgtgactggggcacaccgcggggtggtgcaagtgaggaaccaccacgagctcagtgtggctggtgtggtagcagggagtggtgtggtaggatgtaggatctgagaccggtgcctgaggccactgtaaagactggatttttcaggctggtcgtggtagctcatgcctataattctggcactttgggaagctgaggtgggaggataatttgagcccaggagttcgagaccagcctaggtaacatagtgagacccgatctctattaaaaaaaaataaaaaaaaaatagctggacatggtggcacatgcctatagtcccagctacttgggaggctgaggcgagaggattgcttgaactcaggaggtggaggctgcagtgagccaaggttgcaccactgcactccagcctgggtgacagggcaagccctgtctcaaaaaaaaaaaaaaaaaaaaaaagacaggaacacacaggaaaacaggacacatatctcattgaaaatggataaggaatgcgggtggaggatatcaggagacagggtctacagtgaaggaacaaagatatgatacgtaaaaataaatgcaaaaagagatgtaactgatttgggaagtataagagaagcaggtagggagctggctaatgagcactcaggagggcaacagatgaaagtttaacaatcttcttaagagaaggagaagagaaacaaaggaccactactttccactttaagcaggtctgggcaatttgatctcttttttttgagatggagtctcgctctgttacccaggctggagtgcagtggcgcaatctcagctccctgcaacctccacctcccgggttcaagcgattctcctgcctcagcctcctgagtagctgggattacaggtgcacggcaccacacctggctaattttcgtatttttagtagagatgggtttcaccatgttggccaggctggtctcgaactcctgcccttgtgatctgccctcctcagtctctcaaagtgctgggattataggcgtgagccaccaagcctggcctgatctcttttaacaatgtctatgtattgctttttaaaagtgaacataacagaggccaggagcagtggctcatgcctgtaatcccagcactttgggaggccaagcggcaaggaccacctggggccagaagtttgagaccagcctggccaacatgcgaaaccccgtctctacgaaaaaatacaaaaattagccaggtgtgatggtgtgtgcctgtagtcccagctagtcaggaggccgaggcaggtgaatcgcttgagctgggaggcagaggttgcagtgagcagagatggcaccactgcactccaggctaggcaacagagtgagactctgactcaaaaaaaaaaaaaaaagtaaacataacaaagtcaatcagatttacccagtaagacctaaaaggaacagaactaggagagtagaaatcatggagacatttcagctcaatgccttccagttctccacatattccctgttcccccaagacttagggaaaatcttagccatgtgaccgtgggcttattgctcatttttgagttcaaggtgatctcaagcacaaaactgaagctttcccttttctgctttgtagggttgttggaggataagacctaagttatgtcaaaggcagcacataagaggccaggcacaagacctgttcttagtaaatggtgatatttactgtgctggtgggaagttgaggacagggcctctgtcgtgtttgcctctgtgtcttcactggctgattatgagttccccaagctgcagtcagctgaggacagtcatcatatggggttgggagtggaaggcagaggacggatctgcctgcaaatgcagctcagctcagctcagcttcaggaaaccttgctgtttccctggcaaccaggggccccttggtacaactgtgcagctctcaccaggaaatggaaactgtaccccctttccagtgtgtggtggggggaggagggggcccacatctaccccgggatgaggctggaggccagctctcggtttcctctgacctgggggatagtagggggagacagtgaaggaagcccaaggctagcagagaaccagggactgaatgagacccaggaagttagttgacacagacagagggagggctgaggcctgtcacctgcatctccagccttgaagcactttcctctgggcttgttgctggcaatttcagctgctggctgcagcccaggcccatctggaggagctcccctttccaaggagagatggcttcaaggaggggcctcttactgtttgggaaaatattctcagctctgagagcagtttctgtgtgccttgtgtgagtgcacagttcatatgtaaaaagcaagctccttccagaactagatgttcagactgcagttctgagggccagtccccctgctgattccacagccccgcctctgagggttctgggaagctcctgagctaatcataaacacaccatttaccctggctttaagatggcttctgatccctcccagagcaacctagaccatactgctcaaattggctgaatattttacatctagtgtttctgaatcccacaagggcccttaataatccatgactccaagtccctcattttctagacggggtaaaggcatctcagaaagagaaagtgacttgccagggcccaggaagcagccaacatctctgcctagcagccctcgatcataacaagtccccacacaactgtgggtcttggctgcaatgggacaccaggaagagtccaaagaataagaccctggttctggttcccagtctgcccccatgtaacctcaggcaagccagatccctctctcagccttagtttcttcatctctaaagtgggacaatacatcactccctctttggtaggatctatagttagaggcttttagagacttcaactcaggattttcacagcagaatatcagtcctaggagggtcatctcccaggccacaggattcctccccatctccacccgccaatatgcaacattcatcaccttggttgaaagagctgttcaagactagtaaacagggtcattccagacctgtgcctctttcctcccaggaaccctgattctctcagatctagatgagatatactgtgacgacttatcatgactgatcattcgtgaaacccacacaggagcagaatgaatggcctgggtggctttgtgctgctgtggccaccccttgcctcatccttttgcctgcaatcaatcacgttttcctccttccccttcgagagttccaggctgactctagaaggaacggctcaccactgcccaaccacagagatgtggataggggaagggttttatccaagtcatgtgaaggcatgggccttcaggcacagatgttgcccagcagtttgtgatgtaagtaagttacttaaactgaatctcaatttccacatccgcaaaatgcagatagaaatacctataggtactgagaaataaatgaagtaacggggggaaaacacttagcacagtgcgtggcacacagtaaaggctcaataaatggtggcttttattataataagcccaaacatttacaatggaggcaatgtggcattagaatcaatgcaggatttgtggtcgatgcccaagttcaaatcctgaccatgcaaattccgagctcagtaacttgggcaagttatggaatttctctgcctcagtttcttcatcctgaaatgaccctcttgtaaggtttttgtgaagattcaatgaaataaggcaggtaaaacacttagcatggccaggtacagattaaatgtttaacaaacggtgacttctgttgccacaatcatcattattacagcagtagtctccaaaaaggggtaatgggtatgacaatccactggggtgcaggacaagagtatcaccactttccaaatgttttaatcttgcccttttatgtcccatttttatttgttatacatgtataaagttaaagaaaatattaggggtgcaggctgatagaggtgcacagtcaaaatctggattcaatggaatggaggcaggggcatgccaggaagaatagtaacaccagggtaagaaaaagcatttctgtcatcgaaaggtagcttgggctgtggaggaacagagtacacttttgagggaaaggagatgttgagcgtaagggggtgaaaccaggtgtggtgggagggtgatttgagaaaaaagaaataatatggaaaatcatgcaaaaaaacccacccagacctctgcctcaggggagtgcctgaggggctacagcctgagccacagcactcctctgctcacaagtctccaatggtgccccttaatactgggcctctaagctcagcagtcgaggccattggttctccttactgacttctttgccatcaccactttcctctttgccctgtcttccctgctaaaccaggaacgccttccaccaacatttttaatccagctttccagaatctataccagtgcttttcaattctagcttcactaacagaacctggggaatttttcaaaactaccaaagatttaaggtcagcccttagagattctgactcaactgctggggtgaggcctggcctttggtaatttctaaaaactttcctaggtgattttaatggcagccaaggaggctgagaaccactgttatctgctggattcaaatgccgccttttctaacaagccagaaggtattcccccgctagggtgctctgaaaccaccttgatttgactggctttggtcaaccactgtggatttatcatttctccattagataagggctgccagcctccaaggtattatgggaaagaatctgtacttcaaaggaaaaccctccaggttgtctgactcgagactttcattgtctttgagtgattttacaggtcagtaagttgcaaataattgatggtaacacaaagtaattctaatacatactccttgccctattttgtaaaggtccaattgatttcccaccccctcaggtaaaaaaagagttttgtctctaattgcacatttctttcaatacaaatgtgtcttttgagctggttataacatcggcctggtgtggtcattgattaataagtagaacagcacatgatcatttttgtatctgcatgagtcataattttacactttttagaaaattactgcatatgcctctttcctgcaccccctcccatagggcgtggctcctatggatggttgggggtaaaatgcactaagtggctttcatgctttctttagtgacctcagcaaatggaaccatctactattggttttcaaactgtgctttactcctctttctatagccaggagataaactagagaggttaagtcacttacccaacatcagaagaaaatcagtcatcaagcaggggcgtgtttttccataaacatttatttgagcacctcctacaaaccaggcccactggtagaagttgggggttgaacagaaaatgagacagacaaggctcctggccccacaaagctggtgataaggtgatgtcatatggcagtttgcagtatatatatatatatatatatatatatatatatatattgatcccatacacaacccataaccaaagaaaaattgagtatttaccatgataaacagaaatatacctttaaaatatgacattaaaagtacatttaataaggagtccaatagtttcttcctgtacccccaaaagatcatcttcagtgcgtcctggggtatatccatcccacttagaaggcccctggcctataaaatctagatccttccctctttgccctttcttgctggcttctcccccggtctgcaggaagacacccaggacccgctccataaccctccaggagccttgattctgatgaagctggggtaaatgccttccctggctctgtgcgtgggcacaccccccagcttgacgactggggtttcttagggagcagtgtcttttcctctcctgacccagaaccattgatcctaggactggacaaggcctcaggagatcatctctctgcctcaggattggaactagtctagcctaggtttgaaccccagcttgggtcacttttgtgagaggcagcaaagtagtgtctcacagtatagatgctggagccagactgcctgagattgaagcctgagggtgatatttagtagctgtgtggtgttgtgcaagtattgagcctctctgtgcctgtttcatattaaaaaaaaaaaaaagggataaaaatagcacctccctcataggagttatgatgaggataaaaaaaattaagacaagtctagagcttagaagaggacctggcacacaggaagcactatattttataagcatttgtcattattatttcttccttaaactgttaagggctggagtttccatgtctgcaaaataggcattaataacagcgtctaacatagcaaggcttcagccggggcctggcaaatttaagggttcgagaggtaatagtggttaccattttattgctattatttaaggaccaccaggacatggatttttcagaagaggaacttgaggctcaggtcgcctgccttctcaagcaccacacccttttgagataacacagcacttttatatctgccatcttacagcctcatgaaggtatcgatctcattctcattttgcagataggcaggacatccaaggaacctatagacagtcactcccccatagccagtctctgtgggggcttctcaactccaggaggaaagggagtgaggctggattccaaggcaagtttataggcataaagacacccctccgacttcctcccctctattggcaggagaaggggtgcatgcatgctcaggaatcacggtagagaccacatcctgtgctttgtcgccacccaggaagtatatcggagaggctgggtggggtgaggctggtgattccactgggcctccccagaaaatcctagaatggtagagcaaaagccattcagacccaacccattttattaataccagtggggtgtcctgggtatatgtcctatccctgtagagaggaaggggctaagccccagaggggtagtaggtgtgcccagggcgcctagctgattagtggcagggcaggggctgggtccgaggctggatcctggtggcccagggctccctctggatgctgcagtgcggatgtgccagtcactggcagctatccagcactgcagtctcccccacttcatcccaggagtcagtctcaagaggccaggccttgggcttccctggcccctcctctgcacactcacatctacattttgccccagcaacagctgtggcccttatccagaaactgcaagtattttctgtatctcagcagatgctgccttaggaacaaagggtagataaggcaaagaaagatggatgagtgattgtcacagctgcagagggggatgaaagcctctgcctcctgccctccccagtcccatccaactcccagaatcctaaatcttagaacagttgaatcctagaatgtctgcactggcagtggcagccagttcagcagactttgctccagatggggcacaaagccttagagaaagggcttgctcaagaagtcccagcacatccggactgtaaccgggctttcctctgaccccaggccagtgccctcggcgtggctcagggcctgcctgctaggaggtcagggtccacaggggctgaaactggggcggtcattcacttcaccatgaagggctacgcaggtcaggatatgccatctgggtcagtggaagcaatcccaagcatgttttgggcaagggggaaggaataatggagggaaaagggcggactcttggggggaaaccagagtcctttcacaaacccgggagccatatgtccaaatttggaattgtcagagaagacccactagaatctagggaaaggaaggaggaggcaggaagccgtggccagattagttgtcccaaaggacctcctgccctttccccttgtagggcctacaagggttgtgccaggcttcccaaatctataatcaagactcccaaacctgcaatcattccatacagctgacaaataaatcagttttcaaagccattgtttcctttgaaagagactgggtttctcaactatggacttggagaaggaaatccaggctcagagagggaaagccaccgcccaaagtcacactgcaacaggggctgggattccgattcagggtattttgctcccatgctggtatatggggaattatttgaagcccccaaactttgggaaggcctagaccgcttaggggatgcagaaagaagggtagtgcccctgcctcaccataggaggcctcggagccccgttgggagactgcattcatagacaagcagtggcccaaaggggatggggtccaatgaggccctgaggtatgtacgaccggacgttcagctctctgcacgcaggcagccctcccccgacaccacacacaagccattttataagcagctggagggtccaacgctcttgctctcagtcttgggcctcagccacacccttctctgcgggtcctttgactggcgtccagctgaccccaaccccggaccttcaaagtctcttgagcccccccaaattaaggccggcaggaccagcccctggctcagctccggcgcccaggaccctcaaccagaccctctgcagcaacgggactccctcccctccccctagccagggcgccctccgcccgcgcctctccgccccgaccccagatttgctccgctgcgctccccagacacacccagtctgcgacactctcgggttaccgcgccctcccgtccctgctcctggcggggggtacccatcagccgatgactgggcgcttatttcttgtgtccctgcagcccccgggaaggggttcccagagcgactcccctctccagcctcagcccactcaccgcgcagcggaggcctcgggtcgcagacggacgcacgggcgcagggactcgaggacgcagcgctcgctggatcggagcccgttagcccagcagcaaccgcagcgcggggcggaccgggaggacagccgtgggctccgagccggacacgtggcgcgcagaggccaatccggcgcgcccgcctccctcctccaccccacccctctagctccttagctcttggaatcttagaatgtcactagcccgaggggcttgccgggagaacctcctcagtttccagcccccggatctgagactgagaaggattaggggctttggccaaggtcacgcggcccttcagggctagaagtcagggctcctgactccgggttctggacactttcccgcaaattcttataagtcgccaaagctttgttgagaaacagaaaattgaggtttgccaggggcactttatctgcctgatcagattccatgcctcaacagcctcattaggtcggtgacattatttacccactttcaggaggagagcccagtccagttcctggaccaaggtcacacaaatagtgggttgcggaggcaagcttcttcgtgctctgggaagcagggaaggcaggcagggagaccagcagttgtaatccagcgcta

SEQ ID NO: 479 - DNA, 11160 bp, Homo sapiens
tttgtattcaactgcttcagtgtatactgaacatggatgaagttcagtatgagaaattcagctttaaagatttgacagttccaaaattaatattgttataatgtccatactacccaaaatgatctattgatttaatgaaatccctatcaaaatttcaatgacatttttcctagaaataaaaaaaaattctaaaattttcacggaactacagaaaactctgaatagccaaagtaatcttatgcaaaaaagaacaaagctggaggcatctcattacctgacttcataatatactacaaagctatagtaatcaaagcagcatagtactggcgtaaaaattgatgtacagactaatggaacagacaggagggcacagaaataaatctgcacattacaatccattgttttttgacaaagaagccaagatgtatacactgaagcagttgaatacaaatttctagaacctttaccaagctttggaatcactttgcctgccttcccatatcttggggggtgtccaccccactgcgatgtcgatcgtaatacccagccaggggaggggggtgatattactccccatatggcggggggtgtccaccaccctgctatgtggatcataatacccagtggggtggaggggggtgatattactccccatatggcggagggtgtccagcctcctgcgatgtggattgtaataaccaggaggagagacgggggcgatattgctccccatatcgcagggggtgtccacccttctgcgatgtggaccgtaatacccagtgggagagacggggtgatattacttcacatatgtcggggggtgtccaccccactgcgatatagaccctaatacccagagagggagaaggggtaatattactccccatgtcatggggggtgttcaccctccttctatatggggagtaatatcatctctcccatcctggatattaggaacaatttcacagggtgtgtgtacacagcctgcaatgttgaaagtaatgtcatcctctccccctccggatattaggaacaatatcacaaaaggactgtacactttttgcgatatttcgagtaatatcatcctgtgattccctgaatattgggagacatattttccacaaggtgggtgtacactcattgctatactgggagtaacatcctactgtaccccccggaaattatgagcaatatcacaggggtgcacagccattgccatagcagaagtaatatcatgcgctccctcactagtttttaggaacaatatcacagggggaagtacaccttctggggtattgggaataatatcatcatctcttcttgtagatattaggtacaatatcacgggggggggtgtacaccccttgctctattagaagtaatatcgttctcgcctcttctagattttaccaataatatcacaagcggggtgtacatcccttgttatattgggagtaatagcatcttctttcaacctggatattgagaacaatattacatgggggtgtacatcccttcaatattcggagtaacagtatcttctccactcctggatataagaaacaatatcacaggcagggtgtacaccccttgttgtattgggagtaatagcatcttctttcaacctggatattgaaaactgtatcacatggtgagtgtccatgccttcaatattggtagtaatactaatttcttccctcctggatataagaaacaatatcacgggtgtggtgtacaccccttgcaatattgggagtaacgtcacctctccctatgtggttattacggagaaaatcacagggtggctgtacacttcctacgttattgggagtaatatcatccacaacccccctggatggcaggaaccgtatcacagaaggggtgtacagcccctgcgatattgggagtaatattattctcttgtccctgtacgttaggaactatatcacaggggggctgtacaccttctgtgatattagaattaatgttatcatcttctccactgaatattaggaacaatatcacagaagggtgtacaccccctgcgatcaggccagtaatatcatcggctccttccctggatattaggaacaatttcacaaggtgtgtacaccccctgcgctattgggagtaacattattctctcttcccctcgatattagaaagaatatcacaggtggagggtacaccccaccccctgcgatattgggagtaatatcatcctcttttaacctggatattaggagcggtgtcacagggggcgtgtacacttccttcgatactgggagtaatatcctctctccccgtaaatagtaggaaaaatatcaaaggtgtgtacagcacttgcgatattgagagtaacataatcctcccctcacctggatatcagaaataatatcacggtgggggggtgtacacaacctgcgatattgggagtaacattattttctgcccccatggatgttgagaacagtatcacaagggcggtgtacaccgtctgcgataatgggtgtaatagcgtcctcactccccctagatattaggaacaataccacaggcagattacacacccgctgcaacgttgggagtaatatcatcctttcccccctggatactaggaacaatatctcatgggaggtgtacagcccattccattttgggagtaatattaatttcttcattgctggaaataagaaacaatataacaggggtggtgtacacaccctgtgatattgccagtaatagagacttcgccccccccaccggatattaggaacaacatcaaaaaggggtgtatacagcgatattgggattaatatcacgctctcccccttgaatttaggaacaatatcaaagaaagggtgtccaccccttgcgatattgacagtaattacatcctctccctccgtggattttaagaacaataccacatagttggtgtacacgcactgcgatactggaagtaatgtcatcctcttccccctggatattaaaaacagtatcacagaggtggtctacaccccccgcgatgtggccagcaatatcatcctttcccccactggatattgggaacaacatcacaggggtgtgtacacctcctgcgctattgggagtagtatcattctctcttcttctggatattaggaataatatcataggtggggtgtacaacccctgcgatactggcagtaatattatcctcacgcaacctggatattcaaaaccgaataacaggggggtgtacaccccctgcgatattggtagtaacatcattctctcccccacttgatattacaaaacaatatcccaagaaagggtgtacaccctctgagatattgagagcattatcatcctctccccaactaaatatgaggaacaatgttggtgggggggatgtacaccccttgcgatattgggagtaatatcctctccctccctggatattagaaacaatatcaaaggggtcgtgtacaccccctgtgatattgggagtaatatcattctaatctccccgggatatttggaacaatattatggagggggtgtacaacctctgccatattgtgagtcatatcatttctcttcccctggatattaggaacaatatctagagtaataatatcccttcccttctggacattaagaacaatatcactgggtgggtgtacagcccctgcaatattgggagtaatatcatcctctccctctctcgatattaggaacaatatcccaaggtgggtgtacatcccctgcgatattgggcgtaatatcatcgtctgccaacatggatattgggaacaatttcacggggtggggagggggtgtacaccttcttccatgttgggagtaatatcatcctctccccccgaattgtaggaaaaacttcgaaagggttttaccacttgtgcaatattggcagtaatatcatcctctccccacctagatattaggaactatatcacaggatgctgtacacttcttgcgatattgggaggaatatcatcctctcccatcatggatattaagaacaatatcacagggaaggtggacaacccctgcgatattgagggtaatattatgctctccccttctggacatcaggaataatatcacaggaggtgtgtacaacccctgcgatattaggagtaatgccatcttttccccccgaatataagaaacaatatcacaggaagatgtacaccccctgagatattgggagtaatatcattctctcctactctggatattcagaacaatataacgggggtggagtggcgtgtatacccctgcggtattgggagtaatatcttcctctccaccgctggctattaggaacaatgtcacagaaggggtgtacaccccctggtgtattgggagtaatatcatcctctccgtccctggatattaggaacaatatcactaaggagtgtacacctcctgtgatactgagactagtatcatcctcttgccccctggatattaggaacaatatcacaggggtggtgtacacctcctgcgaatttggggcaaatgtcatcctctccacctttggatattagagacaatatcacaggaggggtctacgccccctgcaatattgggagtgatatcatcctctcccccccggatatcaggaacaatatcacagaagggatgtgcacccactgtgatattttgagtaatgtcatcctctacccgctggctattaagaacaatacaggtggtgtaagctttccgcgacattgggagttatagcatcgtctcccccagatatcaggaacaataatattaatattaataattaatatcaattattaatattaataaaatgatgctaattaatatcaatcattactattagtaattaaagtgcttacaatgaaattaatgttaataacatcaataagagccatagtaaataaaacattagcaatttatattgattaataactagtattagtattaataattaataataccattatgttagaaatcagtattagttgctatcaataattaataataataattagtgattactaatgacattatcactattatcatttctaataccgcacggggtctacacccaactgtgattttgttcctaatagtcagggcaggagagcatgatattagtttcaatatcgcagtaggtgtacacccgccctgtgatactgattctaatatccacgggtcagagtatgaaattactccaaatagagcagggggtgtccagccacccggtgatattgctcctaatattcacaaaagaagagaatgatatcactgccaatatcgcagggagtgtacacctcttctgtgatactgttcctagcatccggagggggagaggatgataatacttaaagtatcgcaggatgtgtacacccaccctgtgatattgttcctaatatccaggaagggagaggatgatattactcccctcatagcacagatgtacacccaccctgggatgttgttcctaatgtccatggaggagagaggctgatattactcccaatatcgcagggggtgtacatccaccctgtgatactgctcttaatattcaaaggccgggaggttgatattattcccaacatcgcagaaagtgtacacccccgtgtgatattgttcctaatatccagaaggggagaagatgatattactccccatatcgcaggaggtgtacagccactctgtgattttttttaataagcgggggggtggggggagaagataatattattctcaatttctcagggaatgtacaaccccctgtgagattgtccttaatattcaaagacagaggggatgatattactcccaatatcgcagaaagtgtacaccccctagtgatattgttcccatgatccacgatagaagaggatgatattactttcaatatcacagaatgtgtacacgcacccagtgatattgttcctaatttcaaggtgggagaggatgatatgacacctaatatcgcagagagtaaaaacactcctgtgatattgttcttaatatcaagggtggggagaggacgatattactgccaatactgcagagggtgtacacttgtctggaaatagttcataatttcaagaagggaagatggtattactcacaatatcataaacaagctgtcggtccaccgtggatcgtaatatccaagggaagagaggggggtgatattactccccatatcgtggggggtgcccacccccctgcgatgtggattgcaatatccagggggcaagatggggatgatattactccccatatcgcggggaatgtccaccccactgcgatgtggatcataatatccacgatatgggggtgatattactccacatattgcaggggggtgcccacccccctgcaatatggattgtaatatccaggggaggagaggggggtgataatactccccatattctcttatgatctcatgcctcctgcccagcccagagatgagactttccttacctaatgagaaaaggacagtctcttcaacaaacagtgctggaaaaactggatatccacatgtggaagaataaaaatggaccctcatctcacaacatacacaaaaatcaactcaaaatggattaaagacttaaatgtatgacccgaaaatgtaaaactatggaagaaaatataagggaaaaccctatgatgttgatctggacagtgatttttttggatatgacccgaaaggcacagacaacaaaagcaaaaataaagaaatgggattatgtcaaactaaaaagcttctgcccaagcaaggaaataatcaatagaatgaagagacaacctatggaatgagagaaaatatttgcaaaccatacatctgataagtggtcaatatccaaaatatataaggaaatcaaatgactcaataacaggaaatcaaataacctgatttacaaatgggcaaaggatctgagtagatatttctccaaagaagacatggaaatggccaattgctaagaaagtagattttaagtgttctttttacaaaaaaagataagtatttgagatagggctttgttaaatagctgaattttgccaatctacaatacataaatatatcaaaacatcatgttgtatgctataaatatatacaatttttatttgtcatttaaggtaaacaaatttttaaaaatgaaacaaacaaaaagatttgacaattccagaatgaatgactgagataaaatgtagtgatctgatcatcttgaaaggtcattacaattgattgaattattttggctgttgtggaatattttccacgtggccttgtttggaagcagggttataaataaggtcatcccttcctgattttagggatgtgaaatcaaacttagtattttaaaattttgttttgagttgggcttccactggtagaaaaataaatgagaacttaattccattatttagaattgaaaaaatagatttttaaacaaaatgatttgtctacctgtgctgtggtggaaaagtatgggtgtctgtgacagggtttcctttatcaagtgaaaaaacttcaacccagactgggctaatttttcatttggtaatatggccatatctgggaagcaatcatttccagatcttaactggcatttcaattactaacttttacatttcacatgtttaatggaacctggaaaaggagacacagattttagtcttcttggctagtttgtgggtatagaacaatcttaactcggacatcgtggaagtcagtgagctgtgtagacaggaccttctggggagctgattgttcatgcactgcaaaactctctttcaattattgaaatcaacttttttccaatgcctcaaagcaaggacgattctgaggcctttgaaagcaatttttcattttgtttctttgcatactgacacatctcgatgtttactacgtaacagaagagctaatttaaagcagtgtgttgctaagcctagctctctccctatgtctccctgcctctgccaccctggatcctgtggtcctcagtacttttctgtgccatacattagaatcccagaatggcattctaaataggagacaggcggcagagtagtaaaaattgagtgaatttatgattcaactgagaagattctctttccagtattcttttccccagtaaagtgattgtactgattcctttgtaaatttggtcacttggaaagttctaaggattgagcaaattgcttttaaagaatctccattttctgcatatgtatgtcacctactcaaaatcttattttccagtttaaattattttctaactaatatgttatacttccctcagcaatccctcaactgtaagaaaaatgcatttttttcttctagtgataaatagtaagttcattgcatttcttagaatataaacattcataattgataacgtccacacatctccccagtcctcatgtttgtattattagcttaatatggaaagactgtgtgtgtgtgtgtatgtgtgtgtgtgcatttgtgtccataataaaagagaaatcttatgtgtccataataaaagagaaatctattttgctaatgagagtttccaatcaacaaattttgccttgtgaattacagttttaaagtactttcaattgttaaatttattgctatttaaaatcctatttaggaaccttgctattaatactagaactttagttacagcctcaagtttgagcccctcccaaaaaatctcatctcctggagcctgcaaaagtgtataaaatatgttcagaaaaatacatcttggacagccatggagtggaatggagagctggtgggatatatggctgagaggagaggtccaagacagtgcctttcctggtcacaaggtcaaggtcaatatggctcacatgggtgatgccattttcttcttgttctcataacatccagaagatgtgctggctgatcagcagttttgcagaactgctactttggttctcagggagtgctctagaatatatttacataacttgagaaaaatgtcttgagcatatactgcatggccagtactgtgcctgagccctcttagtgtctagatgtgaattgtagttatagtctcatggctaaaagttgttttgtatttcagtctcttctgccacctggtttttaaaatgttttcctttttgagaaaatcacaattacctgtatatgtaaattttattgttaaagatgagtactgatattttgactttattttgggtcataggcttgcaaagctttacttaagacttcagtaagtaaaggcccatgactgatttgtagaatcactgaaataatagtaagactctacttctcagaagatgaaacagagtcttagagaagtttattactaaattagacagtttttttttgttttgtttttttttttgagatggtgtctcaccctgttgcccaggctggaatacagtggcacgatcctggctcactgcaatctccatctcccgggttcaagcgattctcctgcctcagcctctcaagtagctgggattacaggtatgtgccaccacgccgactaattttcatatttttagtagagatgggggtttcaccatgttggccaggctggtctcgaactcctgacctcaggtgctctgcccgccttgtcctcccaaagttctaggattacaggcatgagccattgtgcccagctgacagttgtgtttttaacttgaattttatacttaatttttgataagaatttttatttggggtgtattatgatatttgaatatatgatattttgtgggtatggagattgcagatgatttaccagatttgcagagcaagtaatagaggacagtttattccttcttagttttcacttgctcttcttccacatgtgttagccactgttagctccactccagatgagatagagcttcttttctgtctgagcatgaatttgctgggagccatgagataagttttttcttaggtcacatagttattaaataaatattcactgagtttaatttatgaacaacgaaagtaaaaccagacacgattcctccccaaaagatgagctcatgtgaaacagtggggaatgcatcatctttcaggttaccagtgtatggtggcactacagtatcaaggttatgtattatagacaataagtaaggaagacatatctgagctgattctaagatcagaatctggtgatgtgttaattgaacacttggcaattgctttcttagtttacccattcagattacttatcctattgaggaaatgaagatagaaaagattggtggctttattatatgttacactgatgctttgggttagagagcatgggttgcataaaatattttaaaatgcggatggataatttttagaccagttaggatggctacattagagaatccaagacaatgtctgccattatctttacaatacacactgatttttgtgtgtaccttgtcattatgtaagcttcctacagggctgtggtaagtcatggacagggttaaggagaagggtacatgtcgagaaactaaatcacatttggagaggagatgtaacaaaggtagggttcagaggtttactggtaacaattccaaatttggaatgaaaaagttactctttgtttagcgttcgagttgggagtttgccctgcaagagacagtcaaccactgacttcagtcgaacgtacttggaaagggaagaacttaaaccagccatgaacagaagaaagccaggttttctggaaacatcgccaaaacccagcaatttctcagaattttcagaggcgccaggggggtgtttgcatttcaatggaaaaagttctgaaagctctggaaactattctcagttttactttctcattgaaaggcaaaaaccatggctgtaagtaagagacagaagcatttgctatggctttgttaagaattaagaaaagggacctctggaaaatttgaattgtccaatcctttgccacagagccaagacaaagtggtccaagtcataatggcaaatagaaaataaaagtactgttagctttaagacaaaagtactcaatgtctggagccactttccaccagcctgggttttaaaagaaagacagaactttctagatttaaagagacatagttgcagctgtattgcaataacataatggtagctctcataagtacatactt

SEQ ID NO: 480 - DNA, 11170 bp, Homo sapiens
ctgttaaatatggccatctgagttccccttgggatactgcaacccacccccgccaacttatcaccttcactcccaagcctgcccctctcccgtgcccttgttcgactgggggcatttctactattcccagcagccaggcctgaaaggggagacacactccaaccttcaccccacctcctgcccccagccccaggagcaccagggcctgacgctcctccaaatcccctgcgctggccatcccaggccccttccatcacgtgacctgacagccaccgtcttcttgctcctctccagagcccctaaacttggctgtggcccgtcagcttcttcaggggtgccagtggctggggcaggaatcggaacccttctctcctcctggagattcaggagaacggggtccacccttcactgccgtgtgatctgagccagctgtccccgctctctgtgcctccacgaagctcagccggggttgagacagaactgttgggaggataaactgtggtttggtggatgaggcaccactaggggccccggcctcaccgcccatttgctgggtgatctcaggcaagtcacttgcagtctctgagcctctgtctccacctcatttgtgatgtcgccgcagtgaccctcccagtttcatggacccttctaaggaccagaaaggggaggggctgaaagaattggctctggggggttaaggggccctgggccaggcatccaggccatcggaggactgtgtcccatagaggggtggagggggagcccgttctgcagcccacagcagggcctgagcccagggggcccagccagaaccctgggtgcagggtcagagccctgagcagccgctaagtgcaccctggagacacccctgctggggaggagcccagagcaggccactttgtccccagggatcccaggactgtcccccaggcccaggggcactgcagaactggtgagggagctactcaggcagaccatctgcctgtgcaccatggactctcagctcagcccagcaggtccttcacgcccctcggccccaggacccacccaagttcccagcagggatctccacccaccctgagcctatttctggcacacagcgccccctgctggcctcttcgggggcagcagagactcacggggcctctgagtcctggctctcaagttgtttaaaggaaggagaaagtctcccggtcccgggatctgggtctcagccacctttgactcctgcctccctcaaggagggacagatggggccgcattgcaggctggtcccaagcaatcgtggccacttttgtttttctggaaagtcttctaaaggtcatgtgccacaaggggcctatttatacccaccctttcactctcctccctccctttcttcccttccttttctgtctgtgtgtgtgtgtgtatgtgtgtgtgtgtgtgtgtgtgtgtgcgtatgtgtgtgtgctttttttttctctctctctctttttgtagatgtggtctcgatctgtcacccaggctggagcgcagtggcacaatcataactcactgtagccttgaactcctgggctcagcctcctgagtaactgggactgcaggcgtgtgccaccacgcctggctaattttctttattttttgtagagatgggggtctcactgtgttgcccaggctggtctcaaactcctggcctcaagtgatcctccagcctcagcctcttaaagtgctgggattacaggcatgagccaccactcccagccagcacagggactttgacggtgtctgaagggcactccttgaacctgagggtccagaaagactttcctgatgtcagaaggaggagagggctgggatggagggaacctgggccacgagtgaggttctcccactaaggagcgtgacggggcacacacagcgtggacagctgcaggtctcatggggtgcacatgcatgtccctgtgtgtcacgcatgtccctatgtgtcaggcccaactgggacctgactctctatctcctttggcccaggtcctcctgctagaagcagcagaacggccctccagcccggacaacgacctgccagcccccgagagcactccgccgacctggaatgaggacttcctccccgacgccatccctcttgctcaccctgtgccacgacagagaaggcccacgggcccagccggtgagtgagggctgcagagaggacaggctggggcagccgaagggaccttgggcatggcctcccagggcctccctagagaggccacacactagacactctagttccaacatgccatgtggcattttgaaaaattaagctaacagttgaaaatgggtatttcacctaaaagccaggatttctagtttctcttaagaagtagacgatctggtcaggtgcagtggctcatgcctgtaatcccaacactttgggaggccgagaagggtggatcatttgaggtcaggagttcgagaccagcctggccaacatggtgaaaccctgtctctactaaaaatacaaaaattagccaggcgtggaggcaggtgcctgtaatcccagctactcaggaggctgaggcaggagaatcgcttgaacccggaaggcggaggttgcagtgagccgagatcacgccactgcactccagcctgggggacaagagcaaaattccgtctaaaaaaaaaaaaaaaaaagtagaccatctggccgagcatagtggctcactcatgcttgtaatcctagcactttggaaggtcaaggcaggtggatcatttgaggtcaggagttcgagaccaacctgggcaacatggtaaaacccccatttctactgaaaatacaaaaattagcccagcatgattaatcccagctactcctaaggctgaggcatgagaattgcttgagctggggaggtggaggctgtagtgagccaagatcatgccactgcaatccagcctggaagacggggtgaaaccctgtctcaaaaaaatagatgatcttgggcaggtgcagtggctcacacctataatcccagcactttggaaggctgaggtgggaggattgcatgaagccaggagctcaagaccagcctgggcaacatagtgagaccctgtctctacaaaaaattataaaaataaaaatgagaaaattggccatcagggctggcagtccctcatggaaacaaccagctactgggttgccactgtaggtccagtccaggctgtgcagtttgccgcagtccccaccattccctattgtcttacagctcagctactgtcttcagtatctgccctgctccttggcttctgcacttatggcccccagcccagccttgctgggttcaattttgcagcattctgcctggccagggagcaggaacttactgcttcccacctctttctggggtttgctctctgaactctctggctggaattggaggacatctgcccccctgccttcctgccacacttttacaattttattttattttattattttattttgagacaatgtattgctctgtcactgaggctggagcacagtagtatgatcatagttcactgcagccttcatctccgaggctcaggtgatcctcctgcctcagcctcccaagtagttgggactacgagtgcacaccaccacacttggcttttttttttttttttaatttttagtagagacgaggtctcactgcgttgccaggctggtctcaaactcctggccttaagcaatcctcatgcctcggcttcccaaagtgctgggatttacaggtgtgagccaccatgcttggccctggccacattttaaagttaaggggaagaattttccctctgcagattctacctactggtctgggctctgccacctggggctgtaattacctttgctttaatcacaattgtaataatcatagttgcaatcgatgaagccctcctggttgccagacactgaggtggggctttatcctggaggacatttagcaaacaacacctgtctataaggctgaatccaggggttgaaggctgaggtctaccatgagtggtcaggatctgcactgtgccagttattaaatattttcatatcagatatgaaaatatttcaaatacagatataatttttttttttgacatggagtctcactctatcactcaggctggagtgcagtgtcgtgatctcggctcactgcaacctctgcctcctgggctcaagggattcccctgcctcagcctccctaataactgggattacaggcacgcaccaccaagccccgctactttttgcatttttaatacagaaggggttttgtcatgttggccaggctggtcttgaactcctgacctcaaatgatctgccctccttggcctcccaaagtgctgggattacaggtgtgagccagcacacgcagcctaatttttgtatttttagtagagacggggtttcaccatgtcggccaggctggcctcaaactcctgacctcaagtgatccacccgcctcggcctccaaagtgtggaattacaggtgtgagctagcgcacccagcctacagatatcactcttaatcttcacacaaagcttggaagccttgaggttacaggggagacacctgaggctcagagaagttaagtgacacccctggggtcacccagcaagccagcaagctgggggcattttgcctccatgattctctgcccttagagccctttggagggggcgctctccctctgccctctgttctgagtgtctattctgatgctgggttggggagcaggggcagagcagggaggagagatgcatgacacaggtggcctccagtggccagtcccagggccggggaaggagagtagggtatcctgcattcttggaaagggactgaaggctgcgggaggagggccgagctcaggtctcctacgggaagggggacctctctcactctggcccccggcctacccctcgagccgctgtccctaaggtctcacccccagagcgttacctcatgcccacattcttcagatctttcttgggggatggaggaggaggggcttcccatcccaccggggacccaggcccacgaaagcgcatgcctggcaagacctttccaaccaggggaaaatgcagtttcaagaatggccaccaggtggggcacacactctacacatggtgacacctgcagccaacctggattccagagcgcaggtggggctcttccgaggccagcagcccccagccaggccctccccaccataccacagtcccatgcaggcagagtgcaaagggccctaagactcagtgcaggtcccttcatcagatcagcaaactttttttttttttctgagacggtctcgctctgtaagccaagctggaatgcagtggtgtgattatagctcactgcagcccagacctcctgggctcaagccatcctcccacctcaacgtccccagtagctggggccacaggcgtgcaccactatgcccggttaacttttgtatcttttgtagagatggggtctcactatgtggcccaggctggtctcaaactcctgggctcaagtgatcttcctgcctcagcctcctaaggtgctgagcaaacatttttcagcatcctctctgggccagagggagaaaaggctgtcccctggccacacagcaagccttacctctccatctccttgtccacccttggggtttagagatctgtagctgggaagatccatccttcaggacctcctggggcctcctcggaggccacctgttggggagcactttgccacaagcccggttcttgaccctaagcagagagacagcagggtgtgagagagggacctggagctaagcaacttcatctgcagcctggctgtgtgagcttgggcaagggaccaaccttcctgagcctcagtttccccacattgaaaatgggaacgaaagcagttcttagaatcatagatgtttgtaagtgcaaagctggtttgtaagttgtaataaccagctccaaggtgatgtgagtgcctttgcctgtttagggagtcccaggtaggcagggctcctgggggaacgtaggctgacagcccagggggccaggcctggagccactggaggctgggggtccaccatgttctgatgccctgtctccttctctccccagggcccccggggcagacaggaccaccagggcctgcaggcccccccgggtctaaaggtgaccgaggccagacaggagagaagggtccagcggggccgcctggtaagaaaaccccccacatatgtgatgttgtcaacctgcggaaggggctgggctttcttctctactggaacaggcgaggtgtcccacgcacccacagccctgatcttgctgggtaccagaaaaacggggtcttttttttttaattttttgagagggagtctcgctctgttgtccaggctggagtgcagtgatgccatctcggctcattgccacctctgcctcccgggttcaagcaattctcctgcctcagcctcctgagtagctgggattacaggcatgcgccaccacacctggctaattttgtattttcaatagagacaggatttcaccatgttggtcaggctggtctcgaactcctgacctcagatgatccacccaccttggcctcccaaagtgctgggattacaggcgtgagccaccacctcacctggcttttttttttttttttttttgagatggagtcttgtgctgtgtcgcccagactggagcacggtggcacaatctcagctcactgacacctccacctcccaggttcaagcaactgtcctgcctcagcctactgagtaactaggattacaggtgcctgccaccatgcctggctaatttttgtatttttagtagagacagggtttcaccatgttggccaggctggtcttgaactcctgacctcaggtgacctgcctgccttggcctcccaaagtgctgggattacaggggtgagccacaacacctggccaaaacagggtcttcaggggcttcgggtacaggcatgagcatcgaggctgtcaggggccaggagcagttctcagccatttaaacacctccagagaccaccctctcaactcctcctgggtcctgccggggaaggacccctggttcagcaggtacagggccagcccaggatggtggcttatacttggtgttcctgccacagggctgaagtccctgggagggaccaatgggcctctggccagagcctttgctgatttcaccgtccctgcccccctcaccctcccaagctgccactaagtgtcccctctggactgggctgggaagggaagcccatttcatttacaccccaggacacccccaaggaagactgtggatcggaggtcaccactgactgcctgtgggcccctgaccaaccctgtttctttcaaggcctcagtttccccatttgtaagttgcagccacccgccaggctccggctgccacagtgactgttcttttcctcattgcagggctcctggggcctccagggccccgtgggcttcctggagagatggggcgccccggccccccaggaccacccggcccagcaggcaacccaggcccctcaccaaacagcccccagggcgccctctactccctgcagccgcctacagacaaagacagtgagtaatgcccctggggggccaagggagggctgagctacgctgtgttctgggagggatcagccttccttaaaggatcctgggaagtggaccccaccacatgcccatcctgctgcacccaactggctcactcctgcaggcctcctccaggaagccctccatgcagtgtccagggcctgccagtgacgatgacagggaacagcttgggagcaaggcttggtcctggggctaagcatcctcaagtggacccagggctagccccaagccctgcttttggccccaaagtggcctgtctctgcctcagtgctcagctccctgcctttggggttgtgagccccaaagttcactctgctggctgacttggcccagattccctacctggctaccccaccccaccaaggttatcccttattgtacttgttcctcacccgccctcactgcaggtcattcagcaggtgtttagtgagcacctactatgtgcaaggcacaggattttagccactggggacacagcaatgtgcaaaacaaactccggccctcgggggcaccggccagtccaagagagcctctgaacacacagaaatgtccacttctaccttgggaggtggggacaaggaggtgcagagagtggacgggaccaggactctgggcctaagggaccatgaggtagtgggaggccaggcagaggagtccgtgagccctgagaggagcatcatttctggttaagtgtcccggcaactggggaagatttttactttaattttttttgacatagggtctgttgcccaggctggaatgcagtggcgccatcatagctccctgcagcctctcactcctgggctcaagggatcctcccacctcagcctcctgagtagctaggaccctaggcatgtatcgccacatctaactaatttttttttttttttttgagtggagatggggtctcacaatgttgcccaggctggtctggagatgtggtctcactatgttgggcaggctggtcttgaactcctggcctcaagtgatcctccctcctcagcctcccaaagtgctgggagtacaggtgtgagccactgtgcccagcctggggaagggttttatgaggaaggtgatggcattgccctggggccctgggtctggttcaggattggccagggtgaatcaggtgaggggctcatcctggagggccatgggagatgggttgttaaacagactccacccctgctccaggcagtgtggtcgccatgatgtaatcagactccccaggcacagctcagaggggtgggcatggagggcttcctggaggagtgagccagttgggtgcagcaggatgggcctgtgggatggagcctggaagaagatgccagcctggggcattggagaagtgagcagggcagacccagagtctgaagagcctggaatgttctagaaggtatttatgttttatatgaagctgaccgacctggctttccctgctctttgtctgggcctctccgtgctcctctgagcagtgggggcaacagtatctgcagcgggccccagggtgatgggaggagcccccctgggcttcgtgtggcctggctcagggctcagtgccccggaccagcctcccagcactgccaggtctgccccaccagacccctggccgctccgctcttcccacagatggagactcaaggctggcctctgccatcgtggacacagtgctggcaggtgtcccaggaccccggggtccccctggtccaccaggtaagtgaatggtgggctggcctgcattgaggactccatccccccagggctggcctgagccatggggccttgaggggagctggaggtcggctggcggtccatggcttctgggcaatgctggggactgggtctgtcccacccgctgtgtggcaggaaatgaagcccctcgtttcctagtggcagtgcccctgggggactggatgcatgaaacccacgtgattctgctggaataagatgcctgcatgaggctgcccttgcatgggccagagtgggacacacaccagtgggggatggggtcaggacagaggtggcaggaagtccctacctttgaggcagaaaccaaggggttcaaaggggctgggacctggctgtcagtcctggcctgaccttccatcatccacattcctcattgggggaagaatgcagggctgactgccttgtccctttctgcccgggaagggagtcattcattcattcattcatttgtttattcactgattcattcattcttttattcattcatttattcattcattcgttcattcattcattcatttgtccattcattcattcgttcattcattcattcgtttattcattcattcattcatttctctgtgcgtctcacaaacattcattgaacatctgccactacatgtgccagacagtgatctaggttcccggaactcctgaataatcaaaacaaacatcatcgagaaactctcattctggtggaggacaggaatatcatcataaattgtgacttcgacaggatctgagggagctacaagggagaagctggggcgtggcggggaggcgccgtcaaaacgtgacatttcagaagatgctctagggaggagagggagtaagctcagagggtacctgggggccttcaggtgacatgccaggtctctggagaactggacagactcctgacatttgtcccctggagtgcctgtcctcacatgccctctccaaacctgggagccaggccatgctggacagcccaacatgcggctccctgcaccacagggagggatcatgagagaccctccctgggcccgtgtggggtcatgagagaccaagaccttactcttcctagcaggctggagattagtcatgaatctccctccctgagctgggcacacacatgagacccagcccggccctctgggtactccacatcccatggggcagacagacgtgtaaacctcagtggccatgggcggtggctggtttacataagggatttgcctggagaagcagtggaaagctgggaaggcttcctggaagaggtgatgctctgtgtcagactggtaggaaaaccagtaggaaagggtttgctgggagagtggaggaatagggaggctccaggaggaaggacagctttagcagagacgccaggagggtgtctggctggggcagggagggtgggaaggggccgggctgaggacttcaggagccctgaaagggatgtaactgggcttggatttttgagagtgtactcttgggggccataggaagggtcgatgatcaggaggctgttatagtaaccccagcaagagggatgggtcccaggtcccgaggcgggaaagaccggagagacgtaccaggggaccaactggctggggcgtgggagcagtctggacggacttcctcccttgcctgccgggtctcgggattggggctgcgtcgtggacgaggccctgggaggaggaggtgtgggagctgtgggcagccggtggagaggaccctgggctccgaggatggagacctcgttgagagggggtgtgcctccctcctccccacacca

SEQ ID NO: 481 - DNA, 11474 bp, Homo sapiens
gcctaacattttgggggatagaagaattaaggggaaaaaaaacttaaagcataaaactgatgattttgattaaaaatttcaagcattgattcttttcaaaaggagaaaaattcaaataaggtaacccttaaatagggtaatctttaaatacaattttcaagaaccatggagttgcagaccagaaagaaataatggatttgatattttcaaagaaatagatagtgcttttaagttcaaaaacctcaatgaagtcctattaaccagaagaatagtatagtaagaaaaatctaaattgggaagtagaaaatcttagcagactaataattagggagttctcacagaaggatcgatttattcacaggtaaagttttctaaaccttcaaggaaaagataacttccaaacatttccaaaatgaaagaaataactggaagctactctgttcgttctgatatagatatctttgaacgccatacctgataaaattaaacatactctcctcattccatagtatatacaataatgccccaagtaaccatgttttggtcaatgacaaaccatttataccactgtggtcccataagattataattgagctgaaaatttcctatcgtcatagcctttatgacactgtagcacaattccatttctttttataaattgagtgcagcctgaatgcattgtgtttacaaggtctacagcagtgtactgtaatgtcctaaccttcacattcacaccactcagtcacggactcagcagagcaactgccagtcctgcaagctccattcatgataagtgccctatctcggtgtgtcagttcttaaatcttttatactgtatttttactgcaccttttctatttatgtatgtttagatacacaaatactttaccattgtgtgtctgggattgtaagtagtaggctacaccacctaggagcaataggctatatatcctgtagtctgggtgtgtagtcggccctaccatctagggttgtatatagtagactacaccatctaggagtaataggctataccccataacctaggtgtgtagcacactacatcgtctagggttgtagtaggctataccatctaggaccctcaggctgtaccccatagcctagctgtgtagtaggctatgccatctagtccctgaattctatattgttgaaaacataacaaaatcacctaagaatgtggtttctcaaaatatatcctcattgttaagtataacacatgactgcgtgtcagattgttaatagcgagaagtaaaagctgtcttgttaccaaaagagtaatgtttgagactatcttactggtaatactgttttgcagtcttatccagtgtaacacaataaagaatagtaagatgcaacatttaaaaatgttgacctggggccagggacgtggtggctcatgcctgtaatcccagcactttgggaggccgaggcgggtggatcacctgaggtctagagttcaagaccagcctggccaacatggcaaaaccccatctctactaaaaatgcacaaattagtcaggcatggtgatgggtgcctgtaattccagccactcaggaagctgaggcagaagcattgcttgaactcaggaggcagaggttgcagtgagatgagatcgcaccactgcactccagcctgggcgacagatggagaaaaaaaaagaaaagaaaatgcagtgtgtaatggaggcacaagaaacggggcagtggaagaggggttaatgtggtatgtggaagagtcaggagcttttctttcaaacctgcttaaattatgacactcccctgtcctgtcccttggataagtttcttgataccattccatttcaccttgtttcttttcttttttttttttttaaacagagacagggaccttactctgttacccaggctggagtgcagtagcgtgatcatagctcattgtaaccttgaattcctgggctcaaacgattctcctccctcagcctcctgagtacctggactataggcacacaccaccacgcccagttaattttttaattttttgtagaagtggggtccatttcagttttcttattagtaaaatgaaatgctatcacttgacagaagtttttgtttaattacaaagaacccatgtcaatgtacagagcatagtatttggcaatcaaaagacactactcggtcctctcccattgtttatggtagtggataattgatgagaaaccttgatagaaaactaaacccacattttatagtaacataaaggcaataatggatgacgttaatccttctctgtccgccatcagaagatttgatacatctttgttgaggtattatatgatcgtcctctaaactttgaaataattaacagaaggtaagtcctgctgtgatggccatataaaagtttacttaaaccttttttttgtttgtttaaataaaaggcgatgtagatactggtagagcttgttgctcatgttacagaatatacagctttataaactttaatttctcaacaaataaattgactaagggtatagatggtttacagatgcggcgatgggaaagtgcgtagggaaacattcacgttctgtatcaagaatagcatttttctcattcgtagcttttatctgatttggcagggttgaagtgaagctggcattgtcatttttgcaactatcatggtaaactggcataatccctttggaaggcagttccctgataagtttttactgtacttaaagttgaagagatcttgttagagtcttgaggcttataaaataatcgctatctcagtgctttgggagtccaaggtggtacgattgtttgaggccagtagtttgaggctgcagtgagttatgattgcaccactgcactccatcctcggcgacagaacaagaacctatgaaaaaaaaaaagagcttataggtatatttcaggaaactgctgggctaggtttttcgggacaagtacttaaagaaggtcatgacagcgtttgataattgggcttgcatttgcattaggcactagtcattctctttttctttctttctttttttgagatggagtctcgctctgtcgcccaggctggagtgcagtggcatgatgtcggctcactgcaagctccgcctgccaggttcaagcaattctcctgtctcagcctcctgagtagctgggactacaggcacgcaccaccatgcctggctaattttttgtgtgtgtgtttagtagagatggggtttcaccatgttggtcaggatggtcttgatctcctgacttcgtgatccgctcacctcggcctcccaaagtgctgggattacaggcgtgagccaccccacccagcccgaaacagaaaagctttctaaagttgctgactcactaaatgtacccccgtggctttgcggtatgtttaagttgtataaaccaccccttcttgtcattttctatcctataattccttacctaatggattaagtggtgccagaactgaccctggagaatgcagatttttgatgcggaagtcacggaagttatgttatcttaagggaaggcctttgcttgttaccttttagtagtaggttacagttggtgatgccatggggctcattcctcacaaattgcaaaacttacatgtgctaataaaccttggccttcaaaagtagtaacctagatacaagtagttctccatgctctttctttgaaatttcctataaggactgctttccagcctggtgcatttccttggcactcaccgcattctgctcgctgagcccttttcccacccctgctctctccctggcttcccctcctgggcaactgctctcacttctcactgctgccactgtgctgcctttgcccggcggcccacctccggctgctcctgatgccccctcccagagccgccccttcagctgaaggtgataaagcatggctttccctttgtaatttgggaagataattttttttttttttttactgtttaaactgttaagggagttttttgccagtgatacatattataaaagacacttgtttgtctccaagtttttgtttttattttttcaagagaataaactggcttctgtccctacacagctgagcagtggttcctgattgtcctaaggaagcctttggccctaacctgtgtgcctcattggccacttttttactggcggcagcagcagcagcagcatcagtagttgagaacaccctaatctatcttttcctttctcttcttcacttctaactatagggaaaacgtccacagcgcacaaaggcagagttgcatcctaggtggatgtctgaccacctgtccatcaaacccgtcaagcaagaggtgagtgtgggtgagagtagcgaggaggagctttcctgatgaaagagacggatccttttcatgtacttccattcctgcctttttattttccttcattttttttcctaaaccccaaatgtttatttagcaatcttatgcttaagatacatttctagaaagagaaagaattagaagacgtgaggccacactctggttctgacaatctcctgggatggtaggcatgtccacatttaataagaatacgtactgcaataggtgcatgtataggagcagttcacaaatgcaaagatgggaggatgtagagctgggcaacggaaggagaatttgagtaggcagagccatatttgacctgaatcctgagatggctgggattgatggaaggggagcaaagagggtgggagaggtggggcagaaggcatcccacactacaggagtagtagaaacaaaagcacagagacaggaaattatataaatttatataaaatgatataaatatatatggtcaaaaaacagcatatattagagccaagcacaggtagctcatgcctgtaatccgagcactttaagaggccaaggcaggtggattgcttgtactcacgagttcaagaccagcctggccaacatggcaaaaccccatctctactaaaaatacaaaaattagctgggtgtggtggcgggcacctgtaatcccagctactcgggaggctgaagcaggagaattgcttgaacccaggaggcggaggttgcagtgagctacgatcgcaccactgcactccagcctgggcaacttcagagtttcactctgtctcagaaaaaaaaaaaaaaaagaaagaaagaaaagaaaacctgagagtttgtggcaagtttgttgttttgtttctaattggagatgtagcatggacctgaaaagggtccaggaatgagagagcgtggatctggctgatctgtggggagatgaaattcttaggtgtcaagacctcgccatggagggtagataatcacatttcttctaagacacaaagcaaaacaacataaatgggagggcagggaaatgtttaggtcacatgaaagagagagggcatcatgtgggagtttgagatataatgttaggtgaagaaagaatatttggtgcaaccactaattaaaagagttgtccaaggagcattctggagctgactgtgtttcggcattttcattctgtaatgtagctcaggagcctgaagcaggagatttacttgagcctaggagtttgagaccagcctgggcaacatagcaagaccccacctctgaaaaaaaatagttaaattactttatcacatcacatcacactgtaggaagggacaacactttttaaccgtttatcctttgggcactctttcatcgaatatttaaacagttcagtgatcgtagagagttttgagttaagggacagtagttttactctggaccatgtctttgaattgttacgttacggagccttccttttgcctttcagtaacattttcatggatcttaaatttgagtgacgacacgatgttctattacagagatcttgtcagtaactaaacacattctaccttgagccctgaaaagggaaagctaatttataaatttgtatttacttcagtatattttgatttcacatctgtctctttttaactcagagatgtgtcttgcccgatgtttaattacctgggggttgacaattctattcatgattgacctcccttctccagtatcctcttcctcctagcagtcactaatttcagagtggcctttggtccctggtattcagccatgttctcaaatggttttctagcctggccttgttgggctctctctgctgtctttattaccttgacagttcacacctccttgcaagctcccttttctgtttactgttcactgctctgagtattcctagatgccataacttaacacttcagactgcatagcaggctgaatagactgaaacgtccttcattgctccaagcaaaactttggcatcaaacactaaaatttctttttattcttggcagtgtttgagctttcttttattctactcttcagttcgaacaaaaagaaaccacagtattacagagactgtaaactatctgttgtggtccccgatatcctggagaaacccttagtggtgacatgactttttaagcatggaggcagggtttctggcctctattggtcactcagcagtccaaacttattgcctgataaaagactttgagttgtgacttcttggggaaaatatcagtgaggggagactgtctcgctgaactcagggattcgggatgcagtggttatttttgtccggacactttggtcattgctgttgctagggagctgtttgttgggtgttcgtctcaaatgtgctgctaacgggagcaagggtgccagcaagtctgatacctgccctcagagaggggagcgtgtaagggcacagcatgttgggcattgcttaaaccaggggttctgttgaatcgtccttgactggattttaaagtgttgtttctcattagcttctcattaaaaacccccttgattctagcaggactcttatctgtaaagcattcctacaccaacatctctaccatttgcaactgaccccaccttttaaagaaaaaaattgcagcctaagacagtatcacatttttgtaactgtgcaggtttatttttgcttggccagttgtcattcatttggttgtactggttctttaatagttaaaacactacaaaaagtgagtcctgttttttagtggtgttttcatcaagacttgctttaccttgcatcagcctagtgctgaaaatcagcagaggaattttaaaacagacttgtgggccaggcgcggtggctcacgcctgtaatcccagcactttgggaggccgagttgggcagatcacaaggtcaggagatcgagaccatcctggctaacacgatgaaaccccgtctctactaaaaatacaaaaaattagctgggcgtggtggtgggcgcctgtagtcccagctacttgggaggagaatggcgtgaacccgggaggcagagtttgcagtgagccaagatcgcaccactgcactccagcctgggcgacagagcaagactccgtctcaaaaaaaaaaaaaaagaaaagcagatttgttgttcacaacatagattttttttttctcatatgtgtgtaatgtcatttaggtaaaattgtaattgttgagaattcacatcagatgggaaactgctaaaatggtaaaatggtaacccatgctgatgaaagaaaaaaggcccagagaaatgtgaggcagacatattcagctaagcaggaggtgtttacaagtgcagggccgtgctggaggagggggcagattgtggagaaagtggtctgagacaggtggagcaataactagggggacagatggcatccgcaagggcaggagccacagctgggcgtggccggtgcaggctcccacctgcccaccatgtctttatagaaaatgtggagactacatgtagaaaactgtaaaagacctggtaatcccacaactcaggaatcattactatttacgtttttacgtatttgcttcaggcttttcctctatgcatttattgcatattgagcattatatttaagatactttgtgatcagtatatcgagacattcatacatttcaagaattgtttaaattctgatacccagatttaagcatgtgaacatgtgatgagatttttaagcatacaataaaagctgtttataatttgctgcactaccaaccttttttttttttttttgagacggagtctcgctctgtcacccaggctggagtgcagtggcacaatctgggctcactgcaagctccacctcccaggttcaagccattctcctgcctcagcctcccaagtagctgggactacaggcgcccgccaccacgcccggctaattctctgtatttttagtagaaatggggtttcaccgtgttagccaggatggtctcgatctcctgacctcgtgatccacccgccttagcctcccaaagtgctgggattacaggcgtgagccaccacgcccggccagtaccagccttaaattagttactttggggggcctaagtcaaatggtttaaactgtgagcctgttgaacatacctaaggaataccttcctatattatatatgtatgtgacttcttcgtgtaaaggttttttcacttgaattcctatgttacctggctctggaagtcactactcaggagcttatggtccaaagaggagagggacagataaccaggattgatcaaaatatagagatatatatatatggatatatatccatacacacacacatatttacagttatgtacatacatatacacatttattatatttatatgtgtatacattttatatgtatatatacatatatacatgtatgtacatgcacctgtgtgtacacatggatggcacagcagaagggaacacaaatctcgaagtgcaagccctcaagaagcagcatattacgataaatcccttctttagaaaagtattgatatggtttggctctgtgtccccacccagagctcatctcaaattgcaatccccacatgtcaggagaggggcctggtaggaggtgatgaatcatgggatggacttcccccttgctgttcttgtgatggtgtgtgagttctcaggagatctggctggtgttttgttttgttttgttttgagacggagttttgctgttgttgcccagactggagtgcaatggcaccatctcggctcactgcaacctccgtgtcctgggttcaagctattcccctgcctcagcctcacgagtagctgggattacatgcacctgccaccacgcctggctaattttgtatttttagtagagatggggtttctccatgttggtcaggctggtcttgaacacccgacctcaggtgaaatgcccgcctcgtcctcccaaagtgctgggattacaggtgtgagccactgcgcccagctgatctggttgtttattgttttttcggggtttttttgagacggagtctcactctgtcgcccaggctggagtgcagtggcgtgatctcagctcactgcaacctcggcctcccgagtagctgggattataggcgcctgccaccacgcctggctaatttttgtatttttagtggagtcggggtttcaccatcttggccaggctggtctcgaactcctgacctcgtgatccaccctcctcagcctcccaaagtgctgggattacaggcgtgagccaccgcgcctggccaagatctgggtgttttaaagtgtgtggcacatcccccatcgcacatgcgcacttgcgctttctggctctatcttgcttcgctgtgctaagacgtgcttcctttcccctcaccttccgccacgattataagtttcctgaggccccccagtcatcctttctatacagcctgtggaattgtgagtcaattaagcctctttgcttcatatatcccagtctcatgtagttctttatagcagtgtgagaacggaggaataccggtatcatttctaccactgataccacaggttaagttatatattatgccatcttcgagtaacacttgaagccacacaataaatgcaaaggcattacaatgaatcccacttaatacaaataactatatagaccaacactgctctacaaatttagcttgggtctttttctaatggccggttaaatacagttttaatttcgtaggttaatggtgaaggttcatacactgaagccagtacgtatacctagcattgcttttcagcctaaacttatccacgtacacaactcagttacaaggcttggccttaaaatgctaggagagcttcttaaagtagtttttacaggtattaaatttcgtcttgcacaccgaagtcatcgtacataacagggcaaagtcagagtttttatcattgcgtttattcttcatttacctttaaaacacttctctagctgaatatttaaagcaataggaagcagtgagcatattatggttacaggccttcactcagtcactgttgcagataaaatgccagcagtgagtgttactcactggcccagttaagggctttgacactgaccacctcttctggggagatggtgttccttgccctcatatgcttctccattgtaatgctgccatctttgctgatttgcctcagagcccaccagttctttttgatcatcccatcagtctcttcttcctttctaccaggtagaagtttttccagcaaagagagtttattaggagagagagccattctgaggagcgtttacataaattaagtgattaggcgacgctttgcatacggtgtgcagtaaattggcattccttcatttagcacacacttgatgtccccgtgcttgacattctgacctggaccatggttcagtcttgaaagcagatgttagcgtttgggagtcacacagtgtttcagccagctgtgtgtctgtacacaggaaaaggtcttctccctgtcaagtaaaaatagcatggtctttctgttctaccccagtggtaatgtttcctggctccagttctggtcttggtatccttcaccacggaatgttatcttctggccatctttcatgcctttgtcaatagggacttctagaatctccttctctgcaactgtcttccttccattgcagctttcacgtctatctttaggacggatggtttccccatgggcttggcactccatgcacacagattgaatttgctgaaccattccaggtcttattgatgaattactgtttgcattcaagcacctcagcagttggcacagcaggatcctgctcccttcttaacacctctgccttcacatttgtcacaaatcatattcttttgcagagccagttttcttttttcaccattggatagatctcctaaggctactgagagctgatgtaggagtttttacctctcctttctcttagtatccttccttctcccccaaaaaaacttagcagagatgtccatgggggaatgagaactgccaccagccccaccctctttaattgcctgtcctcctttgtcatagaattccctattctctgcatcagagagaacttctcaagattgagaaatccatttaacttctctccttcatt

SEQ ID NO: 482 - DNA, 11542 bp, Homo sapiens
cagtgtaaggggaccatggacctagatcttagatctttgacttttcatcgaaaccctctccttcacctgcccccatgccccaaacttactgtgctctagggtcctctggtggggctgttctggagggatccccggctccagatagcgtgcctgctccatagggagcggcctttccatagcaggccccctccatctgtcctggcctggctgaaggcctccaagtcgaggtctgctgaggacatggtaggggccacatctttgacaaggttctttggagagaggccctccccacaattctgctccaggacccaggggcaccaccacctctctccaggagtcccaccccctgctccctggtctccttctggacccacccctgactccaccctgcctcatctgcctaccctctgggccctcttgggtcccatctcagtctctgaggacagtctctagtgccctctgggcccagccccttgcctatgcccacctctgtcctggctcctcctcagtccaggcccaggttggttgggccacaacctcctgggtgccccaagatatggggtcagggtctggcccccgaggctgagctgggaggccccataggtgggctgggcagaggctgcctacctttgctccagctcttcctccagagccttctgcaggctggtcttcagtcgctctgcctgggaagcagcagtcaggcaggctaagtgtgtgtgtgtgtgtgtgtgtgtgtgtgtgtgtgtgtggtggggtgatggtcgatgaaccccacccctgaccaatcacccccgaccactcacccccacttcctggcactggaagagcagagtgctagtgcctggcaggcccggctcctgcacggtgatggacaggatggagttgtaggaacatgtgttgagcgccacattcatggcctggatgctgtctaggcggtaagagtccagctcctcctgggccaggtggagaggtcaactgtgaggccaccagagctaggtgtggcttctgggagctcctgaccagctcatcctagccctttggtggcctagggctgaggtgtcatctacctgactcttgtgcctctgtccccagcctctgtcccctgtctcttcctaggcttgggtgtgtgttgtatgtggggagagtggctgccctttggggcatggagggtggagttcaagagctagtgcttgcttccccacagcccaggctggctatcactgggtttgctgggaaggctgaccttggtctcaatgtccagcagctgcagccagccgtccctgacctgcaggatcaagtcttggctccacacccggccctgtgcatccatctcgaacagcttctgcaaggcatcctcgggcccctggactctctgactcccctgcttgcatgtcatcaagtgctgcagggagagggggagtcctaggactgggagaaagctcagagaggtggaccacaggcgtgctgggtagagaaaagcagaagaggaagaagacgtgtcctcggcccccttgaggtaggaggttccaggcttcagataaagcaactttccagggccaatgtgagggacggtgtcgaagcactggggccagggatagggcctccaagtctgagtctgaggggctgcaggaggggtttgaggactctggaggaaggacaggcatggcctttactagtccaggccaggtgaggcagctgggtggtggaggatgtgggctccagccacccaacaaataactcctctggaggtgatacaggaccctcagattctgtccctggcttcctttgttccttttgggaactcagtcccagcccagtcttcctcctcactcacccagcattcctgtctccttctccctggttcatgcctggagatatccatcgtgatctcagtctccgctcaagtccttgcctactgctaggctgaccatccaggagttttttgctgttatccactctcctttaggagccccctcccttctcccagccaaacattaccttcacaaggccccttccacccaggcttcttgtggtagggagatgcagcctgcctcctgccctttgaccccacccccctgcccagggcccagctcttctccctgtgttcgcactgccagcatattcaggggactctggcatcatgagcaaactccatcctcctcttgctctgcctgctgggcctaaaagaagcctcttcccagcctccaccctacagagaagctgagtcctcctggcctctcctcggctggctaggggagctctgcctctgctgccctgtgggacctgctgccctgtgggacctgcagaccatcgccccagctccctccctgcttgttctccattggagccactaacaagtggtggccaggacaggatggcttctaccccagagctccagcctgaccctctgcctgctctccccaccacgcccttgtagcctgtgcttcgccttcaccttggtgtcgacagcccttcaggcacctaaatcttgcagtgcctgcatcatcctccctggtagagccagagactccattctagccttggagcagcctcggagctgctcacagtcaccctggaggcttgggcccaggtgcctcccctctccaacagtggccctctcaatcccccacagggcccaaagatcccaaagatcccacacactcctgcctccagccatgcaaggtcttgggcaatggagcagtgccctggggactcgggcagcagggggttgggagacaggggagggtaggtgggtgggtggttgtaggtgcttcttatcccatcctgctgctacttcttcctgtctggggacaggacactcacccgctcaacctccagccaggcctgctctgttcaatctgaccacccctccccgtccctgacactgagcagatgctctggcaggcttgttggatctgagtccatgcgacatggttgggacaggctgttggcttctggggcagggacttgtgtgaagtgtccatgttctggcagggcggtgggcacatgggaacacttgggtttagttggacactgcccgggggctgcagaggtactcacctccaccctgtgctgcaggagggtgggctctgaggtgaggttctgggagtactccttccggtgcactacaagggcacagagcaaggggcgggaggtgggcagaagaacgaggtgagactcaggcaactgctgggggcagttggtgtgaggaagggggagtggaggatgggacattctgggggctcagtgggagggcacgggagaggggcctgccaggagcttacagtaaatggctctgctgctgggccttgacatgttgacgctgctgaggacggctccctagaacccaaagtgaaccagaggcagccatcagagctggggaaaggtgtaccaggcacagcagggcaggacagttgctattgctctgactgggggcctctgggaccagacccaaagcccctggctccaggggccctttccggagccatctgcagccagcgtcctccactgaggagccctccatcctggctgggcctggaggccccgggctgagggaagggagggtcagggaggccacagcatggctgggcctcagggaaggctccaggcctcccatggtttggctgataaagctcatgccaaggagcccaggaaacctggatggacagggacctgcgttcagatcctatcttgggcctgggtatgaaagatgctggatgagcagagggttctgtagccgaccccgccagaggaggccctcttgttcgaccctgtttcagttctgcaaactgagaggacgctgatgctggctcttcagctgtagaccctctgggaagactgcatgcatgtgtgtgtgtacttatggtggcactgcaggactcgccagtgagctgacctcccccaagtgtctccctaggcctcctggctctttgctttttgtactctgtatcctctgcccaggtcccctcctgaccccaaccctttaaattctagctcaaagatcaccctcttggtgaagccctcctggaccatccaaccccaccctgcccagggtaccctcctaatgctgcactggaccttgtacatttatctccagcaacaatagtcacaatagccaccacggtgctgtgagcctggtgctgagccccttaccaacatcctatcagtttctcctcactgccgtccacttgtacttacttggcgccacgtgcctagcactgttctaacggcgttaccttcagtcactctaatcctcaaaacaacctcacaaggcaggtactggtattgtccccatttaccatatgaggactctgaggctcaaagacggtaacaggcctgaggtcacaaatgaacgtttaatagagagcaacccagatctgtccgattgcaagcttcgtgttttaatggtttataaacatgcctctgccgctgggctgtgcgcagtcacagagggagtctagagaacatacatgttgaaatggagtggaattaaatgtggtgtgtgtgtcccgggtgggggtggtgttagtctgtgcgggtcaagggtatgtgttatccaaatgaggtttgtgggtatccacatgtctacatggtacacctcagttgtgcagaaatactggactaccccgggtaacatgtgagagagcaacccatacccttgtttattaggactgttgtgaaaatgacgtaggatctgataagatgactcagtgtggaaggaaataaactgccagtgaacaattaagggaatgtggaagggacggctggatctctggtttccttgtttgggaggaccccttttctctccaggggtaaggcggggctagaagcctgttccccttccccagcctcccccaacccccattgtaacacttcctgcttctccatgctctccatgcagaagaggaagtgaggtctgcccctggtcagccccactccccactccctcaacaccagggtgggccctgtggggccctctaggtaggtaggtcaaggtggggaaacagctgcagccaaagattccctaccccagggagggaagagggagctggcttggcctgccttgccccttaggggtaggggagctgtgacagcccatttcccccctttaagccctagatgtaggggtttggagcagggaaggccatcacctcatagaccctggggcaagcatcccagaggcccttccggagcctggacctcgctctgctttccagcccaccagccagctgctgagtcccaagcccctccttgggcttgatcccctgggctgcagctgggaacaggctggagacctggcctgggaagccactgagttgcccccacctgccctgagatcccctgtgactgggctgggccccgatcttccctgggggccaggcccttacctgggtgccagtgaaggccgggtgcctggtccccccaggaggctggtcttggagcaggtggtccggtgctggtggtggaaggacagcagcttctctgctagtggccacaggcagagcctgcctttgatgaggttacagaggcagccacgcctgtgctctttggactctggtgggtggggaggcttcctggtcactaaccgctcaacatcaacctggacctgcggcagtgtctgtgctgactggcgtccccagcttagctagaggcccctgcttccctgtttcccccactgctagccttggggtgtggccccctcttccctctgccttttaggtgcctactctggggaacaggtcagcatcaggcacggggctgggaccagaagaagagagcacacatggcccagagtctgggttctgtggtgagggcacaggtcggctggaggtggactccaggcttgggggaagctgtgggctggcgtgtgtgccatgcctgtgcgtgggtggcacccataggtgtgtgatcctgtgtacctgggtggtgcctgtgagcaggacatggatcttgtcacagaagatggggactgaggcccctggggcattacatggagcgctgagattccctctggcagggccctcattctgtccctactgttgtcccttccagcaggagcccccttaccagccctttctcgctcttccactctctttccttctgtaccccatcttgtgcccagacccctggtggacgcctggccagcttcagcaaagatggaaaacggaggcctgcatctatctctagtcataaacctacccacttcctgcactccatggtatcgaaaaatctttcttggcactcagagtgggccaggctcccctgccctctgggaactcacagtctaaccaacaaggccaggtataaacagaaaccagggagcagggcaggaggggaggcgggggcgggggagtgccagtgagcctcggaccctcgtgggcagaatgcagggtcccggtgctgggccctgtgatggagtgtcctgtggagtctgagggctggagcactcccatctttagcttccctggaactatcccaggatatctcagccttctctcccatcaccacccaaccaacgctgccctggatggcctggagtccatgcgtcagatcctagggaggtgccttccctgtctgggctgtgtgtgtccctgggagagtccagtggacagccagctgctggggcccagggatcaggtgcctgtgaggccagcacccagccacagccccatgggaagcagtcctggggttctttcccctgggtccccatcttgtggcccttcagcttcttttgggatagcacagcctgtcccctcgttgcctcccccaactccgtgaaggccacagtcatatttcaccccagccctggcttggggctcaggcaacacctcatttctgcccagctcaggccaggcccgtccttcccataggaccctccccaagtcagtgtgagcacagcagggactcctgggggggctctggggcaaggtgggcaggggcagagaaacaatgagtggcattcccagcaccttgccctctgcagtgccctttaggggtgcccctgggagcagtgtgtgtctcctcagacataaagcctttgtggccttggtgggtctggggcttggggccaggtattggggacatctgcttctgtggagccccctgagggaagagggaaatcaggaaagagggagaggccaagcttcccatacctggggacttggggccataactgaagcttctgcacaaagctccgggtgccacagcagctcttctgcaagggagttcggctgaggcaccaggagctgggacttaggttggaggggaaggaagcaggactcgaagggcatgtccttgaaattgtggggttaaaaggctgtgggaccacattcgttcattcattccacaacttcctgtagaattgagggcttcctgcctgctaggcactgtgagaggtgctaggatccctctggagggcttacagacaccttggaattcaagctgagttcattatttctcagcaaaccatctcccctctcatgctcccatctcagggaaggcatcagctcccaatcgtgtgttccagcagggaggggagtcctccctcaatcctcacacccaatggactacccttcctgcagtcccagctctgtggcaagtcctaagtggcccccttcctctccaccccactgcgactgtcttcctcagaccccattacacctcctgtcttcgaccctgcggccgtctcctcacccacgccctcgcttcactcttgttctcattgatccttactggttgctggtagggaagctttcttagctggagatttgattgtccactcctctgcctaaaacccctcagtgacttcccgctgctcacgggacaaaacctaaactccttctcagggcagttgaagtccttgatgaactcaagtctcctgcttctgagtctggccttatcttccccccaactccctgccccttgtactttatactcggcttggggcatggcttgtaattccttgaagggtcacaccctggtaccaggctggctgctgttctctgtctggcatgccctgtggacacgctatggctttatgtctccagtagccctccttcagaagccttcccactgcccagggctggtggggctctggcccgtggcttccagacacgttgtacatgtgtccctctgttactgcatgtatcacattgagggggatacccccatgactggggtccctgtggggaaaagaaagagagatcagactgttactgtgtctatgcagaaaaggaagacaaaagaaactccattttgatctgtacaaagaaaaattgttctgctttgagatgctgttaatctgtaactttagcccccaaccctgtgctcacagaaacatgtgctatattgaatcaaggtttaagggatctagggctgtgcaggatgtgccttgttaacaatatgtttgcagacagtatgcttggtaaaagtcatcgccattctccattctctgttaaccagggacacgatgctctgtggaaagccgcagggacctctgcccaagagagcgtgggtatagtccaaggcttccccccactgagacagcctgagatatggcctcatgggaagggaaagacctgaccatccctcagcccgacgcccgtaaagggtctgtgctgaggaggattagtaaaagaggaaggcctctttgcagttgagatgaggaaggcctctgtttcccgcatgtccctgggaacagaatgtctcggtgtaaagccgactgttcgttctattctgagataggagaaaaccgccctgtggctggaggcgagatatgctggcagcaatactgctctgttactctttgctacgctgagatatttgggcaaagagaaacataaatctagcctacgtgcacatccgggcacagtaccctcccttgaacttatttatgaacagattcttttactcacatgttttcctgctgaccttctccccatcatcatcctgttcaccctgttctcctgccacactccctttgccgagataatgaaaatagtaatcaatacatactgaggaaactcagagaccagcaccggtgcaggtcttcgcatactgagtgtgctggtcccctgggcccactgttctttctctatactttgtctctgtgtcttcttttctcagtctctcgtcctacctgacgagaaatacccacaggtgtggaggggcaggcccccttcaggtccctgaggacccagattgttttctgccactgtctagaggagagaagggcttgtaaacaaaagcactgtagtatgcaggcataaagaaccttactcggcttgggggtgtcagggaggacttctcagatgaggaaatgcaagggctggcccttcaatgacacacaggagttcagccaagaggtgaagtgggcagggaattgcaggcagagggattgcagtcctactggatgaagcggcctggggagaagatgggtatggcgtgaactgtgtgtgtgcacgcgtgtgtgtgcatgtgtatgtgtatgtggcggggaggtggtggcagatgacagcatatgtgtgccgtcatcacctggtggtgagtagagccattgaatggttttgcatggagatgcaacaagaaggctactgggtcttctgtcttgtggaagacgctgccgcttgctggttctcagcatataaagagacccaggtgcacaggctttaggctaaggggccaaggagcccctcccaccaccctggcctgggccaagaagcagggtgggttccttggaagctccagagcaggccctggtcagagctgggaaactctggagggctctgaggaaaagagctctgtgttcatggatgaccatgcagggggtagggcagggccctggcattcagaggtgaatgggtgccgcctcacctttagaaccagaccccagagcagggtccagccagcacctcttgctggtggactgcatggatgaggcagcctcaatgtcaatcaggggctgattgacaactcttcttcccaggccgcttcatccagtaggactgcaatccctctgcctgcaattccctgcccacttcaccccttggctgaactcctgtgtgtcctttaagggccagcccttgcattccctgagtcatggtggtcctgtccaggggctgacacctggccctggggctgctggggaatcacagagacagctcccatccctgcccctgctttccccagccctggcacaggggtaagtggcttctacgagccaggtggagacataaacaagagagatgatgtccctccctcgcaactaacctgccaaggtagaagaaacaaatgtatctgaagataatcaaggtcctgacaagtgacaagagagaaatagagtgaagtggatgatggcatgggggtgggagggtgtttggaagcacgacgtcggagaaggcttctctgaggaggggagcttcaagctaagccagggatgggaaggagcctgggagagggggccagcaatgtgaagggcttgcagctgagaaggaacgagctggcggagaggtgaccgaaatggggtggacaggggccagagcacacagggctccgtagaccatggccaggagcctggtttttattccaagggcagttggaagacacggaggggttttaaatggaggagtggcatgattggatttatgttctagtcacaactctggctggggtggggagaatgggctgtggggggagtgggggcggactcagggagaccacaagcagctgctgcagagagggtggtgaggcctggacatggcagggcagtgaggatggagacttaggctgcaggtggaacggatgggacatgctatggattagaatgggggttgagaggggaaaaaggacctattaggactcaggtttttggcttggacaactgggagggttatggtgacatctggtgagatggggaaaccgaagagaagagggattgggaggcagggggatatgaagagttactgttccattctggatggcctcagtttgagaggtgttttgggcctctgggtggaagtagcaggaaggcaggggcaggtgtgagtcagaagctcagcagagcaggatgaccacatgcaggcattcagaagcatgtggagaaagatgattcaatgatgcggggaacgtttgcagtgtagaagacagtagatacttggcagctgtaaatacacgaataacattcagagacctaagactcacgagaccacatgcgggaaagtgtatagataaagagaagggggctcacgactcaacccaggcgctccaacattaagagattgggaaggatgaggggagactaaggggctgccagtgagcagcaaggagagctgggaagagagtgtttcaggaaggaggggtggacacctgggccaggtgctgctgggaggtggaggaaaggctaccatctgtgggtttgcagtgggggctggagccagctggggacggctgaagagtgtgagggtgaggaggtgggctgtgagtgagtcgccgagtgtagacagtgggcatgggaggctttgctggggatgggatggtgggccaggga

SEQ ID NO: 483 - DNA, 11620 bp, Homo sapiens
tgcaggctgagaatatctgtgtaacatctgtaaatgtttatgttattcattcttcaagagaaccttcttgggaaaggatcctcattggtatgatgattaacattttcttcatttgtattcctgtgctgtatttattaacgggagggcatggtgtaatctgcgaatcctctctgtgacttataaatgagacctttcaggaatattacatatctttgtccaatagacatttattaaacttaattgatatttcttggatttcaatttttcagtagatgcttgataaaatacagaagtaaataaggtgataggattctcccactccagtagtttttttgtttgtttgtttctttttctgagacataatctcactctgttgcccaggctggagtgcagtggtgccatctcggttcactgcaacctctgtctcctgggttcaagccattctcgtgcctcagcctcccgagtagctgggattacaggcgggtgtcaccaagcctagctagtttttgtatttttagtggagacagggttttaccatgttggccaggctggtcttgaactcctggcctcaagcaatccacctgccttggcttcccaaagtgagctactgctcctagcctgaccccagttgtttttaaattgaattttggaaatcttgtagaaaatctagaaaacagtaaagattagaaaagagaaactttaagagccgtttaaattattatttaatccagagagaagaaaactcttcaagtatatagaagtgttatgaaagaatattctttctatagaggatgaattaatagtgttttactcaataaatatttgattatcttctgtattctaggcatcaaggataaggtggtgaaaaagacacacaatccttgtctttattggagtttattgtctagtggggtataccatctagtaggatagataacagtgaaaaaatagttacataagtaattagcattgtgataagaaaatacaagttgtggccgggtgcggtggctcatgcctgtaatcccagcacttcggaggccgaggtgggcggatcacctgaggtctggagttcgagaccagcctggccaacatggtgaaaccccgtctctactaaaaatacaaaaattagccaggcatggtggcatgcacctgtaatcccagccacttgggaggctgaggcagggagaattacttgaaccctggaggcggaggttgcagtgagccaagatcacgccactgccctccagcctgggtgacagagcgagactctttctcaaaaataaataaataaataaataaataaaataaaataaaataagaaaatacaagttgtatttaggataaattctaaaatccctacataatatctcttgcttacctctccagtctcaccctgtgtttttttctccttttctgtatatttaactacactgtcagtcttgacccccatactagttaggccccctgttaataacttctcacagtactcctacctctcacagtgtttataaaaagcttattgtataattggttattaaatacctgtctttttggccaagaattgagccagtgatgatcatgttttttcttcaacactcaaaaaagtttttgaataaatgactaaataatggtagttattactcttatttttttgacaaataagattgtttatattgaaagtatgcaatgtgatgatttgataaatgtacacattgtaaagtgattaccacaatgaagtactttagcacatacatcacctattgttaccattttgtgtgtgggggatgagaacacctatgacttactctcatagcaaatttcaagtatatgatatagtgctattaaatattattaccatgctacacattagctcagcagaatgtattctttttaagcttgtaccctttgaccagcatttcatttcctcctctctattctggcccctggcaactaccattctattatgtttctatgtgtttggctttttttttttttttttttttccccaggtaatgtttttatttttatttttttattttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccacgtctacttctttctacacagacacagcgaccatccgatttctcaatcttttcccccaccttttccccttttctattccacaaaaccgccattgtcatcatggcacgttctcaatgagctgttgggtacacctcccagacggggtggtggccgggcagaggggctcctcacttcccagaaggggcggccgggcagaggcgccccccacctcccggacggggcggctggccgggcagaggcgccccccacctccctcccggacatggcggctggccgggtgggggctgacccccccacctccctcccggacggggcggctggccgggcgggggctgaccccccacctccctcccagacggggcggctggccgggtgggggctgaccccccacctccctcccagacggggcggctggccctcacttcccagacggggtggctgccgggcggaggggcttctcacttctcagatggggcggctgctgggcggaggggctcctcacttctcagacggggcagccaggcagagacgctcctcacctcccagacggggtcgcggccaggcagaggcgctcctcacatcccagacggggcggcggggcagaggcgctccccacatttcagacgatgggcggccgggcagagacgctcctcacttcctagatgggatggcagccgggaagaggcgctcctcacttcccagactgggcagccaggcagaggggctcctcacatcccagacggggtggcggccgggcagaggctgcaatctccggcactttgggaggccagggcaggcggctgggaggtggaggttgtagcgagccgagatcacgccactgcattccagcctgggcaccaatgagcactgagtgaacgagactccgtctgcaatcccggcacctcgggaggccgaggctggcagatcactcgcggttaggagctggagagcagcctggccaatacagcgaaaccctgtctccaccaaaaaaataagaaaaccagtcacgcatggcggcgcgcgcctgcaatcgcaggcactgggcaggcggaggcaggagaatcaggcagggaggttgcagtgagccgagatggcagcagtacagtccagcttcggctcggcatcagagggagaccgtggaaagagagggagagggagactgtggggagagggagagggggagggggagggggagagggagttcggcttttttaggttccacatgtaagtgagatcatacaggatttgtctttctgtgtctggcttatttcacttagtataatgccctccagccacatctgtattgttgcaaatggcaggattttccccttttaaaaaatttttaattaaatttttatttttatttaaaagaaataggaggtctcagtgtgttgcttagactggtctcgaacttctgggctcaagtgatcctcccaccttggccttccaaagtgctgagattgcagatgtgagccaccatgcctggcctgagccactgtgcctggtcccctttttattgttgaataatattccattgtgtctatatcacatttttttatcaatttatccatcgatggacaattaggttgtttcacccagcctggatgacagagtgagactctctaagaaaaaaaaaattgaaaaatcgaaaaacagaaaaatgaaatggaaagtaatcagtattgttaaggatgtggataaattggagccctcatatattgctagtgtagccactgtgaaaaatttcactagttctttgaaaggttaaacatataattaaccgtatgacccagtaattctgcccctaactatgtacccaagagaaataaaaacacaatatgtctttacggaaacttgcatatgaatgtctgcaacagccaaaaggtggtggtaacctaaaagttcattaactgatgaatagagaaacaaaatgtggtaaatctatacaatgaaatttaatttagccatgtagagaaatggcggaccttgtaaacattattctttgtgaaagatgaaggcagataaaaagccatatgttgtatgatttcatttttaccaaatgttctgagtatgtaaatctagagagacaaaaatttgattagtggttgctgggactggaatggcaagaatatgagcagtgactgctatgaggcacagaatttctttgtgaaatgatggaatgttctggaattagtggtggtggttgcacaacatgatgaatatgctaaaaaccgcttaattgcatattttaaaatggttagttttatgttaattttatctcaattaaaaaaattgtaagaagagaaaaagaggccaggctcagtggctcatgcctgtaatcccagcactttgggaggccgaggctggcggatcacgaggtcaggagatcaagaccatcctggctaacacagtgaaaccccgtctctactaaaaatacaaaaaaaaattagctgggcatggtggcgggcacctgtagtcccagctacttgggaggctgaggcaggagaatggtgtgaaccagggaggcgaagcttgcaatgagccgagatcgagccactgcactccagcctgggtgacagagcgagactccatctcaaaaagaaaaaaaaaaaaaaaagaaagaaaagaaaaaagagctaagtaatttgcccaaggtaatacttggtcaagatccaagatgcagatcttttctggaagccaaggcccatctctagtgcatgctgccacctgtggtagtctgtagttactgtcagtcaccaccaggtggcagtattgttgaatagaaatgaatccagtggaagatttgtggctctgacctgcattgccttttgacataagattaaggagtgttaaaatcggagatgaattttttaaaaaagagagacatctggaccttatgtcccttctggttgaaatatacactgctacgtacgaatcatttttgcctccaaatcaaactaggagcagatcaaacctttagaactgactaccattttatagggatttacaggggacagaggaacatgttaaacaacaccatggggatacagtcagcaaaattcagattgtgaaaatctaggataggctgggtgtgatggctcatgcctgtaattccagcactttggaaggccgaggcagtcagatcacttgaggtcaggagtttgagaccagcctggccaacatggtgaaaccacgtctccactaataatatacaaaaatattagctgggcatgatgtctcaggcctgtaatcccagccactctggaaactgaggcagaagaatcgcttgaacccaggagtcagaggctgcagtgaaccgagatcatcccactgcacttcaacctgggcaacagagtgagactctgtctcagggggaaaaaaaaaaaagaggaagtctaggataaatgatccaatttttttcaataaattgtaaagaaaaacaccaggggaggggaaaccttgttacttaagaaatatatcaatcaaatagaatgtatagacttatttcaatcttgatgccaacaaattactgtaaaaacatatttttgagataattgggggaaattttggaaactaatgatattaagggacttttattaattttataagatatgatggtgccattgtagttatgctttttaaaggagtccttatcttttatgaggtatgtactgaaatatttgcagttgaagtatctggagtgtgctgaaaaatgagttaaacagtcctttctaaggcgttaaacagcaagaacagcctgtatttgggaaacgaaacatatacattacttcatgcaacaaacatcctttgaactcttacttgaggcatgtgaatcaactagagaatattttcagagcaataagtgaactattagcaggtgataatcgtataaatgactgacctaagtgataaggggagccatagtgaagagtgtgagttatgattagagatttagttgggctttttttgtaagtaaactttttctttttgagatgggagtctggctctgttgcccaggctggcagttggttgtgaccttggttcactgcaccctccacctcccaggtgcaacccatcctcctacctcagcttcccaagtagctgggactacaggtgcgcctcgccatgccctgctaatttttgtattttcagtagagatggggttttgccgtgttgcccaggctggtcttgaactcctgagctcaagtggtccaccttccttagcctcccaaagtgctgagattacaggcatgagccactgtccctggccaatgtaaaacttttatgcgtaatataacatatgtaaagaacagtgcccaaaattataggtatatagtgcaaaaactttgtaaaaagttcgtaaaaaggttttacactatatacctagaattttgtgcactgtgaatacctttgtgaagctagcactcagttgaattttgagcaacatattgcttgaagtaatggatgtggattagagatggagatcatagacaaggaattagaaatgcaagagcaacatattcttttaaaattccaggctgaatatcatcttggagatatgatacttgaaaaaccatttgtttgtattctattaggagtattaggacaatttaataagcagaccgtggaatgtttatattttgtgtgttttaaatttattaattcatctcattaatagtttttttgttgtttttgttattctgctacagcttttattagttttcaggatttatatccttgattttcacaaggtcatttccaaaatggaacttcagtattttaggaggctcagactcctttgatgttttaagaactatctatcaggaaaagtttgttaacaattgattatctttaatagtaagactgcaatccagctgtgactagtggatttgctaatagctattactggaagataatctataaactagttgctatcattatccctttttcctgatgagaaaataggcacaaaagaagctaagtaacttgtccatggtcacacagtcatttagtggcagagctatgattcagaacaaagcttgatggctttagaatatttaattaacagggttgttgtgaagattcttagttaataaatataagccacttaaagcagtacttgactccttttgtatagtaattgttaggtatcattaatggtattattgccattatcattatttcagggagaacttctggtagtgcacagaaatctcttcccccataaaggaagaagtcccaccaaatcttttgatggatagattacaatgaggctatgtgttttaaaacatacatcttaaaacattaatttgggggctttttgagatagcaaatctgtcttactattacagttttgagatggcaaaccccaaaatcctcatgaaaacaatttcatgtgcttgagtagctaaggtttacgttttctattgagaatgtaagataaatgaattttaactcccctgatttctgttgtaacagaatttaagcagaacggtgggaagccctatttgtctgtgattacggggagaggaaaccacagccagggaggagttgctcgcatcaaaccagctgtcattaagtacctcataagccatagcttcaggtgagtgtagatttctgttattaataatggcaactgcccatatagatctttatcagatatttctgtgagtatagatttctgttattgataatagcaatagccctaatatagctaggtaaataaacactaatagcgtactcagaacaatctgttaaaatagttaactaaatttaatcatctgatttcagccacagattcatgcttaaattatgatataactttccctgctggatttatgttgtctggtaaaccagaaataaggaaaaatgtgtttgttgccaataatcatctgataaaactttctatcataaatttaaagttctaaaagaaagtaaatatatttgtttctttgataatatgcaaaataattaggtaatatgtatcatactttaagatttgctattattcttttgaaaggaaatcagtatttgtggattttggatggaattgggtggcttctattgaaatatagttataatttaggtacgtttaaactttagcagaaatgttcagttaatatgaatttatttgtgttttcataagttaaatgccattaatgacctgtgttgacaaacatgaaatgttctttttcattaagtgataattatttaataacagaaaatgacaagaaagtcaaagatgaaatatctgttgatggatagatttcctgcagatgtgtatcattaactcctacccaccaatttcagtgtagcatatttattttatgccatgtaataagatgttatttggctacattatcgaaaatgatagcataagttatgagcataaaacaggtgacatcagggttatttttataaaaggagtagttagaccagaacattatgttgagattaattatctattttagagactagtcttcctttaaattctctccggatagagttgaaagcattgcatggccagattaatcagacttacctgatatatcagagatttcttcttggtgctttcatgatgcaccaaggactttattcttcctacagcatactctttttcataaaggtaaaattcaggcctcacaggttttgacaaatcttaagttatactaagtcaagagcaacctccagctttaagattgtatttgttttgaccgtagataaaaggaacacaaacctagatgttggtcttggatattgacttaataagggtcaatactttggtagtaaatattatattaagcgtaggtacttggaattgattacaaggtatattccttagctaatttgaaattttcatctttaaaataactcttttctcatttctgcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaaaaaaaaaaaagaaaaaaaagagaaaatattttggttataatcataagaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataatgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctccca

SEQ ID NO: 484 - DNA, 11668 bp, Homo sapiens
aggagaagtttcctgcagtatcaacaaatttgtcagtcatctctccaaatactatcatcatgagggggagacctgatccgtgagctatggccatgatggtacccagcgacataaacaatttatcctgccaatcggagtatcgaaactaaaaaaaggaaataaaataatacttagctgtggaatggaatttctcctcttccataattatatattctttggatttttatttaaagtcagtacttttttaagagttgtaaatgaatgtcttagaaaaggaggccttcaaatcattaacaacttaatttcatgattctgtttattttgtattctgtgaagaaatcaatctaattatgtttaattggtatctgatttgaataaataattactatacaatcaaaagggataaaggtttaagaaatattatttgatatcccagagctcctgtggtaataaagaacggctagggaaagacattaagtttaaacacacacacacacacacacacacacacaccacatcctttaaaaaagcattcagaatatttcagagggagaatttaaaatagaggaaaatagatgctctgagttttgagataagatccctttagaaggtttaagttagctttaaaaaggcaactcagtagtgaagcacaataaacattacagtgtgtctatatatgcaccttagggaagtcttgcctatggagatccttatgcagaaccttttttaaaaatttagttttcaccagtgtcacctgccaagtatgcagaaccttgaagggtaagagggagttcgctggagaagaatcggcgagtgtaaaagaagtaggaagaatttaggcttagaataagaaggtaactagaaactacatggaatgcttaagtaacccctggcagtggaattcctgaagggcacagtacaaagtgtgggagaggatgttggagagagatagaaggcctgcgctggtgggccacaccaagaatcttggacacagtactacctacagaggggaagggtgataccagttgtcacagtgaagtgcacaaccctcaagaactaaccagcagttcagtgttctaacacttcaaaggactttgttactgtcttattagtcctcttccatttctcaccttttctttctgtttttgattgacccatttatggctctctttctctttgttcttctttcctcctctgccttctagactacattttcctcatcttacatttccatttctatagcttcctatcttttttttctctcctctcttttaaaatgctttactctgcccattccccccacctcagccccttttggggacaaagaacagttattgggagagagggtgatgagccaggcttggcacagtggagcctttgagggctgaagctaggtcagactgggtcaataacccgggtgaggctgaggttagaggcacatggtggaaagtggatatgtgtgtacaccattctcaaagatttccaggagttcaggcaaggtttcagggacagggacaaactccatcatcaaacacacagggcaagcaagagaaccgaaagagacaaagggtcagaaaccaggcagagcttggataaaacaatgggagcaggtaaagtcaagagccaatggagctgggtccctaaaattgtcacaaagggaccagtgtcccaaaggttcatttttagtggttctgggaaaaggaaaacagaacacttgagtctgtcagctatagttaaaagcacagggtcaggttgttaacattaaaaagcattttaaatgttttcatattaattgaatacaattttacagcctctaagcataaatttaaaacgaggtgaatttcacagcaacatcctaagtaaacctaggtttgttttcagtgattttccagaaaataatatatttctaactcctgttagagcacagttttatcctcaacctctttcaggacaaaaaatatctattaagatatctagtaagaggtgaaaataaatattaaatttaagtttaacttaagctaaaacttctaaattcaaatgaaaatttctgttcctacattaaggtttgtaggattgtattttctgtaggaggcagatttaaaacctatgcattaaaaccagctttcagaggcggttccaagatagctgattaggaacagctccagtcaacagctcccagtgcaagtgacacagataacaggtgatttctgcatttcctactgaggccccaggttcatctcactgcggcttgtcggacagtgggtgcaggacagtaggtgcagcgcaccgagcatgagccaaagcagggggaagcatcccctcacccgagaagcacaagaggtcagggaattccctttcctagccaagcaaagctgtgacagacggcacctggaaaatcgggtcactctcaccctaatactgcgcttttccaatggtcttagcaaacggcacatcaggagattacatcccacgcctggctcagagggtcccacacccacgaagcctcgctcattgctagcacagcagtctgaaatcaatctgcaaggtggcagcgaggctgggggaagggtgccctccatagctgagacttgagtaggtaaacaaagcggccaggaagctcttgagtaggtaaacaaagcggccaggaactgggtggagcccaccacagctcaaagagacctgcctgcctctgtagactctgcctctaggggtagggcatagctgaacaaaaggcagcagaaacctctgcagacttaaatgtccctgtctgacaggtttcaagagagtagtggttctcccagcacagcatttgagatctgagaatggacagactgccttctcaagtgggtccctgacccccgagtagcctaactgggaggcaccacccagtaggggcagactgacacctcacatggccgggcagccctctgagacgaaacttccagaggaacaatcaggcagcaacattcgctgttcatcaatattcgctgttctgcagcctccgctgctgatacccaggaaaacagggtctggagtggacctccagcaaactccaacagacctgcggctgagggtcctgactgttagaaggaaaactaacaaacagaaaggacatccacgccaaaacccatctgtacgtcaccatcatcaaaaaccaaaggtagataaaaccacaaagatggggaaaaaacagaacagaaaaactgaaaattctaaaaatcagagcgcctctcctcctccaaaggaatgcagctcctcaccagcaatggaacaaagcaggacggagaatgactttgatgagttgagagaagaaggctacagatgatcaaacttctctgagctaaagacggaagttcgaacccatggcaaagaagttaaaaacctagaaaaaagaatagatgaatggctaactagaataaccgatgcagagaagtccttaaaggacctgatggagctgaaaaccatggcacaagaactatgtgacgaaagcacaagcttcagtagccaattcgatcaagtggaagaaagggtatcagtgattgaagatcaaatgaatgaaatgaaacaagaagaggagtttagagaaaaaagaataaaaagaaacaagcaaagcctccaagaaatatgggactatgtgaaaagaccaaatctatgtgtgattggtgtacctgaaagtgacaggattaatggaaccaagttggaaaacactctgcaggatattatccaggagaacttccccaatctagcaaggcaggccaacattcaaattcaggaaatacagagaacaccacaaagatactcctcgagaacagcaactccaagaaacataattgtcagattcgccaaagttgaaatgaaggaaaaaatgttaagagcatgcagagagaaaggtcaggttacccacaaagggaagcccatcagactaacagctgatctctcggcagaaactctacaagccagaagagagagggggccaatattcaacattcttaaagaaaagaattttcaacccagaatttcacatccagccaaactaagcttcataagcgaaggagaaataaaatactttacagacaagcaaatgctgagagattttgttaccaccaggcctgccctaaaagaggtcctgaaggaagcactaaacgtggaaaggaacagccagtaccagtcactgcaaaaacataccaaattgtaaagaccatcaaggctaggaagaaactgcatcaactaatgagcaaaataaccagctaaaatcataatgacaggatcaaatccacacataactatattaaccttaaatttaaatgggctaaatgctccaattaaaagacacagactggcaaactggataaagagtcaagacccatcagtgtgctgtattcaggaaacccatctcacgtgcagagacacacataggctcaaaagaaagggatggaggaagatctaccaagcaaatggaaaacaaaaaaaggcagggattgcaatcctagtctctgataaaacagaatttaaaccaacaaagatcaaaagagacaaagaaggccattacataatggtaaacggatcaattcaacaagaagaactaactatcctaaatatatatattcacccaatacaggagcaccaagattcataaagcaagtccttagatacctacaaagagactcccacacaataataatgggagactttaagaccccactatcagcattagacagatcaacgagacagaagttaacaaggatatccaggaattgaactcagctctgcaccaagtggacctaatagacatctacagaactctccaccccaaatcaacagaatatacattcttctcagcaccacactgcacttactccaaaattgaccacgtagttggaagtaaagcactcctcagcaaatgtaaaagaacagaaattataacaaactgtgtctcagaccacagtgcaatcaaactagaactcaggattaagaaactcactcaaaaccgctcaactacatggaaactgaacaacctgctcctgaacgactactgggcacataacgaaatgaaggcagaaataaagatgttctttgaaaccaatgagaacaaagacacaacataccagaatctctgggacacatttaaagcagtgggtagagggaaattaatagcactaaatgcccacaagagaaagcaggaaaggtgtaaaattgacaccctaacatcacaattaaaagaactagagaagcatgagcaaacacattcaaaagctagcagaaggcaagaaataactaagatcagagcagaactgaaggagatagagacataaaaaacccttcaaaaagtcaatgaatccaggagctggttttttgaaaagatcaacaaaattgattgactgctagcaagaccaataaagaagaaaagagagaagaatcaaatagacgcaataaaaaatgataaaggggatatcaccactgatatcacagaaatacaaactaccatcagagaatactgtaaacacccctacataaataaactagaaaatctagaagaaatggataaattcctcaacacatacaccctcccaagactaaaccaggaagaagttgaatctctgaatagaccaataacgggctctgaaattaatagcttaccaaccaaaaaaagtccaggaccagacagaatcacagccgaattctaccagaggtacaaggaggaactggtaccattccttctgaaactattccaatcaatagaaaaagagggaatcctccctaactcattttatgaggccagcatcatcctgataccaaagcctggcagagtcacaacaaaaaaagagaattttagaccaatatccctgacgaacatcaatgcaaaaatcctcaataaaatactggcaaaccgtgggcgcggtggctcacgcctataatcgcagcactttgggaggctgaggcgggcggatcacaaggtcaagagatcaagaccatcctggctaacatggtgaaaccctgtctctactaaaaatacaaaaactagccaggcgtggtggtggggacctgtagtctcagctactcgagaggctgaggcaggagaatggcgtgaacccgggaggcgcagcttgcagtgagcccagatagcgccactacagtccggcctgggcgaaacagcgcaactccgtctcaaaaaataaataaataaaataaaataaaataaaataaaataaaataaaatactggcaaaccgaatccagcagcacatcaaaaagcttatccaccatgatcaagtgggcttcacccctgggatgcaaggctggttcaacatacacaaatcaataaacgtaatacagcatataaacagaaccaaagaaaaaaaccacattattatctcaatagatgcagaaaaggcctttgacaaaattcaacagccattcatgctaaaaactctcaataaattaggtattgatgggaggtatctaaacataataagagctatttatgacaaacccatagccaatatcatactgaatgggaaaaactggaagcattccctttgaaaattggcacaagacaggatgccctctctcaccactcctattcaacatagtgttggaagttctggccagggcaatcaggcagaagaaagaaagaaagggtattcaattaggaaaagaggaagtaaaactgtccctgtttgcagatgacatgactgtatatctagaaaaccccattgtctcagcccaaagcctccttaagctgataagcaacttcagcaaagtctcaggatacaaaatcaatgtgcaaaaatcacaagcattcttatacatcaataacagacagagagccaaatcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatggataggaagaatcaatatcgtgaaaatggccatactgcccaaggtaatttatagattcaatgccatccccatcaagctaccaatgactttcttcatagaattggaaaaaactactttaaagttaatatggaaccaaaaaagagcctgcattggcaagtcaatcctaagctaaaagaacaaagctggaggcatcatgctacctgacttcaaactatactacaaggctacagtaaccaaaacagcatggtactggtaccaaaacagagatatagaccaatggaacagaacagagccctcagaaataataccatacatctacaactatctgatctttgacaaacctgacaaaaacaagaaatgggaaaaggattccctatttaacaaatggtgctgggaaaactggctagccatatgtagaaagctgaaactggatcccttccttacaccttatacaaacattaattcaagatggattaaagacttacatgttagacctaaaaccataaaaaccctagaagaaaacctaggcaataccattcaggacataggcatggtcaaggagttcatgtctaaaacaccaaaagcaaaggcaacaaaagccaaaattgacaaaaatgggatctaattaaactaaagagcttctgcacagcaaaagaaactatcattagagtgaactggcaacctacagaatgggagaaaatttttgcaatctactcatctgacaaagggctagtatccagaatctacaaagaactcaaacaaatttacaagaaaaaaacaaccccaccaacaagtgggtgaaggatatgaacagacactcctcaaaagaagacatttatgcagccaatagacacatgaaaaaatgctcatgatcactggccatcagagaaatgcaaatcaaaaccacaatgagataccatctcacaccagttagaatggcaatcattaaaaagtcaggaaacaacaggtgctggagaggatgtggagaaataggaacacttttacactattggtgggactgtaaactagttcaaccattgtggaagacagtgtggtgattcctcaaggatctagaactagaaatatcatttgacccagccatcccattactaggtatatacccaaaggaatataaatcatgctgctatacagacacatgcacaagtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcctcagcaaactatcgcaaggacaaaaaaccaaacacctcatgttctcactcacaggtgggaactgaacaatgagaacacttggacacaggaaggggaacatcacacaccggggcctattgtggggtggggggatgggggagggatagcattaggagatatacctaatgtaaatgacaagttaatgggtgcagcacaccaacatggcacatgtatacatatgtaacaaacctgcacgttatgcacatgtaccctagaacttaaagtataatttaaacaaatttaaaaaaataaagaaaaaaaaacttctaaaaaaataaataaaaccagctttcatttgataaacaatttattctccaaagtgctaatttttttttaaattgcccttactgaggctttttaaacaaataaaaaaagaggagagaagacaatgaataggggcttttggttacatgagaagtatgcagcagtgtttgagagtgtggatgttttggtgtctttttatccatttaattactaagttggatttcagctgacatgacacttaattctaacttctttgctaccaaataatggctgtcacagtttgaaacacgtcatatttaccaaaaatgggcaaatgctttcttgagctgcctctgtaagacatatttcaaatgaaaaccagatgaggagacttcttccaaaaatattgtcttgtcttgtaccaacagaaaagcaccgaaaactgttttaagcataatcagaattcctaatagttaccccctatttagccaattttttggaaaccaaatgtgaatgtagattccttaaattaaaatttatgtacttaacaattactttcttgaaatgcaagcttattttaagctaaatttggggtgggggtctgtgaagcaaatgcagaaatgcattttcttgaaattgttgagtttgcattgtgctactaacacaattcccattttcactttccttgcacaccagttagctctgtccggtgtcatcgccagcctgtctctactttttaaaaaatcatccatcttaagaatgtgggtcattgactataataagccaaacttatacagcacaggtgcagcaaggacaatttattgctgtctgcagacagttttttgttgtcgttgtttttgagacagggtcttgctctgccacccaggctggagtgcagtggtgtgatcataactcactgcagcctcagactcctaagaccctcctgcctcagcctcccaagtagctgggactacaggttcatgccatgacatatgctattttttaagatttttatttttattattttgtagagatgagatctcactatgttgtccaggctggtctcaaactcttgtgctcaagcaaccctcccacctcagtctcccaaagtgctgggattacaagtatgagtcagctcgcctagctagacaatcttaaagtatttgctttaaaggtaattgattcaatacctcaaatttgaataaaaggtaggattattcacatttaacatttcacagcttaccaatgttaatactccaatcattttcactgtcttcgtttttttccttttttgtttgctgtaaaaaatagaattgcttcaatttaaaactgttacaaaatgttttacaatcaattgaacataaatatgtttagttacaatattcaactattatattttcaaatataagagtgatgttcacaaaatgtcaaaattattcagttcaacaaacatagcaagcacaaaagtaactgtcgaaggtactacaaagatacatggatacataagaaatggtcgcctgccttacagagctcacatacacaggaaagataagtatgctaacagtgtcgctaagtcaattaagttatttgttttctaaaattaaaaaaaatcatgatttaaaattaggaatgtctattcttctgaaggattgtggagagtggtgtcaggcaatcttgttggtgatacattcaaagtacatctagaatttaaccacttatcaccagtttcattgctgtcaccagtagggcagcctcctgcctagtctctccacttccacctatgccgcttcagtctatcttcaactagcagtcagagtaattatttcaaaatgccaagccatacactacttctttgctcaaaaacctacaatggctttcctttttcttacaataaaagccaaaatccttgcattaacctctgaggtcctacacgatctgtttgcttatttcctctctgaccacatccctactcccaaacctgcttactctgctccaaccagcctggactctctgctgttccatgaactcaccaaacatgtacctgactcagggtctttgcattgccagttaccttttccgggaatgctctccccttagatacccacacagctgtctcctctcatttctttcaagtctttgctcaaatattacctttaaaataagatctaccctaaccaccctacttaaaattacaaagtactccccttttgtactcctgatccccttaacctggattaatgcttttttccatggcgttaattaccttctaacattggctgtggtttacttatttagtatgtacattatttatgtctgtcctccgtactataatataaactctatgagggagtgtgtgtgtgtgtgtgtgtatgatgatttatatatatatgatgatttttacataaatatgatgcatttatccaggtaaatgataaagttttactcataagatgattccaaattatgtaaagtattgactaaaatcactggacaaacatctgccactaaatatgttcaaaagaatgtgccatgggcaatagcaacataattagaacaagaatataactaatttgattgaagcaggcttaacttcctttaaatatattatctttggtctgcttttataaaaattagtttcactacatttgatttcataatcatgtggtcttaacttattgttaactttctgtatttctcttttgagctgctttcttctttccagcagaagctgtgggcttcccctctgaggactttcctgggttctgaagtgttactacaccttttgtaggaatagctcctttgcacacgcatcaaatgttaagccagtgcaatacataaatagacttcttcatgaaaatgccatctattaatagactcacagtcaatccctgcctaaacagccagctgatgaaaaccatatttttctattgcgtgtgtaagtacttccattggaagtaacaccatctatcactttttcaattctacatggcaaaactaaattttctatgaaaaaatacaatggtgcttagaagaaatacagcaaggttactgcac

SEQ ID NO: 485 - DNA, 11789 bp, Homo sapiens
aaatacaatcaaaataggaatataattcaaccaaggggaggaggaagtggcatcagaaaaggcatcactgccgggtggaatggctcacgcctataatcccagcgttttggggagccgaggcaggtggatcacttgaggtcaggagttcgagaccagcctggccaacatggcaaaatcctgtctctactaaaaatacaaaaattagctgcatgtggtggtgtgtgcctgtaatcccaactattccagaggctgaggcatgagaatcccctgaacccaggaggtggaagttgcagtgagccgagatcgaggcactgcattccagcctgggtgacagagtgagactctgtctcaaaaaaaaaaaaaaaaaaaaatggcatcactgctgggtgcaatggatcatgcctgtaatcccagcaacaggaggatctttcgagcccagtagttcaacgctagcatggccaacatagcaagatccctaggccctatttcaaaaaaaaaaaaaagtttattagttagacgttttggcatgtacctgtaatcccagctacttgggaggccgaggagagaggattgcttgagctcaggagttccaggctcagtgaactatgatggcatcactgcactctagcctgagcaaccctatctcttaaaataataataataatgttttaaaagaaaactaaaagacatcactaaagaagtctttgggctgaatgttgaagagggattttgggaataagagaagcattgtagactgaggagacagcaagtgagaagatgtgaagagcatgggaccttcccaggctagcagaaccagcgtggctggagcagagggccaggggaatgactgtgagtgagcgcggacaggggccagggactagactgtgaagggtatttgtattagtctgttttcacgctgctgataaagccatacctgagactgggcaatttacaaaagaaagaggtttattggacttacagttccatgcggctggggaagcctcacaatcatggcggaaggtgaaaggcatgtctcatatggcagcagacaagagaagagggcttgggcggggaaactcccctttattttatttatttatttatttatttatttatttagagacaatgtctccctctggtgtcacccaggctggagtgcagtggcacagtctcagctcactgcaacctctgcctcccaggttcaagcaattctcccgcctcagcctcctaagtagctaggattacaggcatgtgccaccacagcctggctaatttttggatttttagtagagatggggtttcaccacattggtcaggctggccctttttaaatcatcagatctgatgagacttattcactatcacgagaacagcacaggaaagacccacccccatgattcaactacctcccactggcttgctcctgcaacacatgggaattcaagatgagatttgggtggagacacagccaaaccatatcattctgcccctggcccctcccaaatctcatgtactcacatttcaaaaccaaacatgccttcccaacagtcccccaggtcttaactcatttccgcattaactcagaagtccacagtccaaaatctcatctgagacaaggcaagtcccttccacttatgagcctgtaaaatcaaaagcaggttagttatttcctagatactatgggggtacaagcattgggtaaatacagccattccaaatgggagaaattggccaaaacaaagtggctacaggccccaggcaaatctgaaatccagcagggcagtcaaatcttagagctccaaaacgatctcctttgactccatgtctcgcatccaggtcacactgatgcaagaggtaggttcccatagtcttaggcagctccgcccctgtggctctgcagggtacagcccccctcctggctgccttcactggctggtgttgagtatctgaagcttttcctggtgcatggtgcaagctgtcagtggatctaccattctggggtctgaccctcttctcacagctccactaggcaatgtcccagtagggactctatgtgggggttcctgccccacatttcccttctgcactgccctagcagaaattctccatgagaaccctgcccctgcagcaaacttctgcctgggcatccaggtgtttccatacatctgaaatgtaggcagaggctcccaaacctcaattcttgacttctctgcacttgcaggctcaacaccatgtggaagttgccaaggcctgaggcttgtgccctctgaagccatggcccaagctctacgttgtcccctttcagccctggctggagtggctgggatgcagggcaccaagtccctaggctgcacacaggagaccctgggaccggcccatgaaaccactttttcctcctaggcctctgggcttgtgatgggaggggctgctgtgaagacctctgacatgccctggagacattttccccattgtcttggggattaacatttggctcctcattacttatgcaaatctccatagctggcttggattttcttttctatcacattatcaggctgcaaattttctgaactttcatgttctgcttcctttacagaactgaatgtctttaacagcacccaagtcacctcttgaatgctttgctacttagagatttcttccaccagataccctaaatcttctctctcaagttcaaagttccacaaatctctagggcaggggcaaaatgctaccagtttctttattaaaatataacaagagtcacctttgctccagttcccaacaagttcctcatctccatctgagaccacctcagcctggaccttattgttcatatcactatcagcatttttgccaaagccattcaacaaatttctaggaacttccaaactttcccacattttcctgtcttcttctgagccctccaaaccgttccaacctctgtctgttacccagttccaaagtcacttccacatttttgggtaacttttcagcagcaccctactctactggtacaaacttttgagtgcggacagggccagggactagactgtgaagggtgtttgtattagcctggttttacgtcgctgataaagacatacctgagactgggcaatttacaaaagaaagaggtttattggacttacagttccatgtggctggggagacctcacaatcatggtagaaggtgaaaggcatgtctcacgtggtgacagatgagagaagagagctcgtgcagggaaactcccctttttaaaaccatcagatctggtgagacttattcactatcatgagaacagcactggaaagaccttcctccatgattcaactacctcccactagtactctcccacaacacatgggaattcaatataatatttgggtggggacacagccaaaccgtatcagtgttagagccaaagtcaggaggtaggagctggggtcaagggaatgggacccagcagagggctttacacaagagacttacaggatcagcttggggccttgaaaagagcacgcatgatggtggggagctggattatttagggagtcagctgttggtgggaagagtcaccagaaaatggtattgcacagtcctagtgagaaaggtgaatatgagccaggcatggtggtgtggacctgtggtcccagctactccggaggccagagcaggaggatcgcttgagcctaggagttagaggccagcctgggcaacataggaagaccccatctctaaaaaaataataataataacaaaaaaagttggacatgaagcaagttgagagtggaaggaggagttccttcagaacacgaaagcccagagaagcccagtgattgtctttagttcatacagctggtggcagagcctggacttaaacttatgttaacactagaagcaggtgaccaatctgccatctagagattgctttcacatacgttcccaacccccccgccacacacacagactattttatagaggaggggaagttgaggacctgataggtcagtctccatttgtttggcaaattgaaacaggaaatggcagcacctgaacagaggctaagcgaggacaaaccgattcagtaagcatttgctgagcacccaccacatgccctggactatgtcttcaaggacctccaagtttgaaagggaagaaaacacatacagaaaaactccaaacaaggcagacagacgtgtgttagaatgggcgatggacaaagatccacgggaagacagaggagggtatggtttcagctgaaatcggtgccacagccttgtgcaatctagggcaggagcctgaatggtggaaggaggcttggaggagggaaaggggttccatggatgacacttggtgctgcagcagggcctggcctggagctcaggtctttctgcctcttctgcttcttggcccctcagggatacttgggctgggcccagctgacagacagatgccggtgctgaagccagagtcgcagcattcctgggtccttcacttggcacaagcctggaaacaagtagacacgacgtggcctgcctgagggtggggtcagggacagaggggcagggagctgaggagttggcactatgggaagagccacttttgtccaggttgctgggagcttctgtggctcatggtagtccaataacgatgactccaggtgacctctgtcaccattttctattaggcaatgtttcctgcccattcctggttttagtgggctaaataatacccttgtgtataagatttttttttttcttttttgagacagagtcttgctcttgtctcccaggctggagtgcaatggcacaatcttggcttactgcaacctctgcctcccaggctcaagcaagtcacctgcctcagcctcctgaatagctgggattacaggcatgcgccactatgcctggctaatttctgtattttcagcagagatggagtttcgccatgttggccaggctggtctcaaactcctgacctgaagtgatccacccatctcggcctcccaaaatgttggaattacaggcatgggccaccacgcgcagcctgaaatataagattgaagagatggattccctacggtattcacacatttccttaccatgggctagtcacttaaaatggccatgctaatatttgttttatggaaaagtggggactatcacatctgcctgcagactacggataaaacaatattataaaaatgtatgttcaagcctgggcaagatagtgagacctcatctcttaaaataaataaataaataaaaaatagcaggatgtggtggcgtgcatctgtagtcccagctactcaggaggctgagatgggaggatcacctgagctcaggaggtcgaggctgcagtgagctatgatcacgccactgtactccagcctgggtcagagtgataccctgtctctaacaacaacaacaaaaaaatatgttcattaggagtctatccctgagcacagctaaaattctgtagcactcgtagaattgctttgtcagttctacaggaaattgagccctaggtgagttggcaattgagaaaaattcctgaaaagagaggaaagactgaaagtggtctagtatttcctagactgcacttcacttcacatgacagtgtgctgcaaggtgaaggggaagggctaaggactcaggccaaacttcagcttgtcactttccctcattcaacacatatttaggacctatatcatgttctgggaaattactagctatgtgacttacgtagacaacgcttttgaactttatttttctcatctggaaaactaaaaataatatgtatgtacctcataggtctatagtaaaaattaaatgaaatgtgtctgttgtaaataatgtattagaacatcagctctgtgtctgagcagtgtagggcacttagggatcctgagttttcacccctgactggtctcacttacttcctggcaagattgggcggccctgacccacttggtctagcgcacaggattggcacctggcttgttctgtcttctgtagaactcagccaggatttcagcacgcctaccagctgaggtagagaacacaatggaagcagaaacagcttctcccaaggctgacctggtgcagtctgggctggttagtcaaggggaacagaaaccactcaagtatctagtggttgatcaaactccagctgtttgcctcagagccttcctttcacccagccttaactgctattatctgaggtctattcatacgtcctgtatgcagagggaataggtaaagattggttgctctttgtcattgaagaaacctgtgcttcacttctcttattgaaggaatcagccttccccaggattatctgggctcactgggccctaccgtgcaggacttcttttgaatgattgcaggtatcctgcctttctctggcccacatggctcacaaactcaccactagtcctcatcaccagcagccataagctgcaactgacctgactcagcagaaaagaaatgaatgtactaaaaggatattgggagagccagggagccaggcctgaggcaaagcttccaggaaccatatctaagaagtgctgcagaagctgttggatgagaatgctgcagctgcccctgagttcttgctgctgctgtttgtgcactactaggagcccacctccccatgactgctgtggtacccaccacacatgctgctgccaccccaggagcacacagctgtcacccaaggcacgtcagatgcatgtgccaccatgttcccttgaaaagtgcaagcctgtgtatgctttttcctcacatttgttacctgcaactcaaagtcaggggcccttgactggtgaactccagaccacaggctcctaacacaagttttctagctttcatcttagaaaagcaggacacctgtaatcccagcattttgggaggctgaggtgggaagatcacttgtggccaggaattcaagaccagcctgggcaacataatgagacccccatctctctaaaaaaaaaaaaagaaagaaagaaaaaaagaaagaaagaaaaaagaaagaaaagaaaagcagggctcctaaagtgggaagatttccaagcattagaccatgtgtcagaaatagacaaaaaatatacagaaaatgtccactttgtactctggccccgggctctcatcatcttcccagtcccacctcctcccacctgatggagccaagccccgggccctgtgttaaggcttggcctgagatgttctgcatgggggcctgagccatgagagaagtgcaaggaattcagatgggcacttcttgacagtgagcaacaaggggatgctgtctgagcttgggaaccccagagggggttaagggaagagtaccagggtgatgattagctagagtcataaaatggggagatctagcatggccttggggaacatctagtgggcgtcacacatccaaatgcctgcagaggggccaggcaggtcagacaataggggatgatggggcctgtggggatgcgcctttaggcattacattcaaagacttaagtctactgtgcagaggtggtaagaatgatacaagtggttgttgttggggggctgattgactataaaggggcatgaagaaactttctgcaggtgatggaaatgttctgtctgttgctttgggtggggttacatcttatataccttcatcaaagaaataacttagatgtgtgcattttaccatgaagtatacctcaatttaaaaacttggggcaaattcataaagcaatgtggatctggctctcgggctaaccatttgtaaacttctgttgcaatccgacttccagaggcgtccttggctcctcatcttggaaaagcgcgactgcggcgtggtctggcgggcggccgctcactgcgcggtctccacgcctggcaggtggcgcggggcaggcagctgtgccagcctagcatttccacctgccgggaggaggcggtcccctggggcccggccggcatctccctggcctgaaaatgagccggtcaccccaaacgccaactccgaaaggagcggaagcggatggaacagctggtcccagggagcgcgggccaggcgcgcagataaatcacggacacacactgcacggatagctccagactggcgttgagtgccaaatgccgacacagacacggtcaggttccaggaagagaaatccgatccgatgcgcgctaggcggcggcggcggagcacagtgaaacccacctgagggggaagggttggggggaacccaatcttgatggagcccctccccatgcgggcactttgggcacttcctgaagtcctacctggccacccgcctgcccggggcatcaggcatcgccacttcactggggagaaaagccagaccgccgcagttcacggagcggtaggaattgcggtggaattccaggccggagtgtgtgaccctacgccctagctccgtcctctcctccaccccgaggcgagcaggtgtctgcaggagtgcctccaaccccattgcaaagcggacgtggccctcgtctcgatgtcggcgctgctcgccgagagggaccccggggtggtgttgggcgcgcggggcggggacggggacgcgctgcggccaagtccccgggccctgcgacccgcagggaccttctggacgcacggagcccggccctccagccggcgcccgccctgattggcgcccgaggccggcctcccgccggctcacctgccactcccagccaatcggggccaccagaattggggctgtcgccgggggggtgggtggctagggcgggaggggaggagatgctgccggcccgaggctgagccaccctccccgcggagttcccgcccggccctctgcaatccggagcccaagccgccggctacgcgccctgcgcccccttggtgccgcgtccagtgcccagcgcgctttgatgctgcagctccgggccgggccgctctgcttctctgctcgctgggacgctctccgacggctccgccctcgcctctcgccccgagtccctgctgaccccggggaggtggggtccgggccgggcacagccccgctgaggcaggatgttcacgtccaagtccaactcggtgtcgccctcgccgtccctggagcaggctgactcggacgccctggatatcagcaccaaagtgcagctctacggcgtgctgtggaagaggcctttcggcaggccgtcggccaagtggtcccggcggtgagtgcgcccccgcgccccaaggagaccgccggggagagagcctgggcgtcgttacccctcccaccccctccagtcgccgtcgtgcctctgctttcctgtgtgaccttggcgtcaccccttttcactctacactggctcccgcaggaaaatgtggaccatagtctgggccgggagaatggagatggggcccctgccctggggcggtggcaaattctctatggaatgaacctgaccctcgagtgggaatgttgggtgtgggcagaagagaccgtggtcggggtgggatcccagctaggtcagatcaggccagactgaggggaggcagaaactccatctctagccaaagatgcccccaaccccgggacccccactgtcaattccatcgtcttcacaacccctgacccaggccgcgaggaccgggcctgagtgtctccctcccgccaaccacccacccttaagacggagagggacctggcccttctgaaaggctcaggctaaggagggaggaagggccaggaagggtgcttgtccatggggaagtgaccttggcaacccctccaactgtcccttgaaataatttttttaaaagtgagcacagggaagagagattctagtgcttcagacggaggagctggaaaggagggaggcagctggagtgaaggaggggatagattggttctgccaaggattgatcctctgaaaggggtggtggagagagacagggtagtcccaaccatccttcagccccagctgcctggtccccaactcagacgcgactccgcggacatcggtagccactctccacttacaaattagcctgggaggtattgagggaagagggagttcacagccctggacttgcaggaagctcccaactggctgcaggtgctgtgggccattttctggacagtttccactctccagtcaatttcagttctgagattcactactggtatggcctggagaatgcagaccctgtccagcccttccgcggaggtgtgacccttccaggaaaccaggggtatccagatgccccttccccatcccacactctatgagtctgcccctgagcagagggggcctccaatgttcccaggaccacagatcatgtggatgtggtagtggtgggtgctgatgttctgttctgatgaataatttaatgtttctataagaccgcagaacaaatggagctgtggacagtagctcacattttatatctctggtttcatgttgttttgttgcttctgacaggtttctctctgggatttaatgggatacaggcttcttgagttcctccaaagttcagcttatctctgaccccctaaatgaaggcttggagcaacatggagtgtatttggggagcttccagtattgtgctatgtgagctacagcccccagggccaggagagctggggtggaaaggctgtgtgtagattcaagcacaattagcagaatatctccccccaccacccatctttcttctgcctcagcagctccagatagttaatctttcttttctattgggtctggctgctgttctgggtcctgtcaaccaagacttctcttgccagacattttcacctgacagcatccctagaaaatgctaggtgcttgtgacccccagggtatgtcccctggtcctccccttcaccactgcaggtacattgggaaactggtctctgcacctacagttgattccagggctaggaagtgtcaggagtacagggcataggcccccagctaaaagcacaatggtagtgccaaggaggcttggagaggtttagtgtcccccacccagagactccatcttctcctccatccactaccgtggcccccaaagccacccgaaacgatgcaatcagagtctgagcagtatgtatgctctgctaatacagctaaaagtcaagtcctttagcctccttccaaggagattgttacctgggttcccttcctttgtaggaatttcagagctgccactgtgcaaagactacctggggctcaagaaagaactaacatcccacctgcccattctaggcctctgtgttctcagttctgggaatacacaacacacacacacacacacacacacacacacacacacacacacgctatttagtcttgggtcagtgacagagccagccagagagggcctgggtgtgggggagaaagatgctcagctcagccccctctcacttcccatcagggccccctgggccccagcttcccatttgtaaagtagagtctgtgggctcagctaattagcagccacaggaagacttggggacagagcagctgagggccgccaccgcagagccttgccattagggcgatcaatgccctggctggagcagttaaggggagggggcctgaaaagtctcagcactgcattagtaaagaataagctggagagaactggctgtggccagctgggttctataaaaccttttccactcagggtctgtcttaggacctgtgcctccagcttccaccgcccaagcagccctgcctgcctggggtgggaaggtgcccttgagctgaagggtcaacttatttcctgggggcaacaaaaggggaaggga

SEQ ID NO: 486 - DNA, 12027 bp, Homo sapiens
tttgtattcaactgcttcagtgtatactgaacatggatgaagttcagtatgagaaattcagctttaaagatttgacagttccaaaattaatattgttataatgtccatactacccaaaatgatctattgatttaatgaaatccctatcaaaatttcaatgacatttttcctagaaataaaaaaaaattctaaaattttcacggaactacagaaaactctgaatagccaaagtaatcttatgcaaaaaagaacaaagctggaggcatctcattacctgacttcataatatactacaaagctatagtaatcaaagcagcatagtactggcgtaaaaattgatgtacagactaatggaacagacaggagggcacagaaataaatctgcacattacaatccattgttttttgacaaagaagccaagatgtatacactgaagcagttgaatacaaatttctagaacctttaccaagctttggaatcactttgcctgccttcccatatcttggggggtgtccaccccactgcgatgtcgatcgtaatacccagccaggggaggggggtgatattactccccatatggcggggggtgtccaccaccctgctatgtggatcataatacccagtggggtggaggggggtgatattactccccatatggcggagggtgtccagcctcctgcgatgtggattgtaataaccaggaggagagacgggggcgatattgctccccatatcgcagggggtgtccacccttctgcgatgtggaccgtaatacccagtgggagagacggggtgatattacttcacatatgtcggggggtgtccaccccactgcgatatagaccctaatacccagagagggagaaggggtaatattactccccatgtcatggggggtgttcaccctccttctatatggggagtaatatcatctctcccatcctggatattaggaacaatttcacagggtgtgtgtacacagcctgcaatgttgaaagtaatgtcatcctctccccctccggatattaggaacaatatcacaaaaggactgtacactttttgcgatatttcgagtaatatcatcctgtgattccctgaatattgggagacatattttccacaaggtgggtgtacactcattgctatactgggagtaacatcctactgtaccccccggaaattatgagcaatatcacaggggtgcacagccattgccatagcagaagtaatatcatgcgctccctcactagtttttaggaacaatatcacagggggaagtacaccttctggggtattgggaataatatcatcatctcttcttgtagatattaggtacaatatcacgggggggggtgtacaccccttgctctattagaagtaatatcgttctcgcctcttctagattttaccaataatatcacaagcggggtgtacatcccttgttatattgggagtaatagcatcttctttcaacctggatattgagaacaatattacatgggggtgtacatcccttcaatattcggagtaacagtatcttctccactcctggatataagaaacaatatcacaggcagggtgtacaccccttgttgtattgggagtaatagcatcttctttcaacctggatattgaaaactgtatcacatggtgagtgtccatgccttcaatattggtagtaatactaatttcttccctcctggatataagaaacaatatcacgggtgtggtgtacaccccttgcaatattgggagtaacgtcacctctccctatgtggttattacggagaaaatcacagggtggctgtacacttcctacgttattgggagtaatatcatccacaacccccctggatggcaggaaccgtatcacagaaggggtgtacagcccctgcgatattgggagtaatattattctcttgtccctgtacgttaggaactatatcacaggggggctgtacaccttctgtgatattagaattaatgttatcatcttctccactgaatattaggaacaatatcacagaagggtgtacaccccctgcgatcaggccagtaatatcatcggctccttccctggatattaggaacaatttcacaaggtgtgtacaccccctgcgctattgggagtaacattattctctcttcccctcgatattagaaagaatatcacaggtggagggtacaccccaccccctgcgatattgggagtaatatcatcctcttttaacctggatattaggagcggtgtcacagggggcgtgtacacttccttcgatactgggagtaatatcctctctccccgtaaatagtaggaaaaatatcaaaggtgtgtacagcacttgcgatattgagagtaacataatcctcccctcacctggatatcagaaataatatcacggtgggggggtgtacacaacctgcgatattgggagtaacattattttctgcccccatggatgttgagaacagtatcacaagggcggtgtacaccgtctgcgataatgggtgtaatagcgtcctcactccccctagatattaggaacaataccacaggcagattacacacccgctgcaacgttgggagtaatatcatcctttcccccctggatactaggaacaatatctcatgggaggtgtacagcccattccattttgggagtaatattaatttcttcattgctggaaataagaaacaatataacaggggtggtgtacacaccctgtgatattgccagtaatagagacttcgccccccccaccggatattaggaacaacatcaaaaaggggtgtatacagcgatattgggattaatatcacgctctcccccttgaatttaggaacaatatcaaagaaagggtgtccaccccttgcgatattgacagtaattacatcctctccctccgtggattttaagaacaataccacatagttggtgtacacgcactgcgatactggaagtaatgtcatcctcttccccctggatattaaaaacagtatcacagaggtggtctacaccccccgcgatgtggccagcaatatcatcctttcccccactggatattgggaacaacatcacaggggtgtgtacacctcctgcgctattgggagtagtatcattctctcttcttctggatattaggaataatatcataggtggggtgtacaacccctgcgatactggcagtaatattatcctcacgcaacctggatattcaaaaccgaataacaggggggtgtacaccccctgcgatattggtagtaacatcattctctcccccacttgatattacaaaacaatatcccaagaaagggtgtacaccctctgagatattgagagcattatcatcctctccccaactaaatatgaggaacaatgttggtgggggggatgtacaccccttgcgatattgggagtaatatcctctccctccctggatattagaaacaatatcaaaggggtcgtgtacaccccctgtgatattgggagtaatatcattctaatctccccgggatatttggaacaatattatggagggggtgtacaacctctgccatattgtgagtcatatcatttctcttcccctggatattaggaacaatatctagagtaataatatcccttcccttctggacattaagaacaatatcactgggtgggtgtacagcccctgcaatattgggagtaatatcatcctctccctctctcgatattaggaacaatatcccaaggtgggtgtacatcccctgcgatattgggcgtaatatcatcgtctgccaacatggatattgggaacaatttcacggggtggggagggggtgtacaccttcttccatgttgggagtaatatcatcctctccccccgaattgtaggaaaaacttcgaaagggttttaccacttgtgcaatattggcagtaatatcatcctctccccacctagatattaggaactatatcacaggatgctgtacacttcttgcgatattgggaggaatatcatcctctcccatcatggatattaagaacaatatcacagggaaggtggacaacccctgcgatattgagggtaatattatgctctccccttctggacatcaggaataatatcacaggaggtgtgtacaacccctgcgatattaggagtaatgccatcttttccccccgaatataagaaacaatatcacaggaagatgtacaccccctgagatattgggagtaatatcattctctcctactctggatattcagaacaatataacgggggtggagtggcgtgtatacccctgcggtattgggagtaatatcttcctctccaccgctggctattaggaacaatgtcacagaaggggtgtacaccccctggtgtattgggagtaatatcatcctctccgtccctggatattaggaacaatatcactaaggagtgtacacctcctgtgatactgagactagtatcatcctcttgccccctggatattaggaacaatatcacaggggtggtgtacacctcctgcgaatttggggcaaatgtcatcctctccacctttggatattagagacaatatcacaggaggggtctacgccccctgcaatattgggagtgatatcatcctctcccccccggatatcaggaacaatatcacagaagggatgtgcacccactgtgatattttgagtaatgtcatcctctacccgctggctattaagaacaatacaggtggtgtaagctttccgcgacattgggagttatagcatcgtctcccccagatatcaggaacaataatattaatattaataattaatatcaattattaatattaataaaatgatgctaattaatatcaatcattactattagtaattaaagtgcttacaatgaaattaatgttaataacatcaataagagccatagtaaataaaacattagcaatttatattgattaataactagtattagtattaataattaataataccattatgttagaaatcagtattagttgctatcaataattaataataataattagtgattactaatgacattatcactattatcatttctaataccgcacggggtctacacccaactgtgattttgttcctaatagtcagggcaggagagcatgatattagtttcaatatcgcagtaggtgtacacccgccctgtgatactgattctaatatccacgggtcagagtatgaaattactccaaatagagcagggggtgtccagccacccggtgatattgctcctaatattcacaaaagaagagaatgatatcactgccaatatcgcagggagtgtacacctcttctgtgatactgttcctagcatccggagggggagaggatgataatacttaaagtatcgcaggatgtgtacacccaccctgtgatattgttcctaatatccaggaagggagaggatgatattactcccctcatagcacagatgtacacccaccctgggatgttgttcctaatgtccatggaggagagaggctgatattactcccaatatcgcagggggtgtacatccaccctgtgatactgctcttaatattcaaaggccgggaggttgatattattcccaacatcgcagaaagtgtacacccccgtgtgatattgttcctaatatccagaaggggagaagatgatattactccccatatcgcaggaggtgtacagccactctgtgattttttttaataagcgggggggtggggggagaagataatattattctcaatttctcagggaatgtacaaccccctgtgagattgtccttaatattcaaagacagaggggatgatattactcccaatatcgcagaaagtgtacaccccctagtgatattgttcccatgatccacgatagaagaggatgatattactttcaatatcacagaatgtgtacacgcacccagtgatattgttcctaatttcaaggtgggagaggatgatatgacacctaatatcgcagagagtaaaaacactcctgtgatattgttcttaatatcaagggtggggagaggacgatattactgccaatactgcagagggtgtacacttgtctggaaatagttcataatttcaagaagggaagatggtattactcacaatatcataaacaagctgtcggtccaccgtggatcgtaatatccaagggaagagaggggggtgatattactccccatatcgtggggggtgcccacccccctgcgatgtggattgcaatatccagggggcaagatggggatgatattactccccatatcgcggggaatgtccaccccactgcgatgtggatcataatatccacgatatgggggtgatattactccacatattgcaggggggtgcccacccccctgcaatatggattgtaatatccaggggaggagaggggggtgataatactccccatattctcttatgatctcatgcctcctgcccagcccagagatgagactttccttacctaatgagaaaaggacagtctcttcaacaaacagtgctggaaaaactggatatccacatgtggaagaataaaaatggaccctcatctcacaacatacacaaaaatcaactcaaaatggattaaagacttaaatgtatgacccgaaaatgtaaaactatggaagaaaatataagggaaaaccctatgatgttgatctggacagtgatttttttggatatgacccgaaaggcacagacaacaaaagcaaaaataaagaaatgggattatgtcaaactaaaaagcttctgcccaagcaaggaaataatcaatagaatgaagagacaacctatggaatgagagaaaatatttgcaaaccatacatctgataagtggtcaatatccaaaatatataaggaaatcaaatgactcaataacaggaaatcaaataacctgatttacaaatgggcaaaggatctgagtagatatttctccaaagaagacatggaaatggccaattgctaagaaagtagattttaagtgttctttttacaaaaaaagataagtatttgagatagggctttgttaaatagctgaattttgccaatctacaatacataaatatatcaaaacatcatgttgtatgctataaatatatacaatttttatttgtcatttaaggtaaacaaatttttaaaaatgaaacaaacaaaaagatttgacaattccagaatgaatgactgagataaaatgtagtgatctgatcatcttgaaaggtcattacaattgattgaattattttggctgttgtggaatattttccacgtggccttgtttggaagcagggttataaataaggtcatcccttcctgattttagggatgtgaaatcaaacttagtattttaaaattttgttttgagttgggcttccactggtagaaaaataaatgagaacttaattccattatttagaattgaaaaaatagatttttaaacaaaatgatttgtctacctgtgctgtggtggaaaagtatgggtgtctgtgacagggtttcctttatcaagtgaaaaaacttcaacccagactgggctaatttttcatttggtaatatggccatatctgggaagcaatcatttccagatcttaactggcatttcaattactaacttttacatttcacatgtttaatggaacctggaaaaggagacacagattttagtcttcttggctagtttgtgggtatagaacaatcttaactcggacatcgtggaagtcagtgagctgtgtagacaggaccttctggggagctgattgttcatgcactgcaaaactctctttcaattattgaaatcaacttttttccaatgcctcaaagcaaggacgattctgaggcctttgaaagcaatttttcattttgtttctttgcatactgacacatctcgatgtttactacgtaacagaagagctaatttaaagcagtgtgttgctaagcctagctctctccctatgtctccctgcctctgccaccctggatcctgtggtcctcagtacttttctgtgccatacattagaatcccagaatggcattctaaataggagacaggcggcagagtagtaaaaattgagtgaatttatgattcaactgagaagattctctttccagtattcttttccccagtaaagtgattgtactgattcctttgtaaatttggtcacttggaaagttctaaggattgagcaaattgcttttaaagaatctccattttctgcatatgtatgtcacctactcaaaatcttattttccagtttaaattattttctaactaatatgttatacttccctcagcaatccctcaactgtaagaaaaatgcatttttttcttctagtgataaatagtaagttcattgcatttcttagaatataaacattcataattgataacgtccacacatctccccagtcctcatgtttgtattattagcttaatatggaaagactgtgtgtgtgtgtgtatgtgtgtgtgtgcatttgtgtccataataaaagagaaatcttatgtgtccataataaaagagaaatctattttgctaatgagagtttccaatcaacaaattttgccttgtgaattacagttttaaagtactttcaattgttaaatttattgctatttaaaatcctatttaggaaccttgctattaatactagaactttagttacagcctcaagtttgagcccctcccaaaaaatctcatctcctggagcctgcaaaagtgtataaaatatgttcagaaaaatacatcttggacagccatggagtggaatggagagctggtgggatatatggctgagaggagaggtccaagacagtgcctttcctggtcacaaggtcaaggtcaatatggctcacatgggtgatgccattttcttcttgttctcataacatccagaagatgtgctggctgatcagcagttttgcagaactgctactttggttctcagggagtgctctagaatatatttacataacttgagaaaaatgtcttgagcatatactgcatggccagtactgtgcctgagccctcttagtgtctagatgtgaattgtagttatagtctcatggctaaaagttgttttgtatttcagtctcttctgccacctggtttttaaaatgttttcctttttgagaaaatcacaattacctgtatatgtaaattttattgttaaagatgagtactgatattttgactttattttgggtcataggcttgcaaagctttacttaagacttcagtaagtaaaggcccatgactgatttgtagaatcactgaaataatagtaagactctacttctcagaagatgaaacagagtcttagagaagtttattactaaattagacagtttttttttgttttgtttttttttttgagatggtgtctcaccctgttgcccaggctggaatacagtggcacgatcctggctcactgcaatctccatctcccgggttcaagcgattctcctgcctcagcctctcaagtagctgggattacaggtatgtgccaccacgccgactaattttcatatttttagtagagatgggggtttcaccatgttggccaggctggtctcgaactcctgacctcaggtgctctgcccgccttgtcctcccaaagttctaggattacaggcatgagccattgtgcccagctgacagttgtgtttttaacttgaattttatacttaatttttgataagaatttttatttggggtgtattatgatatttgaatatatgatattttgtgggtatggagattgcagatgatttaccagatttgcagagcaagtaatagaggacagtttattccttcttagttttcacttgctcttcttccacatgtgttagccactgttagctccactccagatgagatagagcttcttttctgtctgagcatgaatttgctgggagccatgagataagttttttcttaggtcacatagttattaaataaatattcactgagtttaatttatgaacaacgaaagtaaaaccagacacgattcctccccaaaagatgagctcatgtgaaacagtggggaatgcatcatctttcaggttaccagtgtatggtggcactacagtatcaaggttatgtattatagacaataagtaaggaagacatatctgagctgattctaagatcagaatctggtgatgtgttaattgaacacttggcaattgctttcttagtttacccattcagattacttatcctattgaggaaatgaagatagaaaagattggtggctttattatatgttacactgatgctttgggttagagagcatgggttgcataaaatattttaaaatgcggatggataatttttagaccagttaggatggctacattagagaatccaagacaatgtctgccattatctttacaatacacactgatttttgtgtgtaccttgtcattatgtaagcttcctacagggctgtggtaagtcatggacagggttaaggagaagggtacatgtcgagaaactaaatcacatttggagaggagatgtaacaaaggtagggttcagaggtttactggtaacaattccaaatttggaatgaaaaagttactctttgtttagcgttcgagttgggagtttgccctgcaagagacagtcaaccactgacttcagtcgaacgtacttggaaagggaagaacttaaaccagccatgaacagaagaaagccaggttttctggaaacatcgccaaaacccagcaatttctcagaattttcagaggcgccaggggggtgtttgcatttcaatggaaaaagttctgaaagctctggaaactattctcagttttactttctcattgaaaggcaaaaaccatggctgtaagtaagagacagaagcatttgctatggctttgttaagaattaagaaaagggacctctggaaaatttgaattgtccaatcctttgccacagagccaagacaaagtggtccaagtcataatggcaaatagaaaataaaagtactgttagctttaagacaaaagtactcaatgtctggagccactttccaccagcctgggttttaaaagaaagacagaactttctagatttaaagagacatagttgcagctgtattgcaataacataatggtagctctcataagtacatacttgtcataagtatttaatcttttcacacactacaaataccttgttaggttgctaaggggttacagtacttatgagaaacgatctttgagaagaagaagaatactatttccagttaagatttagaagaattttaagtagatctatagtaacagtcaaaagtagaaaatatgcagtatagcaaacaaaattatttttggtctaattctaccacataaaacttgaaggcaacattgtccaacagaaatacactgtgaatcacatatgtaattaaaattttctacttgctacatttaagaagttaagacaaacaggtaaaattaattttaatgctgtattttgtttaatcaatgtctcaaatattatcattttaatatataatcaatataaaaaattagaagtgaaatactttacttttaatcttactgtatgaaatttataatttatgtttacaacatctctccatttggatgctaagttttcattggaaatacttgatttgtattcagatgtcataaaatttatggttgaaaaagtagatatataaacatacttaaaaattttctaataattgaaatgagtagcaatttttagttttaaactcattaaaattaataaaattaaacattcaatttctcagttgcactagccccgtttcaggtactcaactcagcagccacacgtggctaagtggaactgtattaaacagtgcagctcaaaaaggttgctaaattcatcttttattattctgtaattttgctctttcaaatattagctaaccagataagcttgtgaaagtgactaatgccccctttattatgcgaagatattttggggggaatacaaattgttctgtgagcttcgacctaccc

SEQ ID NO: 487 - DNA, 12194 bp, Homo sapiens
agcactgtctcttcagtgccctgatttctcacccagaggtttcaccctccttcatctcacgggcccagagccctgtctcactcaccccacctgtcttagaccccagttcccagcctgacaagctttccactcacaggggagaggctactgcagaacctgacggttcaggctgagtcgccctttggggttggggccctgacgcacctgctgctctctgggagccctgaggaccgagtggcctgcgcgctgaccctgcccttcatctgccggtgagtgggaagtgggtgccttgcggggttgggggaggagtgctgtgtttcccaggcccgttgcccaccttttgaaaggccctctcttccctgtaggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggatacctgtgttgtgtggtgtgtctgcttctgtttcttcgcccaccaagcagggtcttgttcaggtctttgtgtctggacacagaccacccttgcatgtgacagtttaataagtactgggacaaggttgagttcccaggctgctgcttaggatgtggttttgggcctcaggggaagcctgcttcctgctgtcagggcctcactcctctgacatagcaacccaactggacacacagatcttgcttggggctgaaagggttgtgctgagggaatgctgttagtctgatgatgtgttgaaggcctttgcattactgactgttgcccatcttgggcccccattctttggctcccttttcatctcctgggccacgtgtcctactgctgtctgtctgagggaagacctgctgtggagggaatctctgagccctgtcttagtcatgcccagagacagacaaagacctgtgctggcgttgaggggagggaagggctcacattgctttggtctccaaggcagggtctccatcatctggcttccagatctttttttttttttttttttttgactattattttgctttagattcagggggcacgtgcatgtttgttacacgggtgtattgtgtactggggaggattgggtttctagtgaacccattacccaaagagtgaacactatacccactaggcaattttccagcctttgccccgcacctacccgccccccttttggagtccccagtgtctgtttctatcttcatgcccctgtgtacccattgcttagttcccacttataacggagaacatgcagtatttggttttctgtgtctgagttagtttacttaggataatggcctccagctccattcatgttcctgcaaaggacgttatttcattttttaaggctgtgtactattccatggtgtatatgtaccacattttccttttttttttttaagagacagggtcttgctatgttgcccaggctggtctcaaaatcctaagttcaagcagttctcctgcctcagactcctaaaatgctgggatttataggcacgagccactgtgccagccaacattttctttattcagtcacccattgatggatacttaggttgggtccatgactttgctattgtgaatagtactgcaataaacacaatgagtccagctgtcttttacatgatttcttttcctgtgggtagatgctcgttagtgggatttctgagtcaaatgatagttctagttgtaggtctttgagaaatctctatgctgttttccagagaggttgagctaatttacattcccaccaacagtgtataagtattcctctttctccacattcatgccaacatctgttgctcttttactgtttaataattggcttgcagatttttgactcctcagtggcagcctgattttggggagagctgcactgggcctgccaaggtttgcttctgggcagctgaggttggcacttgctgtctctgagcctctgtgagtgttggtccaggtctctggttttcaggctatgcattagaaccaagcagtgagctttgaaaaactattgatgcctggggtctttttgctcacattggactgggcatcggtattttattttattttattttattttttggaatcttgttctgtcacccaggctggagtgtggtggtacaatattgactcattgcagcctccgcctctctggttcaagcaattctcatgcctcagcctcccaagtagctgggattacaggtgccaccatgcccggctaactttttttgtatttttagtagaaatggggtttcaccatgttggccagcctggtctcgaactcctgacctcaggtgatctgtctgccttggcctcccaaagtgctgggattacaggcgtgagccaccgcgcccagtcaggccctatcttcaaatatagtcacactgagggttgaactgtgatgtataaatgtgggggagacacaaacattcagtccataacactccctttcccccaaccctaggcaatcactaatctacatcgtatctctacagatgacctattctggacatgtcatataaatggaatcatacaatgtgtgatctttcatatctggcctctttcatatagcttaatgttatcaaggttcatccacactgtagcatctcatttctttttattaggaataatacagtttcactttatggattgctgtggtttgaacatgtaccccagagttcatgtgttggaaacttaacccccaattcaactgttgagaggtgggaactttaagaagtgattaggttatgtgggctcttccctcatgaatggattaatggcattattgcatgagtaggttagttatcaagggagtggacagctgatagataaatggatgggttctgcccccaccccaccccctctcttgcactgtcttgcccttctgctttctgctgtgggatgaggcagaaagaaggccctcaccagatgcagggcccttgaccttcgacttcccaacctctagaactgaaagaaagatatttctattctttataaattatccagccttaggcattctacgatgcagcacaaaacagactaagacatggatatgccactttcatttcttcaatcatcagttgacggacatttgggttgtttccactcgggctattatgaataatgctgctatgaatactcatgtacaagtttttttgtggaatatgcttttatttctcttggttacatatctagaagggaaattgctggatcatataactctatgtttaaacatgtgaggaactgccagaccattttccaaagttagtgaacgattttacattccaaccagccatgtgtgagggttccaatctctccatatcctcacaaaaacttgctaattacctctttcttttcagctttttttttttttttttttgagtcggaatctcactctgtcaccaggctggagtgcagtggcacaatctctgctcactgcaacctctgcctcccgagttcaagtgattctcctgcctcagcctcccgagtagctgggattacaggtgcctgccaccacacccagctaatttttgtatttttagtagagacggggttttgccaagttaaccaggctggtctccaactccagacctcaggtgatccgcccgcctcggcctcccagagtgttgggattacaggcgtgaaccactgagcctggcctttaaaatattatcattattatttgagatggagtctcgctctgttgctcaggctggagtgcagtggcacgatctcagctcactgcagcctccacctgccaggttcaagggattcttccgcctcagcctcccaagtagctgggactacaggtgcccaccaccatgtctggctaatttttttgtgtgtttttagtagagactgttttcaccatgttagccaggctggtctcgaactcctgacctcaggggatccacccacctcggccttccaaagtgttaggattacaggtgtgagccactgctccttgcctaattacctgtcttttttgttattgccatcctaataggtatgatgtggcatctcattgtagttttgatttgcatttctctggggactaatgatgttgaggatcttttcatgtaatcattggctatttatataacttctttgaactgtctattcaggtcgtttgcccattttttcttctttttcttttttattcttgacacagggtctcctctgttgctcaggagttcagtggcacaatctcagctcactgcagcctctgcctccaggtttcaagcaattctcctgtctcagcctcccaagtagctggaattacaggctcccaccaccacgcacagctaattttgtgtttttagtagagatggggttttgtcatgttggccaggctggtctcgaactcctgacctcaagtgacctgcccgccttgacctcccaaagtgctaggattataggtgtgagccaccatgcctgtctcgcatttttaaaaagctccccaggttgttccgatttgctgctgggttgatactcacattccagtgctcagatctgtccagaagagtggctgcagcacagttgtctgtccataactacctctatggcctctcgtttccacctcgtttctcagggtctcagtccagggaaggccttgccactttgtggctggagactgtgtcttgctttctgctctgagttcatcagtaacttgggaaagggctgtttcagagcaggcctgggccacctcagtgctgaggaagggctttgtcttgcaggctggctgggggttggttgcctgggagtgttttccccgaatttgcaaggggcttgcgcccgggttcgagtttacgtgtgtccatgaccaagtcttggagggaaggtcctagtgtagagtctgtgggtgggttcactgtgtctgtccccgtccctcagatttctttgtgtctggtatgtatgcctcttggggcctctatttatctgtcagggtctccgatgggagggtctccgaacctgaggtctaattgagccttagaatatcactcctgctaccaatccaaaaattccgtctgggacaagtctcccaggaatggcatgggtgggagggaggctcttgtctaggactcaggcgctagctttgagcggtgtctgtttgggggcctcagtccgtgtctgtaagtctccctagggagcggctctggggcttggtctggagaagccacttctctctggctctggcctcctggggctccctgcagctgaggccaaggctggggtgtggccgcctccgcggcaggccggcgggctgggctcgggtgggccggggcgctccctcctttccacgcccccacctcgggttcccccgttcatcgcccccccatccccatctcagcgggtcccggcttccttacatggtcacggccgggcttccagctcccggacgtcccccgccccccgcccccaccggacacggcccccgccctgttcgccccgcgccaccggcccgcgccccgccatggaggacctgggtgagtggggccggatccccgggtccgtggcccctcaccgctgcccagagctgcctccccgccgtcgctctcccgcatctccccatccctgtcttcttacttctgcttttcgcctctgcccgcgcctcctttccaactccacgtcccccttcctgcctctcccttcctgcctttcctgggccggccgctccctcccttcttccctcgctgtgctcctccatcccaggctgcggcagatggaacgggaggtgcggcgcccgcgggcgcccgggcgcggggctctggggagggaggggttaaaggggcctcggcccggggaccgggaaagtagagggcacgggaaagtctggcatcaagttttggagaaaaaaagcgggcctgcctgcaccagagttttgggagaggaggagttaagggctcctgagcacagtgagggtcaggtccttgaggcaaggaagagaatagtaactcaggagtgcctaggcgcccgcgaaggcttcagggtttcacgcgggtgctcagagacgaagactgagggcaggacttctgggttctggaagtgaaagggctcaaaagacccggatctggggatgcagggatggagagaggtgtcttgtccggaagggggacccaggtatctcgtcctccctgcgaagcctggggctggaaggctgtgcgctccacgggagagaggggcttccggcccctggcggtagagggcgctgctcggtaggggtaactgacgctgtaccgcagataaacagccaatcagaaggcaggtcccagcgaagcgccagtgaggagcccagggcgggactcaggggcctgggagtggccaggctgggcggggcctgtgtaggtagagggaggagttaaccagcatggaagagagagcgtccaatcagaaagctgagggccaggcactgggccaatggagcaatttggaggggagccaaatttggcttgggtgaagagcccattttgactgcatcagagaagatggggagaataaaataatcaggaggctgggtttgtgcttggctccaagcgtgagcaactgggatattctggtcataaatattccttgctacccttcgagcagtgctctgcctggctctggccctgtgacctcttctcttaatactggcttctgtccttctccagtactgcccactgggaaccttatcttctgatctaaccgtgacccttgtctctctccctgatggcctcttcctgcagatgccctgctctctgacctggagactaccacctcgcacatgccaaggtcaggggctcccaaagagcgccctgcggagcctctcacccctcccccatcctatggccaccagccacaggtgagatcggatgttggggactggggcagccactagggccaggctcggcctggtctatggggatctcagcctcagtggggcagagtgcaggcctgtcatcccacctgtgcgtctccgctctgtagacagggtctggggagtcttcaggagcctcgggggacaaggaccacctgtacaggtgaggggcctggaaaccagggcatgggggccaactgagtctcaggtgaggaggcttggattccccacccctgaacccaggctcccactctgcttcccagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacaggtaccagggtgactgagagaggccttgatgcgataggggcaggggagggaagggtggggcagagactaagaggaatacacttcccagagtagcagttaaagggacctaaagcctcaagtgtgagggtgcgttgagcatggccctatatgtagcgtcctcctctcctctctccagatgaaatcatgtctcagttcccatctagcaaggtggcttcaggagagcagaaggaggaccagtctgaagataagaaaagacccagcctgtgagtttggcgtcgttgtcagggctgagagatgagtcctggatatctgagtcactagagggagcgttgctctgggaggctctgagatgacacaagcatgttcttcacagcccttccagcccgtctcctggcctcccaaaggcttctgccacctcagccactctggagctggatagactgatggcctcactctctgacttccgcgttcaaaaccatgtgagttgggcagtgggccagtgtccatttgtggctccccaaccccttctagacaattccacatctgctgctttgctgactcaattctcatgtcctccccgctgcagcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtaagtggagccttgtgagaagggaggcagagacctgtcacagacccatctttagtgagagctgggctttatgctgttcccttttagtaagttaatctgggaagtgggtatcattattacttatgttttatggatgaggaaactgaagctctgaaccacacagcaggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaagatgggtatgttattattgtgtattacagcattttcttctagttcatttttttattctgaatttttaaaaacggatttttcacttcctccctcttatttattttgaggcaaattctcactcttgtgacccaagctggagtgcagtggtgcgattgtggctcactgcagcctcgaccttctgggctcaagtgatcctcccagctcagcctcccgagtagctgggactaaaggcgcccgccacctcgcccagctaattttatttatttattgtagagatggggcttcgccatgttgcccaggctggtctcaaactcctggactcaagtaatcctcccacctcagcctcccaaatgctaggattagaggcacgagccacccagcctgatcgtattttgattttaaaaaaattaaaacgtttttatgggcccctaaatgtattgtgggctccaggcgctgtgcctgctgtgcctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacgtgagccccgcccggccgcaccgagcccgccctatctcaccaggagagctgtgggacgggcctccaccgcatgggtcccgccccacccgcgataccccactccacccctaccccttccccttggcaatgtccacggccccttggactccactcttcctttctgacccccacgttcctagttagatcttctccccctccccccacgcatgccttagtccagtcacccgggttccgcgcgggagaggaaggcgcgaaggcacggaggccgcgctgagtgccctctccctccctgcagaagatggtgaccgccttgggcactcactggcacccagagcatttctgctgcgtcagttgcggggagcccttcggagatgagggtgagagtgaactcgactcccatcttaaaagctgcgggtcccctcgacgtctcgccccagcccctccgacctccggagtcctcagggccatggttttccttctgctctcttctggccctgccctctcctacacagactccggacccgagccctccccgctctgtcccgccatagacccggctcctccttccccaaggctccctcggactgcccctccttcggccccagatctcaggtcttgtgggtcccccgtcccgcccgcaccctttgctttcagcccactcggttccctctcctaggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggtgcgagctgcggggcggggcgttggaggggcgggtcaagggtacagggctgtggggcggggccttggaggggcgggtcaagggtgcagggcagggggcgggccctcgggggggcgggtcacgggaggtgctgctaggaacctcgggtggggcgagttttccgggcagggtcccaccggacgggattcttcgcgtctagggcgggctgcggggtcccagggcgttatccgctagtaacgcgcgttgtctggcagtggccgctgacctgtctgtcctctttcgcggcttcccttccccaggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccc

SEQ ID NO: 488 - DNA, 12605 bp, Homo sapiens
cttatttccattggaaatttcactgctgggtggtttagagtccttgtcattctcttccctgtcctagctcatggatgtgtgttactgtttcagttcggagcagggtccttaaaggggcagggtcatggctccccagcctcaggggtgtcatcaataatgttctgggccaggtgtggtagctcatgcctgtaatcccagcactttgggaggctgaggtgggtggatcacttgaggtcaggagttcaggacaagcctggtcaacatggtgaaacactgtctttactaaaaatacaaaaattatccaggtggtgcatgcctgtaatcccagctacttgggaggctgagacaggagaatcacttgaacctgggaggcagaggttgcagtgagtagagatcatgccattgcacttcagcctgggcagcagagtgagactctgtggcaaaagaaaaaaaaacagtgttctgaattattcaagccctgtcctggagtcaaactgaactcttccctctaactccccaactagcgccacactgaggagcaacagctgccttgaatcccccgctgttccattcactaaactagattagatggggagggggagggcatagaaggtgctggggagctgcagcctcattgttgtgattcattcacttaatggatcttgtgcagagcacagttcaaggccctggggatgaagtagtgaccaagacagaggaggcctctccctgccctccccaggcacccagtccagcaaggagtgggggatttagccaggagagggtgtcagtgaggacaaaacgtgctcaatgacaggatacagggagagggcagaggcggcaaaccgcgggtcagggaagcctctcgtgggaagcactgtttagcctggaacctgaaggacaagaatgagactgctccagggagagtgagggccaggaggaggacaccagtgcagggccatgaggtgggagaggctcagggggctccaggagcatcaagacaggtggcaagagtgacgagagcacagagaggaaagggggtaggagtcatgaggggctggcagagggattccagggcgaccccagggaccgggcctgtgagtcaagagaaagaggctggattgattctaggcactgggaagccatggagggatgtcagcagggttgatttcacgaagctgcctctggctgcagtgttggcacctggctgggatgggggcgggagaggcagcaggaagaccagggaggaggctggggcaggaggtgtccagctgggaggggaccagggcctggagaagggtgtgcatgggcacggagagaagcagatgtgcccaagacccatgttgccttcgggctgacagaggtgctgatggaacagaggtgtggacgaggagggaggaatcccagatcagagtgctcagcactgaggggtgcactctcaatcagggcctgaccagggatgaagggaagctctgaagatgggtgagggagggtgtcagatctccattaggaaacggagtggagaatggtctgtgactctgcacgactccctgggaatcttgcgcgtatccacgcaggccacataagcaaggctcagctgcggtccaacctgtgtctcggctgaatgccctacaattcctcctgcagccaggggagctaagacttgggagaagccactgagaggtctttctcagctgcaggctacaaaattgtttggctgtaatatggaggcagctcctaaatggctgagtgaccctctgctcacactgtcatccgatccctccgggtcagagtcagactgtgggatgagggacaagggagctgacctcctgcccattttgcttctgctgttcttgtaaataataaactgtctaaatccacgtgggctcattgtctcatccctggctggatgcatggaagtgcgccaaatccaccagcagctgcagtcatgtagccacccacgctgtcgcttggaaattgcttcacagtttgataaattggtcccaaacgtggggccagtaagggtacaatgcctttctggagagaagacagaagaggcccacgtggccgaccaaatgaagagatgtggaagaccccaggatcgcccaggcatgctgtcacccagggagggtgagaggaggggaacagggtacccctctgtcctacctcctgaggaatgtttgcaggctgagtagcaagaggaagaattgaaaccagccaaccaaatgctgcccctcctgatgtccagagagttcttgggctcagggagatgtaaaaatgaaaacaaaaacaaaaccagacaggatgaaatagaggaggaggctgggtcgggggcctggaaggagagagcagctctgcacatcagccgatgctgtgactcctgactgcaaggtctgctcccacaggggaagggccacagttaggacagtggccggtgggacaagcacacacctgggagcccaccaggcttcacctgcccagccacttgatggcagtaaagcagcatagaatagaagagggcaggggccacagcactaaagagctgtagaggaagaggtgcgtaaggaaaccatccagcagctgtgcggactgccctccccagccaattagtcctgaagagccttgaaaattatgagtgtgcgtggcggacaattactcagcctggagccagttgcagcaggatgctggcagtcaacaaaggtgacccctggtgttctgagtacagcagtgacttgacagacagggcccagcacaccccctcgagtggtaattactgacttgcagctgggtgtaggtagacactgagggtagagctccccatgcatggttcctcccaggcagacccttatagggtgggtctggaggaaagacaccaacacagtggacactgcccagcaaatgtctgtcatcaaatgacagggggacagccaagaaaggaggaagccaggcatcaatggaatctcccatcagcctgaaaaagtggcaatcacccgccaggggcagctaccccagacctggggtctgcaccagcacctcaggctccttgtgaacttcaccacagcgcagtccctgaggaggcctgggcctgattcacagacagatcagccaagctacaggacccacagaaaacactgatgaaagctgcatatgaagaaagaagtctggccaggggcagtggtgcaggctatggttcttgccctggaaacagcccccaccaaagttcacagccagtgggctgaccatgtggtctggcacttgacaatggaacaactggatgtcaagtcccaaccctggttgggacaaacattaggcttcagattgcacagggcccagggcctctgaaaacccagtgaaaaggaccccttggcagtgaacgtcagtgaaaccaataagctgaccaattctgcatagcccaggtaagcatcagagccacctggatacaccatcacacgaggcctggccatctgtccatagctcaggactggggcccacgtcaaagcctagtgaggccagcacatgaggccaagcaagcctgcaagtgtaccagctccacagtcaagggacaaagtgactccagtgcacacagcgacctgtgcactccagtacactgacctggccagtcctggaaaacagactccacggaccccttccccttctgccaggagcaccactgggtgctgacgaccgtagatgcagcaattcccatctgcggggaacgtgggccgtgctgcttgacaagtcctaaatgtactgctgcatatctgaactcctggagcacatccagtcggacaatgatgccgccctcatagccaagagaaccagcaataggcagctatctgagggctgctgtgtgggacatttcatgtcgcctaccacccacagacagcaggtgacttaaaagatgaactaaaaaaaaaaaaactgaaaagataagtggactctaattgtggcaattctccaggaaggtaccattcatttaaataaaatatttagttatgaggtagggagggggaataagaaaagacccacactggctgtgagagaccctgctgcataattcatcctcctcactcttctctgcccacctccatccctgcatggaggaacccgggctactgacccgtgggctgcaaggtgggggttggtgtgggagatgctaatccggtcactcttacctcctggctctgcgtgcgagcgctgggcagttgtggatattgatgataatgatcatgatcattatctcaggcgtgatcactcctaagagtgccgctggcgcagcccgcacgtctggggtgatacatagtaatcacctccagaagaacactgtgggttaggaatagtgaggatttcgaaaagcggagcagctctgctggaggagaaggaacaccctaggctcccggaggcatagagaggccagaccattagcgtcttttggctctcgcctgcaggacacctggcccacctgtcgtctcagaatgctgtggtcaccttgtcccagaccattaccactgccctcagtctaactcctggacacccattctctcaagagagcctcaactgaggactgttgactttggaggcaagacagcccccgccaaagcaatgaaacatgattaattttccagacactgatgaggcctcccttggcctcatcttattatcgctggtaccctactgccaaaacaaacgaacaaacaaaccaaacactctcttgtgtgcttttcacagatcatagctactgctctgaatttaatgagccactggacctatcatcctccacctgaccctgatgactagaccgcactccctcatttccacctcctcccaaatacttttggacatgaggggccaggcctcagccagggggcatatgagaagatcactttgggagaaacttgcctgtcttgaaggcaaggaacagggacaggtggccaaacacctgggctccagctctgcacctggtagtgctggagtcgtgcagtcacccagctggcacctgggctctggtatgaggccgtgtgggtccagtccatcatagctactcagccccctgtttattggggacagagtgtgtgtttctgcttgctcctgagggcctaggtttcctgggttgtgactcctggggctttggtcatgaggaagttgagataaagcccataaagtgcttagcccgcacgtgggtcctcttcagtgcatccagagcccaagcggcatctcttgcctgcccttcacagcaaagggtgctcctcatggcagaacagggtgtctgggcagctcctttgcttacagacaacaaacaggacccagttaggaaaaggacttggccaaggtcccagagagaccaagacctggcagcctggaccccatcccaggttctcgcccgcagcaagagtaaacaccagagtacgtgtctgtacaacccttgacaaagccaaccagaaaagccctgacccgatctgagcttgaccttgaccctcattctcactccagtccctaaatctaacttgacactgaccctgacttcaaccctaatccctaattgtatccctcacactgactttaacccagaccctcgccttatcctttcccaggtgcccataagagggcagcccctgtcccctgctgggccccagtggtcagccgtccctctgggagagtgacagctgaggtcctggggccctccttagggccctactagtgagcatctgcttcactcacacagtgacactaagcacctctccagcagcccctggtcacccctctggcctcagcatccctccagccttctctggagctgcagtaggcaaggggcatgcacagtgggcaccctgctcacgcactggctccagcatcctcgggggtggtgtgaatgaacagaggcttggtcagcactcgggtccctcagatgcctgccagctcccactgtggggcagctgttccagaccatactccagacagggaacagggctgccatccaggaggcccctggggaggctcgctgacaaagaagtcagcagtcccttcagaggacttcatggggccatgctgtgccctggtccctttcagaacgccctctccatccaccactacctctgggtcactggctatagcctggccacgccactctgtggctttcctgcagctggagctccaaccaagcagtagggcagtgcctggaggtgtcctgccacactggcatcatagctgcctggtgtgggcacacggccccaggagggccaggcctgagcctctggtgccgtgtgtgactatggagcaaggcacagagggtgtccatcttttcttccccttctcctgaggcatcagcatcaacttgctgtctactcctggcctgtgtttgcccggggctccatttccctggggcccgtccatcctggacacaccagaggggttgtttgcacggatgcttctccagccagtctgagatgctgacctactctgggggtcaggcccttcagagtccaacccctcccgtgtcaacctgtattctgtcctcgtccccaactgctgtggagcacaggcccctggcgaggcggcctgcactgtgcccgggggaaggatgggaagaagacaccacagaggactgttgactttggaggcaagagagcccccgccaaagcaatgaaacatgggcccaggtctggaaaggggctgtgaagagagaagccttcttcctaggggaacaggggcttcatatgacctaggcctgcaaggatggatctgcctaggacctagtgggactggaggagggcatttctgcaagaaaagagatgagtgagaggggcaggagcaggagggcagggcagaacagggtggcagatggagttgactggtgaagggagtagtgggcctgggggaagcaggactagaggttgtatgattgactgcatgcaggcccgggtgcagttgtgggtggggcggttgtccagggccagggctgccgtctaggataagcaggtggtccggctgtgcaacctggacacatctgctcactgaaaaggcctttggccccttgggtatctgtcattctcagccccacgtcctggcccccgagggcaaggccaatgtgtttgagtcccactgtagcctgggactcagcccttacaggagaggaaactgcctgagtccgtgaatgggccgtgtctccctgtgcctctctccactctgtcccaggtgattgtgaagtgccatttgggattattaggaagaatcttagcacttcctcaagatcaccactgaagagagaatcctcatcccgggaaagaggtgggaactagaatggtggagggactggagctaggccctgccaggctgctctgaacatcagtgagatcactgaggtgctagggtccctgctggccaaccctgccatccagagactgggcaccagcaggctctctgggcagccaggggctcctgcagcagctgggagaggtcaccctggaatgtggactgggtgggtcttctgtgcatgaagcactcactgcagtggtcaggctcatctacagcaaggactcctgcctgcctgcctgctctgtgggtttcgttgtaagggtctgatatagctctgtctgcccttggactcttccaggacccttttaaaacactgcagccccctaggctctgtccagatgctcttttttatttattttatttttatttttatttttatttttgaggcagggtttcattttgtcacccaggattgagtgcagaggtgcgatctccgctcactgcaacctcgaccctccaggctcagggatcttcccacctcagcctcccgagtagctgggaccacaggcacacaccaacacacccagctaattattttattttgtatttgtagagacagggtctcactatgttgcccaggctggtcttgaactctcagtttccagcagccttcctgcctcagcctcccaaagtgagccactgtgcccagccagaggctccagttccactggtgttgggtgaggcctagtgagagggtgggcagagggccttgttgaatctgaactgcagcaagggctcgcagatctcaaaggaggcagggaagtgtgctggggtcccgtcagcatcgcatgaactcagggatggctgcatttgaggccagggtcaggctgtcctcacttatcaggggacaagagctggctgatgccgattggaaaggatagaatcctagtgagctgccccagtcccggtaagcatgagtgcctgcatatcctcgctcttcctcagttccacccccttcctgggggtgtcacaggctcctggcagaaccagagcccatgccctgcatttgggctggcacatttagtggaaccagccagagaaatgctgtccctccttcctggggaagtggtggcaaacagaggcgccaaggctctctctgcccactgcccacatcatctctgggactctgcgggtgccctctgccccaaggctactgccagggactcaggtgtggctgggctttccagagcctccctcaaccctcccctcacaggctgaagtcagtacttcgtttgggggagccacacccagagccaggagcctgacttgctcagggcctagggaatgggaccaagagtgatccagcttcttctccagagctgcaccctgcacaaatccaccctctccctacgctttgccctggacactttcagaacacatcacactgcctgtcatcatgcatctccggctagggcagagggagaccgtgcacgtcacccggcacaatgtgacggaagataaactgtgtggggaagagaaactgaggcccaacaggaataaagctgccccaagacccagctcctgcctctcttggtcccacactagaaccactgtttaaataaagtcctcccctcccaaaggtactcctgctccccaactacagcagggtcctgggtcctgggtctgagggtttattggtcagggcccaggcagatgtcatgtgcccctgttgtccccacgcaggcccacagacatcacaggagaatgatttacaagccacttggggcctgctggcagtgagggtttacccaccccccgccccagcttgctccagtgccgccgtttacgtcatgggtacgtggcctgcagttcacggatctccaggcccatcctgttgactgcatacccagtgaggcttcgagcctgccagaggtcaatacagcccagcagactaaagtcagttttccaaaaggactctggaattcagcaaaatgaatggaaggtcctttacagcgtactcactccaccattgtacagatggcagcactgaggcccggagaggctctggaacttgggagaaaggctcaggctaagagaagccagggactcctcacccccagcctgtgagctgctgcagattaaggggtcattgaagatgggctagtggccaagggaaaaccaccacatccagggccacacccgtcacccctcaccctcatcccagtcagggcagcagcagcatcttcctgtgcaaaacaaaatgctcatctcctccaagagctgcttctgagggcctgtcctgccccttgccttgggtaatgagggacaggctggcagtgccctgctcagctcttcagtctgtccaggaaaggccaggctaccagagctccctggagtgccagtggccaggtaagcggtgcagcctcatgtcttctttctggatgtgctcgtaacaggactggagggagagaggcaaggctgaggccagttgacctgcctgatcccaaccacatgcacaggatctagggctcaatagctgtgtgcacccacctcccaacccagaggaggcgtgtctccaactcagccctcagccacagtctgcgaggaaaatggggcccttcctctcccactgtgcttgggaatgcagcatggagcaatcatggccccagggtccccagggctgggatgcactgtgggacccctccctggctcctttaataagagcaggatcagggacactgtgaggacccttcccagagtcacacatgagctgtgaatttgagctccctcccactatggtgttatgatgtctgggaagggaaaagggtctgccccaggggccagggcatttccacctcggtccacagcccctgtcccttacctccagggctgtgagcaggaagtcatacaggcctcctgtgtggttggggtccatcatgtcacggatcaggtggatctcggctcccaggtgctgaattctggagaacaccgccccaccaagagagcgagggagacaaggagaagaggcctgtcgcggacaggcagctggggaaggagcgctggcctggatggctggacacctggggtgtggtcctcactctacctctagcaccccagcaccctggctgggaccctcccttttctgggccttggcttccccatctgtacagagagaagctgcatccataaaccctggggttcagaggtatcagaagatatcgtggttgggggtgggaccctgcccctgccctgcacccccagctcctgactgcctcaccgggcgcgcgacaccacgtagatgagaagtggcagcaggtcgtccatgggcagcttgtactcccggcccaataccctcgacaccgtgccctcaatttccccgtatgtcctctccagcacctccagcttctcccgtgggtccaccgtggtcctgcagcagggtagctggctccaggtcaaggcccttggttcagtcccaaccaggagcaccccacactctgcctccggacccccaacccactacggctcacactcacatgatcttctgcaggcactcggtggctgacaggaaacacttgtccctgaccagggagtacctctgcatggtggagggagtgggctggatgaggccatggccccccagctctgacatcccctccttcccagggccgggcctgagtcccccgccacccttcccttcactgccagctttagtgcagccccaccctgagggctgagtgacccagggcaagtcacagctccactgtgggcctcagtttgtgcaaccataaaacggggtgaatagtctccatgaggttgggaggatccaaacggataagaagataataatcataacaggcactggccactgggtgccgcccagttctgagtgcctatgtcgatggttctcaaacccaagggcttagtgaaacacaggttcccgggcccactccctgcatttctgactcggtaggtctgaggtggttccaagaatctgctttcctaacaggttcccagatgatcctgatgcttccagcctggcaggcacattttgagaacagctgcctcatgtgcccacttcaccctcacaacaattttgaggtggttctggccaagcgcagtggctcacgcctgtaatcccaccactttaggaggcgaaggcaagcagatcacctgaggtcaggagtttgagaccagcctggccaacatggtgaaatcctgtctctaccaaaaatacaaaaattagctgggcatggtagtgagcacttggcaggcgcctgtaatcccagctactcgggaggctgaggcaggttagtcacttgaacccgggaggcggaggttgcagtgagctgagatcgcaccactgcactctaacccgggcgataaagtgagactttttctcgaaaagtaaataaataaataaataaaataagaattttgaggttgttctagtgttggctcccttttactgatgaggcagctgaggcacggtgcacgagcctcttgcacacggtcacacagccaggtaagaacctgtgtttgagcctggtggttacaggccaacagcttacctccaccacactgggaggtcagaatgacagtgtctcctcccaacccaccctgcccctccccagctcctctgcagcctccgcccagcaatcatgaggcaaagggctcctcaaagcctgcaggacctctgggggcccctggcttggggctctggcctccctctcacctgattgctcgtcagcgtgaggtccttgaggggccacaagtgcctgaaattgaaaaagtgagacaggaggctctgcctcgacaaggggcagagtctgaggtcagagggcaaattccctatgccactgtttcccccggcagatctgggtcctgaaaaggggaaggagatcagcctaggtcatggggaggatggaaggattcctggagaaggcagagctccagaagctccagggaggtaagggcggcccaggggcttgtatgagccaggtcgtggtgaccagtagagagggaggggtgaggagactgcactccatccaggaggctctgctgagccagcacagggctgtgagcagggggatgcagccctcatgcagcagaggtggaggctggtgtggggaagcgacactgaggtggtgagggaggcggggcatgcttgggaagcactggcagccaggtctttaggctggtggctggtcagatgcaggacacagtcaccaagatagaggaagaaacagggatttgcagggtgggtgggaagcaccatccctgtgtaacaaaggagacctggatgtgggagcagagacagtgcccgtgccctctactgtggacagtggggtcacttgtgg

SEQ ID NO: 489 - DNA, 13065 bp, Homo sapiens
ccctgcctcatgccatatcctatatcaagatcacttgggaatttatttccagattcttatattaagtacatttaatattatattggcttttattcacacttacctatgagtctgcctgcctgcctgcctgcctgcctgcctgcctgccttccttccttccttcctctgtttgttactttgtcttttttttttttttaacttcctgacatttcggttgggtgcagtagctcacgcctgtaatcccagcactttgggaggccaaggtaggcggattatgaggtcaggagatcgagatcatcctggcctagagggtgaaaccccgtctctactaaaatacaaaaaaaaaaagaaaatagctgggcatggtggcgcacgcctgtagtcccagctactcgggaggctgaggcaggggaatagcttgaacttgggaggcggaggttgcagtgagctgttgcagtgagccgagatcgcaccactgcactccagcctggcaacagagcaagactccatctcaaaacaaaaaacaaaaaaaaacaaacttcttcttctttctcctttatttctatgctgaggttttgttttgttttgtttaagacaaggtctctgttgtccagcctggagtgcagtggcgtagtcatggctcactgcagcctcgacctcctagactcaggtgatcttcccacccccacctcagcctcccggatagctgggactacaggcacacaccaccacacctggctaatttttgtagatatagggtttcgccatgttgcccaggctgaactcgaactcctgggctcaagtgatcccacccacttcaccctcccaaagtactaggattacaggcatgaatcctagtgctaggattaccgcacccaggctgtatggtagttttgttggaatatacaacctaaataaatattttaagagagaattcaataggtgatggttttgaggcctgacatgtccaacaaggcctttgtttcatcctcccaaatactggctgggtaaaagactctatgttcaaaatacttttcctgagaactgtgaagatactcttccataatcttctggccttcagggttgctgatgagaagtatggggtctgcttcataattcttttgtggaagtgggaaaggagtttccctttagggacttcactgccatcctgcactgtgttttgttttattctttttccctttctgtgcttgccaaagggtacctgggccactgccctgctctgccctccaaaaccaaagcccgagccaaatcttagctcaccagtccctacccagagggatactaaccacttcatttggagatatcttctccccatctgggtctggggatgactgtcttgtgtagccagtctgcgagtatgagtggagatggaaccagagtcttttgattagtttctctgctgtccaccccaccaccattccagtccctcatccattctgctctgagctgggattttctagcatttggttaggaaaactggtcctcacatcttcagagggcccttcttcactcctggtggtggtggtgtttgtatatctgacgctactacctaccttccctagaaattgctcattgtttcttgcccaccaatggcaaccttccccctgctactcatttgcttggtgagtaattattgagtgccccctgtatgccagatggtgtgctaggcaccatggttatagtggtgacccggagagacacagtatctggcctcgtggactttacagctcagcaaaagagggatcttaaaccaataatcactgaaatatatgggcacaagttgggaaaagtgctctgaggaaaagcagatggtgctgagcgctaaggagggcctcctgagcaagtgatggtcttaggtgcatcttagctgaggagaagggaacaggcatgtgaagagtggaaagaacattccatacagtgaaaaggctctgaggcagaatgagtggagagaagaccaggctgtccagaatgtggtgaacgaggggagagaggaggggcaggcagacccttccccatcatatgtcgaggttacccgacctattccatgaaaggcacaaccacaaagagaaagacaagctgggtcctgctggagacaagcctgcacttgccatttttttgttttgttttgtaattttattgaggtacaatctatatgacataaaaatcatccattttaagtgtccaattcattgatttttcataaatgtactgaattgtgcaaccatcactataatccagttttagaacagtttgccaccccagtgagatccttcgtggtgtttttggttaacgtcttcacttgcaacatgcactaatgtgaagtgacctttcccttctaggtcttgcaggtggaacagatgtgcccttttcagaggttgtgaagttagctccaaatcccagactagctgctaccccaagcccgggagcttctcaggtgagagaccatcggaatttgtttgtagcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatggggtgaggcagctctttatagctaaagcagtctccaaagtgggctgtcagctgagggctctctgccaacagcactcccatcagttgggagaataagttcttcattcccgaggtgaatctggatggcacaccatagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtggttcaacatgagaactctggtcatcttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaatttgaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgtctcaaaaaaaaaaaaaaaaagttactaatatgatattttacatttccttttttgcatgaagcttttgaaatttggtgtgcatttaacacttatagttctgggcatgcttcaagtatgcaaaggtatacatggcttgcagctactgtattggatagtgcagctctggatgtgctccacatggtgacaggacagctatagctgccccaaacatcatgtcttcacagctgtattcgaaggcagggatcagaaggtgacattgggcagagagtctctcctcacacacctcttgctcatcagggagaaaaatactggcctatccctcccctatcccacacacgcccaacaggctaccacttggtcatatggtcaattctggttgtaggaaagtctagggtagggtctggctctttcattctatctagaaggaggccagcaaggaggaagataactggggaaagttttagggcagcacagcagcgtctgcctcatctagagtacggagtggccaatcctctgagctgtatgtgcctcatcactctccctggcctgcccatggccgaaatcactgacaactcatggaaccctttaccattggatccaaatgtaacctcaaaagcccacccaacagcaggttgcaagcagtgacagtctatatgattgtcagcgtatgtgacttatatgcagactgaatttgtggactagagttaaacttcttgagagcagggccacatccttcattctctctgtggcacctacagcactgcttgtgctcaaggggaaactcaaagcagtaagaatgttttctcccttagctcagctgaacgttgcagtttctccatgaggagaaatcaaagccccttagctttgttctctgactccttaatgtccaatacaggctaggacaaccttaggcccctcgcctgtgggcctctttataaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggccgaggcggatggatcacatgaggtcaggagttagagaccagcctggccaacatggtgaaaccccatctctactaaaaaagaaaaaaacacaaaaattagctgggtgtggtggtgcacacctgtagtcccagctacttgagaggttcaggcacgagaatcacttgaaaccaggaggtggaagcttcagttaatcaagattgcaccactgcacctccagcctgggtaacagagtgagaccctgtctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgtgtgcttgcctgaagtgcatctgcatttctcaggtaagatggacagccacagggaaaactgcttagggggataaaagaagagtaagaatgtggggttgtgtttctttttggtcttttttctctgttgggctttttgtttatttattttggcttataatgcagcacattgtatatataattttgtagcttctttaaaatttctacattacaaaataaatatttcattcttaaaaatgtatgtgcataccatttttaatgactgtataatattctatctgggtagaccaggcacggtggctcatacctataatcccagcactttgggaggctgaggcgggaggatcacttgaggccaggagctggagaccagcctgggcaaacatgagacctcatctctttaaaaaaaaaaaaaaaaaaaaaaagctggcagccaagatggccaaataggaacagctcgggtctacagctcccagcatgagcaacgcagaagacgggtgatttctgcattttccatctgaggtactgggttcatctcactagggagtgccagacagtgggcacaggacagtgggtgcagtgcaccgtgcgcaagccgaagcagggcgaggcattgcctcactcgagaagtgcaaggggtcagggagttccctttcctagtcaaagaaaggggtgacagatggcacctggaaaatcgggtcactctcaccctaatactgcgcttttccgacaggcttaaaaaacggcgcaccaggagattatatcccgcacctggctcagagggtcctacgcccacggagtcttgctgattgctagcacagcagtctgagatcaaactgcaaggcggcagccaggctgggggaggggcgcctgccattgcccaggcttgcttaggtaaacaaagcagccaggaggctcgaactgggtggagcccaccacagctcaaggaggcctgcctgcctctgtaggctccacctctgggggcagggcacagacaaacaaaaagacagcagtaacctctgcagtgttaaatatccctgtctgacagctttgaagagagcagtggttctcccagcacacctctggagatctgagaatgggcagactgcctcctcaagtgggtccctgacccctgacccccgagcagcctacctgggaggcaccccccagtaggggcagattgacagcccacacggccgggtactcctctgagacaaaacttccagagaaatgatcagacagcagcattcgtggttcacgaaaatctgctgttctgcagccaccactgctgatacccaggcaaacagggtctggagtggaccgctagcaaactccaacagacctgcagctgagggtcctgtctgttagaaggaaaactaacaaacagaaagacatccgcaccaaaaacccatctgtacatcaccatcatcagagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactatgtgaagaatgcagaagcctcaggagccgatgcgatcagctggaagaaagggtatcagtgatggaagatgaaatgaatgaaatgaagtgagaagggaagtttagagaaaaaagaataaaaagaaacaagcaaagcctccaggaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcactaaacatggaaaggaacaacctgtaccagccactgcaaaatcatgccaaattgtaaagaccatcgaggctaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaaacaaatggaaaacaaaaaaaggcaggggttgcaatcctagtctctgataaaacagactttaaaccaacaaagatcaaaagagacaaagaaggccattacataatggtaaagggatcagttcaacaagaagagctaactgtcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatacccagaaattgaactcagctctgcaccaagcggacctaatagacatctacagaactctccaccccaaatcaacagaatatacatttttttcagcaccacaccacacctattccaaaattgaccacatacttggaagtaaagctctcctcagcaaacgtaaaagaacagaaattataacaaactgtctctcagaccacagtgcaatcaaactagaactcaggattaagaaactcactcaaaaccactcagctgcatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagaagaactgaaggaaatacagacacaaaaaaacccttcaaaaaattaatgaattcaggagctggttttttgaaaggatcaacaaaattgatagaccactagcaagactaataaagaagaaaagagagaagaatcaaatagacgcaataaaaaatgataaaggggatatcaccaccgagcccacagaaatacaaactaccatcagagaatactgcaaacacctctacgcaaataaactagaaaatctagaagaaatggataaattcctcgacacatacaccctcccaagactaaaccaggaagaagttgaatctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcagcatcctgataccaaagccgggcagagacagaaacaaaaaagagaattttagaccaatatccttgatgagcattgatgcaaaaaccctcaataaaatactggcaaaccaaatccagcagcacatccaaaagcttatccaccatgatcaagtgggcctcatccctgagatgcaaggctggttcaatatatgcaaatcaataaatgtaatccaacatataaacagaaccaaagacaaaaaccacatgattatctcaatagatgcagaaaaggcctttgacaaaattcaacaatgcttcatgctaaaaactctcaataaattaggtattgatgggacatatctcaaaataataagagctatctatgacaaacccacagccaatatcatactgaatgggcaaaaactagaagcattccccttgaaaactggcacaagacagggatgccctctctcaccactcctattcaacgtagtgttggaagttctggccagggcaattaggcaggagaaggaaataaagggtactcagttaggaaaagaggaagtcaaattgtccctgtttgcagatgacatgattgtatatctagaaaaccccattttctcagcacaaaatctcctaaagctgataagcaacttcagcaaagtctcaggatacaaaatcaatgtacaaaaatcacaagcattcttatacaccaagaagagacagagagccaaatcatgagtgaactcccattcacaattgcttcaaagagaataaaatacttaggaatccaacttacaagggacatgaaggacctcttcaaggagaactacaaaccactgctcaatgaaataaaagaggttacaaacaaatggaagaacattccatgctcatggataggaggaatcaatatcacgaaaatggccatactgcccaaggtaatttatagattcaatgccatccccatcaagctaccaatgactttcttcacagaattggaaaatactactttaaagttcatatggaaccaaaaaagagcccgcatcgccaagtcaatcctaagccaaaagaacaaagctggaggcatcatgctacctgacttcaaactatactacaaggctacagtaatcaaaacagcatggtactggtaccaaaacagagatatagatcaatggaacagaacagagccctcagaaataatgctgcatatctacaactatctgatctttgacaaacctgagaaaaacaagaaatggggaaaggattccctatttaataaatggtgctgggaaaactggctagccatgtgtagaaagctgaaactggatcccttccttacaccttatacaaaaatcaattcaagatggattaaagacttaaatgttagacctaaaaccataaaaaccctagaggaaaacctaggcattaccattcaggacagaggcatgggcaaggacttcatgtctaaaacaccaaaagcaatggcaacagaagccaaaattgacaaatgggatctaattaaactaaagagcttctgcacagcaaacgaaactaccatcagagcgaacaggtaacctacaaaatgggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactaggtatatacccaaaggactataaatcatgctgctataaagacacatgcagacatatgtttattgcggcactattcacaatagcaaagacttggaaccaacccaaatgtctacaatgatagactagattaagaaaatgtggcacatatacaccatggaatactatgcagccataaaaaaggatgatttcatgtcctttgtagggacatggatgaaattggaaatcatcattctctgtaaactatcgcaaggacaaaaaaccaaacaccacatgttctcactcataggtgggaattgaacaatgagaacacatggacacaggaaggggaacatcacactctggggactgttgtggggtggggggagaggggagggatagcattaggagatatacctgatgctaaatgacgagttaatgagtgcagcacaccagcatggcacatgtatacatatgtaactaacctgcacattgtgcacatgtaccctaaaacttaaagtataaaaaaaaaaatctggcaaattttttgccagaactgcaatttactcgaacattttccttgccttagta

SEQ ID NO: 490 - DNA, 13104 bp, Homo sapiens
tataaccttgggtatttttttctttctttgtgtgtgtatgttttttatttgtttggctggtttttttttgtttttgttttttgttttttgttttttgtttttgtttttgttttgagacagagtctcactctgtcgccgaggctggagtgcagtgacaggatctcgggtcactgcaagctccgcctaccgggttcacgccattctcctgcctcagcctcctgagtagctgggaccacaggcacccaccaccacacctggctaatttttttttgtatttttagtagagacagggtttcgccatgttagccaggatgatctcgatctcctgacctcgtgatccacccgcctcggcctcccaaagtgctgggattacaggcgtcagccaccgcgcccggccagttggttatttttgagacaaggtctggctctatcacccaggctggagtgtagtggtgcgatcttggctcactgcaacctccacctcccacctaaacctgctgaattagtgtctacaggcatgcaccaccacacctggctcacttttgtgtttttcatacacatgggtttacaccatgttgctggggctggtctcaggaactcctgagctcaggtgatcctcccgtcttggccccctaatgtgctaggattagaggtgtgagccaacccaccccacccatacttacgtatttctgttcagattttattgagtttttatgaccaagcctatggtctatcctggagaatatttgtgtatgtgacaatgtatattcttcaacatcgtagactcgattttgggtgctcccatcgggactgtgtgtacctgtcctggaactcaagtgcacccttggctcataatccattgctcttctccagaaatcttaccaattctcctgcttaaatataagctacgtgtagtaggcattgttttttcttagcagatacgaaactcaggaagattgtcctatgataaacaaggctaacctgctgattgtttgaagcaaggaactggagatggtccttttaggggtttatgttttggattccagaaaacgtgtaaacagggccaatacgtgcatctttattttgtgtccagtttagcctggtcaacaaaaatgtcaacaaaaaacccagagtgctggagtaagaaggtctcgggctgtgactctccaaagggaagaattttctcttgtctaaaagaaaagaacgcacttccctttagagtgttaccgtgtgagaaaagcaatgctgaagttgatgctgatcttgcaaataactttgcagagcctgcttataatcagactttgacaatggtgggcgtctgtttttttttttctaagacaggatctctgttgcccaggctggagtatggtggcacttccaacctaggtctcttgggctcaaatggtcctcttttttgggacagagtcttgctctgtgacccaagctagaccacagtggcacgatcttggctcacggcaatctctgcctcccagtttcaagtgattcccctgcctcaacttcctgagtagctgggattataggtgtctgacaccatgactggctataattttcatttttcttatttatttatttttgagtctcgctgtctctcaggctggagtgcagtggcagcctttgcctcttgggttcaagcaattttcctgcctcagcctcccaagtagttggaattatatgtgtcaccatcatgccctttttgtttttttttagtagaaaatgggtttcaccacgttggccaggctagtctcaagcccctgacctcaagtgatcctcccgcctcagactcccaaagtgctgaaaatgcaggcgtgagccactgcaccgagccatcaacaccttctactccatggaaatgatactggcgctggtttatagaacctcacttggggtcgggcagatttaaaagggacctcaggctgggtgtggtggctgacgcctgtaatcccagcactttgggaggccgaggcgggtggatcacgaggtcaggagatcgagaccatcctggctaacatggtgaaaccctgtctctactaaaaatacaaaaaattagccaggcgtggtggcgggtgcctgtagtcccagctactcgggaggctgaggcaggagaatggtgtgaacccgggaggcggagcttgcagtgagccgagatggcaccactgcactccagcctgggcgacagagcaagactctgtctcaaaaaaataaataaataaataagggggtgggggacctcattgtcccttgcagatgggatgtgccctgcttagcaagagcacggaggtggagtgcatggctttgagttttcactggggcacggaggtggagtgcatggctttgagttttcactgggtaaatgcagctgaactcttggctgcacgaccaggtcatatgtgcaacgagacaggggtctcactatgctgcccaggctaaaatgggcttaggtccttttgcctccacctctccccagtccttagtagctgggactacatgtgaatattaaccatgcacaggcaagaggaaagaaaggaccgttctttggttcacacctagccgccagtcaaattagtattttagatgaagactgcatttgagacatacttgaacaacaaatgatttgctgtttaggtgtgggcatctttcttttttcctagttttaataatggcaccaggcagagtacagtggcccacgcctgtaattccagcactttgggaggctgagacaggaggatcacctgaggtcgggaatttgattccagcctggccaacatggtgcagccccatctctactaaaaatacaaaattagcccagcatggtggtggtatatgcttgtaatcccagctactctggaggctgaggcaggagagtcgcttgaagctggaaggctgatctttcaatgagctgagatcacgccactgcactcaagcctcggcaaaaagagtgagactccatctcaaaaacataaaaaataggccagacacggtggtccactcctgtaatcccagcactttgagaggccaggacaggcggatctcctcaggtcaggagtccaagactagctgggcaaacaaggcaaaacctcgtctatactaaaattaggaaaaatggctgggaacagtggtggacacctgtaatctcagctacttgggaggccacggcaagagaatctcttgaacctgggaaaaggagattgcagtgagacgaaatcacaccattgtactccatcctgggtgacagagtgagattctgtttcaaaaattaaataaataggccgagcacagtgactcatgcctgtaatcccagaactttgggaggccgaggtggcggatcacctgaggtcgggagttcaagaccagcctaaccaacacgtagaaaccccatctctactaaaaatacaaaattagccgggcatggtggcgcatgcctgtaatcccagctgctcgggaggttgaggcaagagaatcacttgaaccccagggggcggaggttgtggtgagccgagattgtgccattgtattccagcctgggcaacgagtgaaactctgtctctaaataaataaataaaactattaaataaacattaaacgttaaaaaataaaaatagataaatatgagatcatcatgaatttgagtgtcacctttgcgcagggcccatggtaatctttgtcattccaattttttcatgcgtgctgccaaagctagcacttgtgtgtaggaagtattcttcctgtgagcatacaatatatggaagtttcttttattattattattttttatgtttttgcgactgagttttgctcttgtcgcataggctgaagtgcaatggtgtgatctgggctccctgcgatgtccacctcttgggttaaagcgactctcctacctcagcctcctgagtagctgggattacaggcatacacttccagggctagctaatttgttgtattttagtagacgggatttctccatgttggtcaggctggtctcaaactcccgacttcaggtgatctgcccaccttggctttccaaagtactgggattgcagacagccaccgcggctggccttcatatattcttatatatataatatcatgtacacacaaaagactcttttacaccctgagaatactcttatatcactttgggcatttttttgttggtgtgtgcattttttgtttgttcgttcgtttgtttttgagacaagatctggccctgtcacctatgctggagtgcagtggtgtgatctcggctcccggcaacctcaacctcccacctcagcctcctgaattagtgtctacaggcatgcacctctatacctggctaacttttgtatttttacagatgaggttttaccatgtttcccaggctggtgtctaactcctgagaatataaggtatatgtagtaggcgttgctttttctctttgaagacaaaacccaggacagttgtccctcgatgaacaaggctaacctgctgaacgtttgaagcaaggaactggagatggtctttgtatcggtttatgttctagattccagaaaatatgcaaacaggaccaataaatgcatctttatttttgtgtccattttgaccaggtcaaggaaaatttcaacaagaaacccagagtgccggagcaagaagatctcaagctgtgagtctacaaagggaagccctttctgttgtctaaaagaaaagaaagtgcttctctttggtgggttacggtttgagaaaagcaacgttgaagttgatgctgatttcggtaatacatttgcagagcatgcttatcacacttggacgatggtggggttctgttttggttttgcttttttattctaaggctctgtgttgctcatgctggagtgcagtgacatgtccaatatatctcttggcttcaaatggtcagcctgggcaacacagggaaattctgtctcaaaaaataaacaaatgaataaaaatacaaaataaagccgggcatggtggctcatgcctgtaatcccagcactttgggaggccgatgcaggtagatcatctcaggtcaggagtttgagaccagtctgaccaacgtggtgaaaatccgtctctactaaaaatacaataacaacaaaaattagcccagtgtggtggtgggcacctgtaatcccagctacttaggaggctgaggcaggagaattgcttgaacccgggaggcagaggctgcagtgagccgagattgtgccacagcatccagccaggatgacagagtgagattccgtctgaaaaaaaaaaaaaaaaaaaaaagctgggcgctgtggctcacgcctgtaatcccaccactttgaaaggccgaggcgggtggatcacgaggtcaggagatcgagaccatcctggctaacacggtgaaaccccatctctatttaaaaatacaaaaaattagcgaggcgtggtggtgggtgcctgtagtcccagctacccgggaggctaaggcttgagaatggcttgaacccaggaggcggagcttgcagtgagccgagatcgtgccattgcactctagcctcggcaacagagcaagactccgtcaaaaagaaacaaaaacaaaaacaaaaaaaagaaccctacagtactggagcaagaagacctcatgctgtgaccctctagatggaagcactgtctgttgtctaagaaaagatcgtgcatccctttagagtgttactgtttgagaaaagcaacgttgaagatgctgctgatcttggtaatacatttgcagagcgtgcttatcatcagacttgcatgatgttggggttctctttggtttgtttttttccaagacaggttccctgttgcccaggcgggagtgggtggcacctccaaccgagatctcttgggctcaagtggtgatctttttatttttgattttttgagatgcgctctcattccgtttcccaggctggagtgcagcggcaggatccctgttgaccggaaactccgcctcccagcttccggcgattctcccacctcagcctgccgaatagttgggaatagagatgcccgccatcgtgtcctgctagttattatttttattgttgttgttgttgttgagatggagtttcactcttgatgtccaggctggagtgcagtgttgcaatttaggctcactgcaacctccacctcctgggttcaagcgattctcctgccgcagcctcctgggtagctgggattacaggtgcctactgccccacccagctaatttttgtgttttgaatagagactgggtttcaccatgttgggcaggctggtctcaaactcccgacctcaggtgatccaccagccttggcctcctaaagtgctgggattacaggcgtgagccaccgcccctaatctcacgtggtcctctagagtcagcctagactctggtctatcctggaggatgtttgtgtgtgagacaatgtatattcttcaacatcagcccaattctcttagctaaatgtaaggtatgagtagtaggtattcctttttctctttggggacaaaactcaggacgatcgccccttgatgaacaaggctaacctgctgagcctttgaagcaaggaattggagatggtcctttcaggggtttatgttctggattccataaaacatgtaaacagggccaataaatgcatttttatttttgtatccgttttaacctggtcaaggaaaattccaacaagaaacccagagtgctggagcaagaagatcccatgctgtgaccctctagaggaagcactttctgtttgttgtctgagaaaaaacaaagtgcttccctttagagtgttaccgtttgggaaaagcagtgttgaagttgatgctgatgttggtaatatatttgcatgcttattatcagacttggatgatgttggggttctgttttgtttttgttttctaagacagggtctctgtggcccaggctggagtacagaggcacttccaacctaggtctcttgggctcatatggtcctttttgggacagtcttcctctgtgacccaggctggagtgcagtggcacgatcttggctcactgcaatctccacctcgcgggttcaagctattctcctgcctcagcttcctgaatagctgggattgcaggggcccgacatcacacttggctaatatttgtatttttcttttttattcatttatttatttttgagatggagtctcgtttccccagctggagagcggtggcatgatcccgactgactccaacctctgcctctcaggttcaagcaattctcctgcctcagcctctgaagtagctgaaactacaggtggccgccaccacgcctggctacgttttgaatttttttttttttttttttcagtagagatggggcttaccatgttggccaggctggtctcaaacccctgacctcaagtgagccactcaccttggcctccgaaaatgctgagaatacaggcatgagccaccaccgcgcgcctcccaaaggcgtgagccatggtgcgtggccatcaacacctcttactttatggaaatttttctggcactggtatagaacctcacatggggtcaggtggagttgaggggacctcagtgtccctgcagatgggatgagcaagagcacggaggtggagtgcatggggcttcagtgtgtattggggaaatgaagctgaaatcttgggtgcatgaccaggagataaatgcatgagacgggggtctcactatgctgccctggctaaagtggtcttagatcctcctgcctctgcccctcccaggccttgttagatgggactacatgtaaatattaacccatgcacaggcaggaagaaagtaaggaccattttttggttcgtcccggccctcagttaaacttgtgttttagataaacaatgtatttgagatgtgcttaaacaataaatgatacgctatttaggtgtgggcatctttgtttccccctaattttaatgatgggactagtccaggtatggtggctcctgcctataattccagcactttgggaggccgagacaggaggatcacctgaggtcagttgttcgagaccggcctggccaacatggtgaaaccccgtccatactaaaaatacaaaaatcagccaggcctggttgcacacacctgtaatcccagctactcgggaggctgaggcaggagactcgcttgaagccaggaggctgagctttcagtgagctgagattgcgccactgcattccagcctgggcaactgagtgagtctcagtgtcaacaaagtaaataatagtctaggcacagcggcacacgcctgtaatcccagcactttaggaggctaagacgggaggatcacctgaggtcaggagttcaagaccaacggggccaacgtggcaaagccttgtctctactaaaactacaaaaattagctgggtgcggtggtgcacatctgtgattccagctactcgggaggccaagacaggagaaccacttgaacccaggaggaggcgatttcagtgagctgtaatgaagccatggcattccagcctgggccacagagcaagattccgtctcaaaaataaataaaacaaataaaaatacgtagataaatacgggaccgtcgtgaatttgagtgtcacctttgtggagcagccacggtaatctctgtcattccaattttttttatgtgcactaccaaagcaagaacttgtgtaggaattattcttcctgtgagtatgcgatgtatggaactttccttgagacagggtctcaaaaatatatcatgtatattttatatattcttatcatatataatataatcatgtacacacaaaatactcttctaaatacagagaatactctgatatcaccttgcgtattttttgtttgcatgtgtctgtgtttggttgttttttttttgtcatatttttgtatccctacttatatatttatttttaattttattattatactttaagttctagggtacatgtgcacaacgtgcaggttagttacatatgtatacatgtgccatgctggtgtgctgcacccattaactcatcatttagcattaggtatatctcctaatgctatccctccccgctacccccacccaacaacagtccccggtgtgtgatgttccccttcctgtgtccatgtgttctcattgttcagttcccacctatgagtgagaacatgcggtgtttggttttttgtccttgcgatagtttgctgagaatgatggtttccagtttcatccatgtccctacaaaggggttggttatttttgagacaaggtctgactctatcgcccaggctggagtgtagtggtgccatctcggctcactgcaacctccacctcccacctaatcctgctgaattagtgtctgcaggcatgcacaaccacatctggctcacttttgtattttttatacacatgggtttacaccatgttgcaggcgctggtctcaaactccctcccaagctcaggtgatcctctgtctcagcctcctaaagtgctgggattagaggtgtgagccaccacaccccactggtatttgtgtgttcctgttcaaattttattgaggagtttttataaccaagcctgtggtccatcctggaggatgtttgtgtgcatgacaatgtatattcttcaacatcgtagactcgatgttggatgctcccatcgggactgtgtgtccctgtactggaactcgagtgaacacttggctctaagttcattgctgttttctagaaatccagcccaattctcttggttaaatataaggtgcacgtagtaggcattgctttttctttctggagacaaaactcaggaggattgccccttgatgaacaaagctaacctgctgagactttgaagcaaggaactggagatggtccttttaagggtttatattctggattccagaaaatgtgcaaacagggccaataaatgcatctttatttttgtgtccattttaacctagtcaaagaaaattacaacaaaaaatccacagtgctggagcaagaagatctcatgatgtgaccatctggaggtaagaagcactttgtgttttgtgaaagaaagtgcttcctttcagagggttactctttgagaaaagcagcattgaagttgatgctgatcttggtaatacatttgaagagcatgcttatcatcagacttggatgatcttggggttttgtttttttctaagacagggtgtctgtagcccaggctcgagtgcggtggcacttccaacctagatctcttgggctcaacaagtagccctctttttcggacagagtctcgcgctgtgaccctagctggagtgcagtggcaggaacttggctcactgccacctctgcctcctgggttcaagcaattctcctgcctcagcctcccgagcagggttataggcatgtgccaccacacctggctaatttttgcattttattatcgattgattgattgattgttgagacagagtctcactctgttgcccaggctgtagtgcagtggtgtgatctcggctcactgcaacctccacctcccacctcagccttctgaatacctgtctacaggcatgcaccaccacacctcgccaacttttgtgttttttgtacagatgaggtttcaccatgttgcccaggctggtcttgaacccctgagctcaagtgatcctcccacctcggcctcctaaagtgtgagtcactatgtcccgccctacttgtgtgtttctgcttacattttattgaggcgattttttttttttttttgagacggagtcttggtctgttacctaggctggagcgcagtggcgcgatcttggctcactgcaagctccgcctcccaggttcatgccattctcctgcctcagcctcctgagtagctgggactacaggcgcccaccaccacgcccggctaatttttttgtatttttagtagagatggagtttcaccttgttagccaggatggtctagatctcctgaccttgtgatcctcccgcctcggcctcccaaagtgctgggattacaggcatgagcgaccgtattgaggcgcttttacaacatagcctgtggtctatcctggggaatgtttgtgtgtgtgacaatgtatattcttagacatcttagattccattttggatgctcccatcggtactatgtgttcctatataggaactcaagtgaacacttggcttaaaatccattgctcttgtctagaaatttagcccagttatcttggttaaagataaggtgtgtctggtaggcattgatttttctttccggagaaaaaacttaggaggatttcctcttgatgaacaaggctagcctgctgagcctttgaggcatgggacctggagatgatcctgtgaggggtttatgtttttggattcaggaaacacaccagcaggacaaataattgcatctttatttttgtgtctattttcaccaggctaaggaagattccaacaacatatccatggtgctgaagtaagaagatctcgtgctgtgaccctctagagggaagcactttctgttgaaagaaaagaacatgcatcctttcagagggttactctttgagaagagcaacgtttagtttgatgttgatcttggtagtacatttgcagagcatgcttttatcatcagacttggctgatggtggtgttctgttttttgttgttgttttctacaacaggatgtctgttgcccaggctagggtgtggtggcacttacaacctagatctctagggctcaaatggtcctcttatttggggcagagtcttgctctgtgatccaggctggagtgcagtggcaggaactctgctcactgcaacctccgcctcccgggttcaagtgattttcctgccttggttttctgagtaggtgggattacaggcgcacaccaccacacccagctagtatttgtagttttctttattattcttttttttattttaatttttgagacgaagtctcgctgttgcctacggtggagtgcagtggcgtgatctcggctctctacaacgtctgcctcccaggttcaagcaattctgctgcctcagcctcccgagtagctggaatcaacaggaacacaccaccatgcctggctactttttggatttttttttagtagagacggagtttcaccatgttggccaggctggtctcaaactcctgacctcatgtgagccacccacctcggccttccaaagtgctggaattacaggcatgaaccacgacgtctggcctaatttttgtatttttagaagagacagggtttcaccatgttggccaggctggtctcagctcctgacctcaagtgatcctccccctcggcctcccaaagtgctgggattacaggcgtgagccacctcgcccagcctcaagtggtcctcttgactcagcctcccatgtagttgggactacatggggcgtgccaccacacttggctaagtttttaatttttcatacagatatgatctctgttgctcaggaaggtctcaacacctgagctcaaggattccacaggcgtgagccacattctcctgctgacccttttcaaagatagttgacatggccaggcatcatggggcacacagtcccagccaccgcagatcccggggtgggagggtcctttgatttccagactattccatgcactgatcacaccttgtttttttgtttgtttgtttgtttgtttgtttgtttgacagagtctcagtttgttgcctggcgggagtgcaatgatgtgatctcgggtgactgcaacctctgcctccaaggttcaagtgattctcctgcctcaccctccaaagtagctgcggttacaggcatgcaccaccacacccagctcagtttttgcatttggtagagacaggttttcaccatgttggtcaggctggtctcgaactcctgatttcaggtgatccacctgcctcagcctcccaaagagctgggattataggcgttagcctatgcgcccggtctgtatttcctaattttaaatatgggacccatggtgaatttgggtgtcactgtgtacaggggacatgggaatctctgtcattccaatttttttaatgcatgctgttctgtgtaggaattattcttcctgtgagcaaacaacatagagagc

SEQ ID NO: 491 - DNA, 13191 bp, Homo sapiens
cagtgtaaggggaccatggacctagatcttagatctttgacttttcatcgaaaccctctccttcacctgcccccatgccccaaacttactgtgctctagggtcctctggtggggctgttctggagggatccccggctccagatagcgtgcctgctccatagggagcggcctttccatagcaggccccctccatctgtcctggcctggctgaaggcctccaagtcgaggtctgctgaggacatggtaggggccacatctttgacaaggttctttggagagaggccctccccacaattctgctccaggacccaggggcaccaccacctctctccaggagtcccaccccctgctccctggtctccttctggacccacccctgactccaccctgcctcatctgcctaccctctgggccctcttgggtcccatctcagtctctgaggacagtctctagtgccctctgggcccagccccttgcctatgcccacctctgtcctggctcctcctcagtccaggcccaggttggttgggccacaacctcctgggtgccccaagatatggggtcagggtctggcccccgaggctgagctgggaggccccataggtgggctgggcagaggctgcctacctttgctccagctcttcctccagagccttctgcaggctggtcttcagtcgctctgcctgggaagcagcagtcaggcaggctaagtgtgtgtgtgtgtgtgtgtgtgtgtgtgtgtgtgtgtggtggggtgatggtcgatgaaccccacccctgaccaatcacccccgaccactcacccccacttcctggcactggaagagcagagtgctagtgcctggcaggcccggctcctgcacggtgatggacaggatggagttgtaggaacatgtgttgagcgccacattcatggcctggatgctgtctaggcggtaagagtccagctcctcctgggccaggtggagaggtcaactgtgaggccaccagagctaggtgtggcttctgggagctcctgaccagctcatcctagccctttggtggcctagggctgaggtgtcatctacctgactcttgtgcctctgtccccagcctctgtcccctgtctcttcctaggcttgggtgtgtgttgtatgtggggagagtggctgccctttggggcatggagggtggagttcaagagctagtgcttgcttccccacagcccaggctggctatcactgggtttgctgggaaggctgaccttggtctcaatgtccagcagctgcagccagccgtccctgacctgcaggatcaagtcttggctccacacccggccctgtgcatccatctcgaacagcttctgcaaggcatcctcgggcccctggactctctgactcccctgcttgcatgtcatcaagtgctgcagggagagggggagtcctaggactgggagaaagctcagagaggtggaccacaggcgtgctgggtagagaaaagcagaagaggaagaagacgtgtcctcggcccccttgaggtaggaggttccaggcttcagataaagcaactttccagggccaatgtgagggacggtgtcgaagcactggggccagggatagggcctccaagtctgagtctgaggggctgcaggaggggtttgaggactctggaggaaggacaggcatggcctttactagtccaggccaggtgaggcagctgggtggtggaggatgtgggctccagccacccaacaaataactcctctggaggtgatacaggaccctcagattctgtccctggcttcctttgttccttttgggaactcagtcccagcccagtcttcctcctcactcacccagcattcctgtctccttctccctggttcatgcctggagatatccatcgtgatctcagtctccgctcaagtccttgcctactgctaggctgaccatccaggagttttttgctgttatccactctcctttaggagccccctcccttctcccagccaaacattaccttcacaaggccccttccacccaggcttcttgtggtagggagatgcagcctgcctcctgccctttgaccccacccccctgcccagggcccagctcttctccctgtgttcgcactgccagcatattcaggggactctggcatcatgagcaaactccatcctcctcttgctctgcctgctgggcctaaaagaagcctcttcccagcctccaccctacagagaagctgagtcctcctggcctctcctcggctggctaggggagctctgcctctgctgccctgtgggacctgctgccctgtgggacctgcagaccatcgccccagctccctccctgcttgttctccattggagccactaacaagtggtggccaggacaggatggcttctaccccagagctccagcctgaccctctgcctgctctccccaccacgcccttgtagcctgtgcttcgccttcaccttggtgtcgacagcccttcaggcacctaaatcttgcagtgcctgcatcatcctccctggtagagccagagactccattctagccttggagcagcctcggagctgctcacagtcaccctggaggcttgggcccaggtgcctcccctctccaacagtggccctctcaatcccccacagggcccaaagatcccaaagatcccacacactcctgcctccagccatgcaaggtcttgggcaatggagcagtgccctggggactcgggcagcagggggttgggagacaggggagggtaggtgggtgggtggttgtaggtgcttcttatcccatcctgctgctacttcttcctgtctggggacaggacactcacccgctcaacctccagccaggcctgctctgttcaatctgaccacccctccccgtccctgacactgagcagatgctctggcaggcttgttggatctgagtccatgcgacatggttgggacaggctgttggcttctggggcagggacttgtgtgaagtgtccatgttctggcagggcggtgggcacatgggaacacttgggtttagttggacactgcccgggggctgcagaggtactcacctccaccctgtgctgcaggagggtgggctctgaggtgaggttctgggagtactccttccggtgcactacaagggcacagagcaaggggcgggaggtgggcagaagaacgaggtgagactcaggcaactgctgggggcagttggtgtgaggaagggggagtggaggatgggacattctgggggctcagtgggagggcacgggagaggggcctgccaggagcttacagtaaatggctctgctgctgggccttgacatgttgacgctgctgaggacggctccctagaacccaaagtgaaccagaggcagccatcagagctggggaaaggtgtaccaggcacagcagggcaggacagttgctattgctctgactgggggcctctgggaccagacccaaagcccctggctccaggggccctttccggagccatctgcagccagcgtcctccactgaggagccctccatcctggctgggcctggaggccccgggctgagggaagggagggtcagggaggccacagcatggctgggcctcagggaaggctccaggcctcccatggtttggctgataaagctcatgccaaggagcccaggaaacctggatggacagggacctgcgttcagatcctatcttgggcctgggtatgaaagatgctggatgagcagagggttctgtagccgaccccgccagaggaggccctcttgttcgaccctgtttcagttctgcaaactgagaggacgctgatgctggctcttcagctgtagaccctctgggaagactgcatgcatgtgtgtgtgtacttatggtggcactgcaggactcgccagtgagctgacctcccccaagtgtctccctaggcctcctggctctttgctttttgtactctgtatcctctgcccaggtcccctcctgaccccaaccctttaaattctagctcaaagatcaccctcttggtgaagccctcctggaccatccaaccccaccctgcccagggtaccctcctaatgctgcactggaccttgtacatttatctccagcaacaatagtcacaatagccaccacggtgctgtgagcctggtgctgagccccttaccaacatcctatcagtttctcctcactgccgtccacttgtacttacttggcgccacgtgcctagcactgttctaacggcgttaccttcagtcactctaatcctcaaaacaacctcacaaggcaggtactggtattgtccccatttaccatatgaggactctgaggctcaaagacggtaacaggcctgaggtcacaaatgaacgtttaatagagagcaacccagatctgtccgattgcaagcttcgtgttttaatggtttataaacatgcctctgccgctgggctgtgcgcagtcacagagggagtctagagaacatacatgttgaaatggagtggaattaaatgtggtgtgtgtgtcccgggtgggggtggtgttagtctgtgcgggtcaagggtatgtgttatccaaatgaggtttgtgggtatccacatgtctacatggtacacctcagttgtgcagaaatactggactaccccgggtaacatgtgagagagcaacccatacccttgtttattaggactgttgtgaaaatgacgtaggatctgataagatgactcagtgtggaaggaaataaactgccagtgaacaattaagggaatgtggaagggacggctggatctctggtttccttgtttgggaggaccccttttctctccaggggtaaggcggggctagaagcctgttccccttccccagcctcccccaacccccattgtaacacttcctgcttctccatgctctccatgcagaagaggaagtgaggtctgcccctggtcagccccactccccactccctcaacaccagggtgggccctgtggggccctctaggtaggtaggtcaaggtggggaaacagctgcagccaaagattccctaccccagggagggaagagggagctggcttggcctgccttgccccttaggggtaggggagctgtgacagcccatttcccccctttaagccctagatgtaggggtttggagcagggaaggccatcacctcatagaccctggggcaagcatcccagaggcccttccggagcctggacctcgctctgctttccagcccaccagccagctgctgagtcccaagcccctccttgggcttgatcccctgggctgcagctgggaacaggctggagacctggcctgggaagccactgagttgcccccacctgccctgagatcccctgtgactgggctgggccccgatcttccctgggggccaggcccttacctgggtgccagtgaaggccgggtgcctggtccccccaggaggctggtcttggagcaggtggtccggtgctggtggtggaaggacagcagcttctctgctagtggccacaggcagagcctgcctttgatgaggttacagaggcagccacgcctgtgctctttggactctggtgggtggggaggcttcctggtcactaaccgctcaacatcaacctggacctgcggcagtgtctgtgctgactggcgtccccagcttagctagaggcccctgcttccctgtttcccccactgctagccttggggtgtggccccctcttccctctgccttttaggtgcctactctggggaacaggtcagcatcaggcacggggctgggaccagaagaagagagcacacatggcccagagtctgggttctgtggtgagggcacaggtcggctggaggtggactccaggcttgggggaagctgtgggctggcgtgtgtgccatgcctgtgcgtgggtggcacccataggtgtgtgatcctgtgtacctgggtggtgcctgtgagcaggacatggatcttgtcacagaagatggggactgaggcccctggggcattacatggagcgctgagattccctctggcagggccctcattctgtccctactgttgtcccttccagcaggagcccccttaccagccctttctcgctcttccactctctttccttctgtaccccatcttgtgcccagacccctggtggacgcctggccagcttcagcaaagatggaaaacggaggcctgcatctatctctagtcataaacctacccacttcctgcactccatggtatcgaaaaatctttcttggcactcagagtgggccaggctcccctgccctctgggaactcacagtctaaccaacaaggccaggtataaacagaaaccagggagcagggcaggaggggaggcgggggcgggggagtgccagtgagcctcggaccctcgtgggcagaatgcagggtcccggtgctgggccctgtgatggagtgtcctgtggagtctgagggctggagcactcccatctttagcttccctggaactatcccaggatatctcagccttctctcccatcaccacccaaccaacgctgccctggatggcctggagtccatgcgtcagatcctagggaggtgccttccctgtctgggctgtgtgtgtccctgggagagtccagtggacagccagctgctggggcccagggatcaggtgcctgtgaggccagcacccagccacagccccatgggaagcagtcctggggttctttcccctgggtccccatcttgtggcccttcagcttcttttgggatagcacagcctgtcccctcgttgcctcccccaactccgtgaaggccacagtcatatttcaccccagccctggcttggggctcaggcaacacctcatttctgcccagctcaggccaggcccgtccttcccataggaccctccccaagtcagtgtgagcacagcagggactcctgggggggctctggggcaaggtgggcaggggcagagaaacaatgagtggcattcccagcaccttgccctctgcagtgccctttaggggtgcccctgggagcagtgtgtgtctcctcagacataaagcctttgtggccttggtgggtctggggcttggggccaggtattggggacatctgcttctgtggagccccctgagggaagagggaaatcaggaaagagggagaggccaagcttcccatacctggggacttggggccataactgaagcttctgcacaaagctccgggtgccacagcagctcttctgcaagggagttcggctgaggcaccaggagctgggacttaggttggaggggaaggaagcaggactcgaagggcatgtccttgaaattgtggggttaaaaggctgtgggaccacattcgttcattcattccacaacttcctgtagaattgagggcttcctgcctgctaggcactgtgagaggtgctaggatccctctggagggcttacagacaccttggaattcaagctgagttcattatttctcagcaaaccatctcccctctcatgctcccatctcagggaaggcatcagctcccaatcgtgtgttccagcagggaggggagtcctccctcaatcctcacacccaatggactacccttcctgcagtcccagctctgtggcaagtcctaagtggcccccttcctctccaccccactgcgactgtcttcctcagaccccattacacctcctgtcttcgaccctgcggccgtctcctcacccacgccctcgcttcactcttgttctcattgatccttactggttgctggtagggaagctttcttagctggagatttgattgtccactcctctgcctaaaacccctcagtgacttcccgctgctcacgggacaaaacctaaactccttctcagggcagttgaagtccttgatgaactcaagtctcctgcttctgagtctggccttatcttccccccaactccctgccccttgtactttatactcggcttggggcatggcttgtaattccttgaagggtcacaccctggtaccaggctggctgctgttctctgtctggcatgccctgtggacacgctatggctttatgtctccagtagccctccttcagaagccttcccactgcccagggctggtggggctctggcccgtggcttccagacacgttgtacatgtgtccctctgttactgcatgtatcacattgagggggatacccccatgactggggtccctgtggggaaaagaaagagagatcagactgttactgtgtctatgcagaaaaggaagacaaaagaaactccattttgatctgtacaaagaaaaattgttctgctttgagatgctgttaatctgtaactttagcccccaaccctgtgctcacagaaacatgtgctatattgaatcaaggtttaagggatctagggctgtgcaggatgtgccttgttaacaatatgtttgcagacagtatgcttggtaaaagtcatcgccattctccattctctgttaaccagggacacgatgctctgtggaaagccgcagggacctctgcccaagagagcgtgggtatagtccaaggcttccccccactgagacagcctgagatatggcctcatgggaagggaaagacctgaccatccctcagcccgacgcccgtaaagggtctgtgctgaggaggattagtaaaagaggaaggcctctttgcagttgagatgaggaaggcctctgtttcccgcatgtccctgggaacagaatgtctcggtgtaaagccgactgttcgttctattctgagataggagaaaaccgccctgtggctggaggcgagatatgctggcagcaatactgctctgttactctttgctacgctgagatatttgggcaaagagaaacataaatctagcctacgtgcacatccgggcacagtaccctcccttgaacttatttatgaacagattcttttactcacatgttttcctgctgaccttctccccatcatcatcctgttcaccctgttctcctgccacactccctttgccgagataatgaaaatagtaatcaatacatactgaggaaactcagagaccagcaccggtgcaggtcttcgcatactgagtgtgctggtcccctgggcccactgttctttctctatactttgtctctgtgtcttcttttctcagtctctcgtcctacctgacgagaaatacccacaggtgtggaggggcaggcccccttcaggtccctgaggacccagattgttttctgccactgtctagaggagagaagggcttgtaaacaaaagcactgtagtatgcaggcataaagaaccttactcggcttgggggtgtcagggaggacttctcagatgaggaaatgcaagggctggcccttcaatgacacacaggagttcagccaagaggtgaagtgggcagggaattgcaggcagagggattgcagtcctactggatgaagcggcctggggagaagatgggtatggcgtgaactgtgtgtgtgcacgcgtgtgtgtgcatgtgtatgtgtatgtggcggggaggtggtggcagatgacagcatatgtgtgccgtcatcacctggtggtgagtagagccattgaatggttttgcatggagatgcaacaagaaggctactgggtcttctgtcttgtggaagacgctgccgcttgctggttctcagcatataaagagacccaggtgcacaggctttaggctaaggggccaaggagcccctcccaccaccctggcctgggccaagaagcagggtgggttccttggaagctccagagcaggccctggtcagagctgggaaactctggagggctctgaggaaaagagctctgtgttcatggatgaccatgcagggggtagggcagggccctggcattcagaggtgaatgggtgccgcctcacctttagaaccagaccccagagcagggtccagccagcacctcttgctggtggactgcatggatgaggcagcctcaatgtcaatcaggggctgattgacaactcttcttcccaggccgcttcatccagtaggactgcaatccctctgcctgcaattccctgcccacttcaccccttggctgaactcctgtgtgtcctttaagggccagcccttgcattccctgagtcatggtggtcctgtccaggggctgacacctggccctggggctgctggggaatcacagagacagctcccatccctgcccctgctttccccagccctggcacaggggtaagtggcttctacgagccaggtggagacataaacaagagagatgatgtccctccctcgcaactaacctgccaaggtagaagaaacaaatgtatctgaagataatcaaggtcctgacaagtgacaagagagaaatagagtgaagtggatgatggcatgggggtgggagggtgtttggaagcacgacgtcggagaaggcttctctgaggaggggagcttcaagctaagccagggatgggaaggagcctgggagagggggccagcaatgtgaagggcttgcagctgagaaggaacgagctggcggagaggtgaccgaaatggggtggacaggggccagagcacacagggctccgtagaccatggccaggagcctggtttttattccaagggcagttggaagacacggaggggttttaaatggaggagtggcatgattggatttatgttctagtcacaactctggctggggtggggagaatgggctgtggggggagtgggggcggactcagggagaccacaagcagctgctgcagagagggtggtgaggcctggacatggcagggcagtgaggatggagacttaggctgcaggtggaacggatgggacatgctatggattagaatgggggttgagaggggaaaaaggacctattaggactcaggtttttggcttggacaactgggagggttatggtgacatctggtgagatggggaaaccgaagagaagagggattgggaggcagggggatatgaagagttactgttccattctggatggcctcagtttgagaggtgttttgggcctctgggtggaagtagcaggaaggcaggggcaggtgtgagtcagaagctcagcagagcaggatgaccacatgcaggcattcagaagcatgtggagaaagatgattcaatgatgcggggaacgtttgcagtgtagaagacagtagatacttggcagctgtaaatacacgaataacattcagagacctaagactcacgagaccacatgcgggaaagtgtatagataaagagaagggggctcacgactcaacccaggcgctccaacattaagagattgggaaggatgaggggagactaaggggctgccagtgagcagcaaggagagctgggaagagagtgtttcaggaaggaggggtggacacctgggccaggtgctgctgggaggtggaggaaaggctaccatctgtgggtttgcagtgggggctggagccagctggggacggctgaagagtgtgagggtgaggaggtgggctgtgagtgagtcgccgagtgtagacagtgggcatgggaggctttgctggggatgggatggtgggccagggatgacataccagaaacttgttcagatgtgttcagggtggaagacttggcataatggctagtgggaacacactactgcagagacagatgagacaacagagatcctgggcgcatggcaggagggcggtttctgtgggagggcaggggagaaggtgggcttgtctctggagcctctggtcacacctgggctagactctgccatgctgcccacccctccacctgcctgccctcctcgataaaggcagacgaagggcgagtgcgtgatttgaaggcaggggggtgatttgtagccccacaattacaagaggcccagtggcttaagttttcaggaaagaaggccaggcctaacgtgcttccagaagctgctctgtccggggatggactggggttgggatctcagacccgcccccattttcctagctctcctcggtgcctccatttgtttaaaccccaaatctgaagccagtgctcagggctatgaattctcctgccttttcctcattgccctggcagctgatgtcggtccagatgtttctcagttcccgattctgggccttggttctgcaccttcccagccctggatcccctgggtgactcctacacatgccccctccttctttccctctcttctgcatcccatcccatccaggtaggcagtcccaggagcctggattaccctggccccactgccctgacagccctggaggaagggacctcagggacatctggaaagcccttctccagaggccagccttggactgggcttaagaacaggcttctcaggagagctgggctggagaggaggagaggaatccagggccaggctgggaggtggctgctgaggaaagagcagcctccgggaaaggcaagccctaggggatctcaggggaggggcttggttgggtccagctcagtctatgcggcaggtggggagagacagggagaggcggtcccatcaccatgcaggaccatgccctgggcccccttccaggagctggcggcactgaggcttcttcctgggccaggcctggccagcagccacgggtatggaggggagagggcctgaccaatgctgcccgctccctcagacacttctgctcctgcccccactttaaaccactgcccaagaccaacacagtgcggccattcagatccatgtggtgaagggatattcagtgatgtggaaaagctccccattagccttagatgaaaaagacaagttacaaaatgtagatcttagttttgtgaaataagcaaacacacaaacaaataggtaaatagaagtcatataacttgaaacagaaaagtctaaacgaaacctgtaatcatagacatctaaacaggaaacatggcaattatgtaaatacccaaacatagaaacgttcatgatgtagtatatggtgaaaaaagcttcttacaagttggtaatattcaattttgttaagaaaagttgtaatgaaaatctaaacaaaaaatgtcttgaagaagagacacgagaagaaagaatgttagttatctttagatgtgtgtctgtgttgggatgaggggacttctttgtggttttactttctttgtgcttttctatgttttccaactcctccccaaagaacatgttatgttatttttgtaatcagtgcatctccattcccatg

SEQ ID NO: 492 - DNA, 13227 bp, Homo sapiens
cgaagataagaggtggtaaagggaggacgtaatacctgttttttgccaagaaatgcctaaggcagcctgagctcttattttgaatatggatagtgtcatttgtcaactggatccagatagatccagttcaaattctggctccacttcatactagctgtggaaccatggtcaaattatataacctatctgaattgattcctcttcatttgtaaaatcaagatatatctataaaatcctgttgatttggggttttttttttttttttttgagacgaagtctcgctctgttgcccaggctggagtgcagtggcgcagtcttggctcactgcaacctttgcctctcgggttcaagcaattctcctgcctcagcctcccaagtaggtgggattacaggcgccagccaccacaccccgctaattttttgtatttttagtagagacagggcttcaccatgttggccaggctggtgattgttctttaattcgtgtgttgggtactattttagacattggacaaatgcagtgaatgaagtttctgctctcataaggcttactttctactggggaaagatggacaataaacagtaagtgttttatataccactcagtaaagaaaagtaaaacagattaagggttttagaaagtgactgtggtggaattgccatcttacaaaaaatggtcagaggcaggcaaggtggtgcgcggctgtattcccatctacttgggaggctgaggcaggaggatcgcttgagggcaggagtttgagaccagcctgagcaacatagagagacgctcgtctctttatttatttttgagctggagtctcaccctgtctcccaggctggagtgcagtggcatgatctcagctcactgctgagatcctcccaggttcaagcaatcctcctgcctcagcctcccaagcagctggaattacaagcatgtgccaccatgcctggcttttatttttttttttgagatggagtttctctcttgctgcccaggctactggagtgcagtggcgtgatcgcggttcaccacagcctccacctcccgggttcaagcgattctcccacctcagcctcccgagtagctggaattacaggcatgtgccatcacgcctggctaattttgtattttccgtagagacggggtttctccatgttggtcaggctggtctcaaactcctgacctcaggtgatctgcctgcctcgggctcccaaagtgctgggattacagacgtgagccaccgtgcgtggccacctgataatttttgtatttgtagagatgggattttgccattttggccaggctggtctcgaactcctgagctcaagcaatccacttgccttggccttccaaagtgctgagattacagatgtgagccactgcacccagcccctcatcttttttttttttttaaagaaaaaaatagctgggcatagtggcatgtgcttgtaatcccagctgctcaggaggctgaggcagatcgcttgagtccaggaaatcaaggctacagtgagctatgattgcatcactgcactccagcctgggcaacagagcaagaccctggctcgttaaaaaaaaaaaaaaaaaaactagccaggtgtggtggcacatgcctataatcccagctgctcaggaggccgaggccgaaggatcacttgagtccaggagtgtgaggctgcagtgagctgtgattgtaccattgcactgtagtttgaacaacagagcaagaacttgtttcttaaaaaaataaataaaaaataatgttgggcatggtggctcacacctgtaatcccagcactttggaaggccgaggtgggtggatcacttgaagtcaggagtttgacagcctggccagcatggtgaaaccccatctctgtagaaatacaaaaaaattagccaggtgtggtggcacacgcctgtaatcccagctacttgggaggctgagacaggagaatcgcttgaacccctgaggtggaggttgcagtgagctgagatcgtgccattgcactccagcctgggcgacagcgagacttcatctcaaaaaaaaaaaaaaaaagatcagagaaggtctcttaaagataggtagagagatttaaaagaagtgcagcaacaagctgcttagaagctcgttgaaggccgagtgcggtggctcacccatgtaatctcagcactttgggaggctgaagcaggcggatcacctaaggtcaggagttcaagaccagcctgggcaacatggtgaagctctgtctctactaaaaatacaaaaattagccgggtgtggtggcaggcgcctgtaatcccagctactcagaaggttgaggcaggtttgaacccaggaggtggaggttgcagtgagctgagatcgtgccactgcactccagcctgggcgacagagcaagactccattgcaaaacaaaaccaaaaagaaagaagctggttgaagtgcgttctaggcagagggaacagcaaatgctaaggcccagaggctggagcatgattgttttgtcttgaacagtggggccaatgtggtggccatgcttgataggggagagtggtaggagatgaggtcagaggtagtggacagccagatttagtagagacccgtaggccaagatggatatcacctcaaaatagcaccaggagagggtgctgagcaggggctagcatgggtgggttttttttttcttttttgagatggagtcttgtctgtcgcccaggctggagtgcagtggcccgatctcagctcactgcagcctccgcctcccgggttcaagcgattctcctgcctcagcctcctgagtagctgggactacaggtgcacgccactgtgcccagctgatttttatgtttttagtagaaatagggtttcaccatgttggccaggctggtctggaactcctgatctcaggtgatccgcccacttcggcctcccaaaatgctgggattacaggcatgaaccactgcgcctggccacatggtttttttttttgtttttttttaatggagtctcactctgtcacccaggctggagtgcagtgacacaatctcagctcaccgcaacctccccctcccgagttcaagcgattctcctgcctcagtctcccgagcagctgggattacaggcatgcgccatcacacctggctaatttttgcacttttggtggagacagggtttcaccatgttggctatgctggtcttaaactcctgacctcaggtgatccgccagcctcggcactcccagagttctgggattacaggcgtgagccactgtgccgagtcgggacccatcttctaaggttagactctaaagcagtgttgtccaacagaaggtacaatgtgagccacatggataattttttttttttttgagacggagtctcactctctcccccctgctagagtacaatggtgcaatctcagcttactgcaacctccgcctcccgggttctagcgattctcctgcctcagcctcctgagtagctggaattacaggtgcccgccaccacgtccggctaatttttgtatttttagaagggacagggtttcaccatattgctcaggctggtctggaactcctgacctcaggtgatgcacccacctcggcctcccaaagacacatgggtaattttatattttctttttcttttctttctttctttctctccttccttccttccttccttcttgcttgcttctttccttttttttttcttttctttcgaggtggggccccactctgtcatgcacctggagtgcaatggcacaatcatagctcactgctgcctcaaactcttggacttaagcaatcctcccacttcagcagcctcccaagtagctgggactacaggtgtgtgccaccatgcccagctaattttttattttttgtagagttgaggtcttactttcttgtccaggctggtcttgaactcctggtttcaagcaattctcctctttcagcctcccaaagtgttgggattacaggcatgagccactgcctcagccttaattttatattttctagaagcaacattttaaaagtacaaagaaacagatgaaattaattttaatttttttctttttttttcttttctttctttctttttttcctttttttttttttttagacagagtcttgctctgttgcccaggctggagtgcagtggtgcaatctcagctcactgcaacctctgcctcctgggttcaagcgattctcctgcctcagcctcctgagtagctgggattacaggcatgcgccaccacgcctggctaatttttgtatttttagtagagatagggtttcaccatgttggccaggctggtctggaactcctgacctcgtgatccgcccgcctgggcctctcaaagtgctgggattacaggcgtgagccaccgcggctggccagttttaatatttttaatttaactcagtatgtccaaaatagtataattgtaacatgattattattttaaaatacgtgaattgtttaaaaatatgtgaagcatccctgtaaaatcaaacctggggtgataggacttggggtgtgtccctctctgggattagtcaggggaagtagaataattacaggagcattggaggtggccagtcctagtcataccaggccaggacactgtcactgctatgctactgatggaaacaaggcagagacgaaacagaattaaatcaacatggaggttgtttggagaagtccatggattgtacatctgaacttgaaatggccagtggccaggcacagtggctcacacataatcccagtactttgggagagtgaggtgggaggatcacttgagcccacagttcaagagcagcctggagaacatagcaagaccccgtctccaccaaaaaaaaaaaaaaaagggaaaaagaaatggctaatgatgcgggagacatttttatctgatagttttagaccagattttgctgttgtagattgcttctacctgtgaattctttgactgtattcccaagtgaaattgggaattctgattcccaaggaatcagaatcccatccatatttgtggtatgggaaacaagaccccttgcaggggagactggtccaccaggagaccctgtagcccagggacctgggcgccagtgtccctcccaaggcctgaagacataaggctagcatgggccgtggctggctgtgtgggagttcagggccggaacaggttggaaggtagtctcgcctgctatcccttatttcttctctttgcttttttctttgccctttgctttttgtgttactcagggcctgtgggaccctgattctgggagaaatctgttgtgctctccaggttcctgtctcttcttcagatctccccgggtccacttgtagacttgtgcaccctgattcaggatgagaccagaggaccctgtggggcagcgattcatagggagctcaaggccagttgttattctttgaatttgagagaaacattggaaatgtcatcttctgaaatgaaaactaacagagaaaggcaaatcatttgggaaaagttacttaaatggtaaccttgttgccaataaaagagtattttctaattcaaagtccaaagcaagggtccctcttagatctctgttcaatataagattgctctatttcttgggagtcgtgttggtgacactggagaccagaggattccggttctcagagagagggatgctgtgatggagtaggacagtacagtcttttggcttgtatactgaggcacagagtggggaggcctgctgtccttggggagtgggtagcagcagatcaggcaccagaaagggtgagacaccccctctgacccttgtagtgtaacaggtgtgagtttgttcactttgtctcttgtgagcttggctagttcgaatcagtcccccagggcatcatcaccccaggctgttgtgtaaacattcgtacctgagaaggtacaactgtaatggtgcttatacttgctgtgctttacactaagacccagaatagcctatttcttcctctcctctgcctttctcacctttcttttttccttgtcatcgacctcttaacgttacaggagtaaacctaccactgtaatctgcttcaccttacagacacatccctatcttttgtcacctttgttccttttgtagcttgtgacagtaacaaactgggttgtttgaggtgaccccttccctgctctcctccttgggaatgatcttatccgcattgtactcctaggtcccataccctaacttttcagccagaggcacatttatagcaaggttaagggcatcagcagccagtgaagctgagcttcctcctctggtgagttaaaattgcaaatgttgacatctgatcccattcaccttgtggttgtggctctcctttacctcccataaaggaccagccctgtcgagaaccaccttcctccccactgtgcttcttcatgatttcctgcctccgctctttccttctggctttgcttgttctctgagaccgagaagcttgtgtcccatttctgtagatgtgtagcctcataggacaagtgatgtcaaggtttggcaacagtagatcttttgcttaggatttggacccggaacacagaatgtcaccttctgtgggctgcttggtgctacttggctgaagagcctttccaggagcaggagccataggagatcactttcctggccaccgccctgtgtggtatgcttgtgccctagcacttgccttgtgcccactcacagcagtcacagcgatggttttctttgactagcgatggaggtcaggcctctaacacaggagcctagaccttgggcaggactctgcatccttgtctaaagagagggttcccttaggtagtacgattccttatttcaggcctgcatctagatgcttccccacacaagttctgaggcctgtttaattccattgggctattgcatctctgggggagatgcacattttccttgtaatacaccctgtaggaaagttttgacttggtccagcttttcagagcatgagtctgagagcagattgattgcaaggccttgtctgagaagagaatagactgactcatgatacctggacagactccagagggagatgcgatgccctctccagctgctggcagagcattccttctcctgcttgggcgcctctgagcatgctggcgtccagctggccatctaaagatgaccaggatccactttccaccaaagctgcttgggtttccatcccattctgtaatcttatggaagaatccctctccagctctgataaagctcttctgcctttcacagtggagttggatgagagttgtagttcttggcatgccagggagcagtgtggaattgggggagatgaccaatatctaatggtttatactggcatttccaggggatttgagcaattgtcgggggagggtggtatgtcagcataggggcctcaaaaggcgaattctagggctgtctctgtggtttactaccttgtgaccttgggtaagttccctaaccctcatctgacagaaggataaaagctactttgtctgccaaacagggctggtgtgagcagaaaatgaatgtctggggaagaatgttgacagccataatacattatatcgatataaggtattattttaaaagctattagtattatattacatgccaagtatgttaatcatgttctagtttggggacagaggcgcatttactcagacatggcctacgatgtcctcttgaagcgcttttcttccacccaggctccttgtgctggaactgggcagatggtccatcttccttaaaccctagaggaagaaggaagcagtttgctttcctcagaggagacctggatgggacttctcaaattcactctaatgtgtgaggcccatttctctctctgtcttatttggctctcgcagcgatatgaaagtgaaagttcacatagtgaagttggaaaattcagtgcattgccataaaaatactgatttggtttcttctgcgctagatctggccctgtctgccaaagcttgttggccgtcattaggcagggcaagtgctctttggtgccctgcagccccttcacttccccaggtatgctccgtgcgagtggagtttggctgcttgcctggtctatgaaggcatttggtctcaaccctcaaaggcttctaaattctacagctgtcaaggctctgtttatgatggagaaactcgaataggcagtcttgtatttagagtggagcgaaatgatacagtatgaaactttaaaacaagaagttacttgtgagaagcccttaaaaggtaataggcaatagactaatatgagctgtagtacttactcaggtaataacactggtattaatagaattaatacaattccatcaatacagtcattttcaggacagagtacgtagtggacatagattctgtgtgagtgtctgtgtttgtcagttcacagaaaacatccaggtcgttctcttattattggtgtaccttttccattcagtcattcagcattctttggcaccaactgtgttccaagctggagcgagaggtttccattttagtgcctttctggcccctccagagatttgatggtgcctcagaatacaataaattacatatatatatatattttgagacagagtcatgctctattgcccaggcaggagtgcagtggcataatctcggctcactgcaacctccgtctcccaggttcaagagattctcctgcctcagcctcctgagtagctgggataccacgcccagctaatttttgtatttttagtagagacggggtttcaccttgttgaccaggctggtcttgaactcctgacctcaagtgattcacccacctcggcctcccaaagtcaaagtgctaggattgtaggcgtgagctaccatgcccagccaaatatataaatatattttaaacacaagttagtaccaatcaggataggtgtcagtgttagactagatttaaatctagtttcatatggttaatctagttcatactgtttacaagagatgcaaataaggacatggaaaggtgagaaaaactatgttctaggaaatactgaccaaaagaaagctggccaactttattaatatgaaacaatacattataaggcaaaaaagatcacatcataatgatacactgtttaacttactagaaagaataagtctttttttttttttttttttttttttgagacagagtcttgccctgtcgcccaggctggagtgcagtggtgtgatctccactcactgcagcctccctagtagctgggattacatgtgcgcaccaccacgcctggataattgttgaatttttaaatagaaacaggttttcaccctgttgccaaactggtcacaaactcctgaccccaagtgatccgcctgcctcagcctcccaaaatgttgggattacaggcataagccactgtcactgtgcctggccaataattcttaattctttacctggtcagtagatcaaatgagtcagtaagaatttacaagattagaacaatatagctaaccagcttgaactttgaactgcacccatcaactggagaatagttatttcctttttttttttttttttttttgagacagagtctcgctctgtcgcccaggctggagtgcagtggcacgatctcagctcactgcaagctccacctcccaggttcacgccatcctcctgcctcagcctcccgagtagctgggactacaggcacccaccaccacgcccggctaattttttgtatttttttgagggggggtggggggggggcagagtcttgctctgtcgcccaggctggagtgcagtggcgccatctcggctcactgcaagcttcgcctcccgggttcacgccattctcctgcctcagccttctgagtagctgggactacaggcgtcctgcctcagccttctgagtagctgggactacaggcgcccgccacaacgcctggctaattttttttttttttgtatgtttagtagagatggggtttccactgtgttagccaggatggtctcgatctcctgacctcgtgatccgcccacctcggcctcccaaagtgctggcattgcaggcgtgagccaccgtgcctggccaattttttgtatttttattagagacggggtttcaccgcgttagccaggatggtctcaatctcctgccctcgtgatccgcccgcctcggcctcccaaagtgctgggattataggcgtgagccaccgcgctgggctgagaatagttattttcagaacatacagagcacttacgaaaatggcctacatgctgagccatggggcagatctcaccaaatttcaaagtctccacactacggctgtggttcttcacattttgcaagtgatggacttctttgaaaatcccagtctaataaattaaggttgcccagacttagcactgttgacttttggggttaaatagttctttgtgtggggctgtcctgtacactgtaggacatttagcatttccccaatagtggcaaccaaaaatggcttgacattgtccagtgtcccctgagggacagaatcttatctggttgagaaccaccattagagatcttgtctctagaaaaacacagaattttgcatacagtttcttccatctccattagagctagttgatcttgtcctcactgaggatggctgagggagtgggactttttctaagaaaggccgtagggcagccaagcagcctgggggtttggtctttgttctgtgcacggcctctccccacacccctgtcctggatatagatgctcacacgcgtgtgtggaggtgtcataggcatgctggtgctgatgggctgagggctcagactgccatgagcccaatgtcctgctcagggcttgaagagatgaggccagggcgtgttggaaggcagtcctgcctgctcctccttctcagcctctttcttctctctgcttttctctaaaatggtggtgttgttttaatcaagacctgtcaggctctggttctgagagaaatacttgctgcactctcaggtgtcttgtctcttcctcaggttccccatgttcacttgtagaccatggacctccaaagccacaaacataaggcataggttttactctaagcctttcggtaggtgccagtcacagagagttcaagtccgtaacagtaaaaaatacattattaaaatattagatatgaccataaaggaatgtaaaagggagagtttattctgaggaccaggtgatgcaccatgctggtgggatcagaggagactttataaaggagaggtagacatccaggctgggttgtgcaggatcaatgggagtttgcaaggggaggggacattgcaggcaggtggaacagcatgctgagttctgggggctagtgatagcaaaacagagacagaaggtaaaagaaggtatgggtgaggcatgctcagaagctttgactaggtctgcaagcagttgaagggtttaaagtagggaagtgacatgatcagatttatgtttaattttttttccaactctttatttcataaaatagagtaagtgttcctaagtttaggtttagaagttgatatgagtggctctgtgaaagacagattacaggtcagaaaactggttggaggctatgcaaagaacccagctgaacaatgaggtttagaactgtcatggcggccatggggctagaagggagatggacctgcagagggtatcaggtccccaaaccccaaaatctagtccacatttgttatgttgaaggacacagtcatgtccctggctagagaaaggacactgcccttagctccaaaaataaagactaagtttttatttgagagagattttttcctctttttatatacatttttttcctctaggaaatagacagacggttggaaaaaaaactgaagatcacacaaaaagagaggtaaggctgctgtctggtctgagggctcatgctctctgtggtttgagagccgggcagtcagtggtgttctccagctggccattaggattagcaggtcctagcaggtcaggctctggggcagcaaacccttccctccaaattggagaccaggacgtggtggcttgaggctttagggttgaggctggggtgttgcacctgcctctgaccttcgtgggctccctgtgtgaggtcatctgatgcaatgtgaggaagtgacaagttggaagacttgagttttaggcctggcagtgccccagttgctctgaggtctggggcaagtcatttcccagatctggacatcagtttctttctctgtggcatgaggagtgtgggcagatgatttctctgggtccccagtgacttggtggtctagggtattatgagggtatcctggaagaaaacattctaggaaattcttgaaaaaacctttaaaaatagctttgttttccacctagacgacagaggagggtgtttccagagtaggtgaaagttgacttcggctttctgcttttgggcttagggaacctgttggttttccataggtacaagggacaggaaggaggatagggcccctctggatttgctcacggggctgcacagtcattccccaggaaactctgggtgctctgcccgcccgctagttttcctggctccctgcctctttgatcagattgctggctccttgtctgtctgctcatctcagcaaccacgctaaccctgggttacagtcctcgttccataccatttgtgtcctacccgagacttgtttccatccaccctggctcagttcctccaatcccgactcctcctgacagccaaggctctggaagcaggcttgtttggttctgaagagaagctggttgactgctctgggtagggtcctggtggctgttgtcgggtggtcattcctgcctgggttcctgtctcctcctgtggcttttgtttctttcccttcctgtgttgttgtccctctttgttttttgtcattccacctctccctgtggacacatcgccttgatgtacgcgtccaccagccttggacaatgcttttcttttgagcattgccaagcactgtttctaggagcatccttcactccagccccgccgctgtccaaaagaccagggagccctggcaagggaggtttctctgttcagaagctttttgaagaggattcagttgtctggtgtagcttgtctctgggaggcacaggtcactctcactagaaggtggcttggtaaatcttgatgccaggcagggatggcgtagtgggctcc

SEQ ID NO: 493 - DNA, 13259 bp, Homo sapiens
aggacagggcctataaactggactgaagaaggcgatgagcagtcaggcgtgcggagttacagcttgagggtaaagaaaaccggctggggtgcctgaggctatcaggggaggagttcggcaggtggctgaataggagagggtggcagcaatgtgggaaagaaattgcgggagcgctgagatcgagaccatcctggctcacacagtgaaacccggtctctactaaaaatccaaaaaaattagccaggtgtggtggcgggaggctgaggcaggagaatggcgtgaacccgggagccggagcttgcagtgagccgagattgccccactgcactccagcctgggtgacggagtgagactccgtctccaaaataaaaataaataaataaataaataaataaataaataaataaataaataaattgaggagggggcgccatgtggagggaggaagggattgagttcccctgtgttcacaggttcttggggctgcacccctatgacgactggtggggatcatccagtccctcaggctggatgagcagcctggaaatgtcaggcaagcgcagcaggggaaggtctcagtgatgggcatgcctggggggtccacagctgggacttacacccttgcttattacaaaagcaagaagggcacatctggggagggtcatgaatggtcatgctgagtcacgagtggatatttggggctgcccttggtgtggcagctaagggcccagccagggcttgctctagcctgcttgtgtaggggtggccagtggggaagtcaagaagccatctggggcctggaccaggagggcagaggggaggggtcccagacaggtgagggaagtgccacctgaagataatctcggggtggaacccaaggaaggagggacactgggggaggtgactgttgggatggggagcttggtcctggctcacagccataccttagaccatgcctacctccacctccctgctgttttaggacctgatgaccttcgaggatgtggccgtgtacttctcccaggaggagtgggggctcctggacacagcgcagagggccctgtaccgccacgtgatgctggaaaacttcacacttgtgacctcacttggtaaggccctgggtgctccatgaaaagtgcacttggtgacaatcaggactgcctcttcacttccctcctggttgatgagcaggatcaaatctggccagggccacgtggaacaagggtctggtcctgtagacacaaagtttggttgggtcagccactccttgccgccctgtccagctgtggcctctctcatgcctgggctcagtcccgttgctttggtgctctgggcacagttgctgctctggggacacatgagctattcctatgagccccttgccctgtgctatctttagattctcccagttgcacagattactgtctatttccatgaagccctgactcctgctctctgttgggaggtgggttgtcttgacctggggctgggctctcacctgctcctcctcacaggactctctacctcccgacctcgtgtggtcattcaacttgagcgtggcgaggagccctgggttcccagtggaaaggacatgaccctggccaggaacacctacgggaggctcaactctggtgagtgggagctcaggtggggtgaactaaggaccaacctgtggccaagcccatgtccctgcttttctgactctggaaacacatcctcctctcctgcctcctacctgactcccttctcttccatcatcagcctctcctggaggctgctgccttagtaggtgcccttgaagggagagctccaagggcacaggagctgggttcacacagaagggcctaccttcagctgggctgtgtggccttgaaccctccacaactagcagccattattgataggtatttatttcgcccatcatttatctttgtattcatcaaatgtttcctgagggcttgtgggcattgtagacacagccttgaccaggacactcatggtcctgcctttgtggggctgatggtgctaggggagacgcagtgagtacgtaggattcaggagtgcagtcttgagcattggttggaggtcattgcaagagcaggtttgggagtgggtgcccaagacggggcaccaggggagaagggagtgagctatggaaagggagggggtggaacagccagtgtggagacgtgggtggcacgcagcagctgctgttttcctcagcttcacatcctgggtgtctgggggctgccgccttgatcatgggagtccccactgcagtcagtgccacacctgtcagggcagatgcttcctccaaaccccagcccctcctgcagagccagcctcacctcttctttttccctaagcttttgtcccggctcctgggctcccccttgcctgtccactcagcctgccctggtcctctcctaaccaggatgccccaggcaaccaccgtttctctgcgtttaggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcctgctaggctcgcgcagtgaccaggccagcatcagcctgcgactgacctccccactcaggccccccaagagcagccggcccagggaaaagaccttcacagagtaccgggtgcctgggaggcagcccaggacgcctgagcggcagaagccatgtgcacaggaggtccctgggagagccttcgggaatgcctcggacctgaaggccgccagtggtggcagggatcgcagaatgggcgcagcttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcacccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtatgcgcgctctgcggtgctgccttcagccagggctcctcgctctttttgcaccagcgcgtgcacacaggcgagaagcccttcgcctgcgcccagtgcggccgctcctttagccgcagctccaacctcacccagcaccagctcctgcacacgggcgagcggcccttccgctgcgtggactgtggcaagggtttcgccaagggcgccgtgctgctcagccaccggcgcattcacacgggcgagaagcccttcgtgtgcacgcagtgtggccgcgccttccgtgagcgccctgccctcttgcaccaccagaggatccacaccacagagaagaccaatgccgcagcaccagactgcaccccggggccaggtttccttcagggacatcatcggaaggtgcgccggggagggaagccaagcccagtcctgaagccagcgaaggtctgaggtcacaggtcgcagcccaaccctttcttggccttctgtgaatcccttccacagctaaagggtccgagtgctcttcagatccacgatggggaaaagctctgtgcctgagagtcagggacgagggagaccctttggctgtggttccatttgcaggtggggacaggatttgccagtttagtcatagctcacacctccatcctcaaagaggtaacactgcagaaacatcagagggaggacatgtcagctggaactctggtggggctgaggctgtagttggggccataggacgccgacaaaggcagcgctgcatggtggtgctacttcatgtgttatgagagtggatgctgaggtgagggggatgcggacatggggtaggatgacctagagaaacttatgatgtctgcacacaaactggccgctagacggacgctgaggacattttccccctgaggcctctattcaaggcttcctgggggccatctcagcaaacaggagactacaggggactggggatcagggtgtggcctgtgagtgtcagcctcctcctcggaaaaagaaaagctttgggtcaactcagcatcatgtttgcagatgctgacagacgggatcctaatgagagtcaatgtgtgctcactgccagctcctgggctgtgctctggtcagccaggtgtgagggcctggcctggggtcacacagctgactcaggagaggaatgcccatggttctcagcattggaaggacaaacctaggatgatggctttccagtggcactcgttcaggttttcgtccaagtctcagcttggccaaggcctgtcgctcactcatttacaaaagtcgatgtgaggaggagcctttacacctgtggagacagtgatagctttggagcagataaggtggagctgctcatttttgctggatttggtggccgatccccgcccccacccccaccccctccatctcacctttcccttgttatgcctcctcaattggaggctggacagagagctgaataggaaggacttgccattacctaaggccatgtgtgacagcctcctgaggacctccccaacccagtgtgatgggcctgcatggcagagacaaaagggtagactgggggtcatttgcttcctgtggccttaagcctactaggccccatccttacctgagacctcacctccaagaaattaatggtcttttcaatggagaaaaaaaaagactagtatttgcaacttcaaatagatgtagtttcctttacagccgtgtggacctccacagcacagcctcctgtctctattccagggtatgattcagttgtttgtttgtttttgagacagagtctcaaggcaactcttcttgcccaggctggagtgcaatggcacaatctcggctcaccgcaacctccgtctcccaggttcaagtgattctcctgcctcagtcttctgagtagctgggattacaggcgcccaccaccatgcccggctaattttgtatttttagtagagacagggtttctccatgttggtcaggctggtctcgaactcccaacctcaggtgatctgcccatcttggcctcccagagtgctgggattacaggcgtgagccactgcgtttgtttttcatgaagcgtctcagtctgtcgcccaggctggagtgcagtggagcaacctcggctctgcctcttgggttcaagccattctcctgcctcagcccctccagtagctgggattacaggcttgcaccaccatacctggctaatttttgtatttttagtagagacggggtttcaccatgttggctgggctggtctcaaactcctgacctcaagtgatcggcccatcttggcctcccaaagtggtgagattacaggcgtgagccactgcgcctgcctacataccatgattttaaagttgcagctgtttcctattgcttgtaactcagtcttgtcttttcaatggtaaccaatttctgtttcaaactgaaaggttcatgagggtgagttcttctattagtctgttttgtgtcactataaaggaacacctaaggctgggtaatttataaagaaaagaggattaattggctcatggttctgcaggatgtacagccatggcaccagcatctgcatggcttctggtgggacctcaggaagcttgcaatcatgatggaacatgaaggaagagctggcatatcacatggcaagacaggaagcaaggcgggggggaagtgtcacacatttttttttttttttttgaggagtctcgctctgttgtccaggctggagtgcagtggcacgatctcggctcattgcaacctccgcctcccgggttcacgccattctcctgcctcagcctcccgagtagctgggactacaggtgcccgccaccacgcccagctaatttttaatatttttagtagagacggggtttcaccgtgttagccaggatggtctcgatctcctgaccttgtgatccgcccgccttggcctcacagcagagtggtgggattataggcgtgagccaccgcgcccggcccacttttttttttttttttctgaaatggagttttgctcttgttgcccaggctggggtgcaatggcacgatctcagctcactgcaacctctgcctcctgggttcaagtgattctcctgcctcagcctcctgagtagctgggattacaggtgtgcaccaccatgtcagctaatttttgtataatatttttagcagagacagggttttgccatgttggccaggctagtctcaaattcctggcctcaagtgatccacccgcctcagcttcccaaagtgttgggattacaggtgtcagccaccgcacccagcccatcacacacttttaaacaaccaaatctttcatgaactcagagcaagagctcacttctcaccaagggggatggtggcaagctattcatgaggaatctgcccccatactatagtttggatgtttgtcccctccaaatctcatgttgaaatgtaatcctcaatgttggagatggggcctggtgagaggtgtttgggtcatgggggtggatcgctcttgaatctcttggtgctgtcctcaaggtagtgagttctcacaagatttggttatttaaaagtctgtggcacctccttcctttctctcttgctcctgctctcaccaggtgagatgcctcctccccctttaccttctgccatgattgtaagcttcttgagaacctagcaagaagcagattctgaagccatgctcgtacagccctcagaacagtgatccaattaaacctctcttctttataaattacacagcctcaggtatttctttatagtaatgcaggaatggcctaatatacctcatgatccaacacctcccactaggccccatgtccaacactggagatcacatttcaacatgagatttggaggagacacacatccaaaccatatcagttctcttgtccctgagtgaagaggcacttgctccctctaaacccaattctaggtgactagagatttatgaaggtgtcgggatgtttgttcatgatgcatagtggcctcatagggtctccctacttcttctgcaagaagaacaccttcaggggctttcagctcagccagaagattcacataaaggttgttcatctggtaccttgagcactctgccaacacaggtgatcacagattccaagacacataaaagagtgaatcacaactcactggtgactcattgaggagtgatgctcacaaagcaacacacttcgtctaaatacactgtactaaccttggtcacttttgaaaaggtatttctacaattatttgaaactgctcatgaaaactgagctttcccttaaggagcaacccccccacccttcgaaacctatggagatcctatttccaaaaacttaggtaaatggacccaggtcactcgagatgaccctaaaatgcagtggccaaaacggagatcttttgaaattcctaaagtaatatatttgtgtgcacaataggaaacttaatatgtttgttctaaaaccagacaaattggatgggaggcctactttctgtttgtgcaggctatactctgataagatatttgaaaggttttttaaaaagagctctataggccaggcacagtggctcatgcctgtaattccagcactttgggaggccaaggtgggcggatcacctgaggttgggagttcgagaccagcctgaccaacatggcgaaaccccatctctactgaaaaatacaaaaattagccaggcatggtggtgcgtgcctgtagtcccagctacttgggaggctgaggcaggagaatcacttgaacctgggaggcggaggttgcagtgagctatgaaactatagcaaactccagcctgggcgacagagtgagactccgtcacaaaagtaagtaaataaaatacaatgaattctatggtcagatgtcagcttaattaaaagctgatattcaggctttttttttttttttaagaaaaaatacctttctgctttttctcatttggagcctgtttctgggaattttttttttttctgttgactgaaacccctttttacatatgtttagtccctttgtttgcttcttttcttgttagtatgatgtaaagttttattggccttctgaaaaacttaaaatctccccaaattggcttagagctctcccattttcttctactttttcttcctttagctatctttgataccacataaagaaatctagaggagtcttctaatatctctgagaccctttgaggaacacagtaaagtgtcacatacaccttttatggagtcttctgtcttcctcatggaatcctaagtgtagcaggcagtttatcttaggtctaaagctctgatctcttttacactgagttctctgaccttttggcttggggggtaccaagggttactttgttctatgaaagaacatgatctttgggtgtgcactggctggcaagttactggcaagggctgcagttttggctgatagcagttgttttcagtgagtggttattactgcagggtgtactaattcctttgcatgtttaaataagaaaagtatggtttgaacacttggagacttatagaaacactcatcaccaagggggaagaatcctttgggagatgggctgatcacagatcacagagtgggctaattggtgctgggtgtcccaccagcatcagggaatgtccatgcagtgaggtgcactgtggaaacacagccctgtcctgtggtatttccatcttgtggggtcctcaagattccattttaaagtggaatccttgattttatttatttatttttattttttgagatggagtctcgctctgttgcccaggctggagtgcagtggcgtgatctcagctcactgcaaggtccacctcccgggttcacgccattctcctgcctcagcctcccgagtagctgggactacaggcgcccgccaccacccctggctaatttttttgtatttttagtagagacggggtttcaccatgttagccaggatggtctcgatctcctgacctcgtgatccgcccgcctcggcctcccaaagtgctgggattacaggcgtgagccactgcgcctggcctggaatccttgatttttaaagctctagatgttctgcctttcaactgtgccagttttttacatagatggggtttctctatgttggtcaggctggtctcaaactcctgacctcgtgatccgcctgcctcggcctcccaaagtgctgggataacaggcgtgagccaccgcacctggcctatgttgagttttaggccacaaaaaattgaccaaaaattttttgacaattgcatctttaaccatggacattttaagttttgtcctcagctgggcgcggtggcttatgcctgtaatctcagcactttgagaggccaaagcaggcagatcatttgaggtcgggagtcggagaccagcctgaccaacatggagaaaccccgtctctaataaaaatccaaaatttgctgggtgtggtggcccatgtctgtaatctcagctactcaggaggctgaggcagaagaatcgcttgaacccaggaggcggaggttgcagtgagctgagatcgagccattgcactccagcctgggcaataagagcaaaactccatctcaaaaaaaaaaaaaaaaagttttgtcctcttccttcttgaggagttgctttgaagcttcacagcaaccaaggaatctatttcactgatgaaacaattcaatctactttaacatatggctggttatttagaatgtccattttgcatactactctcagtcttccagactgctggaatgtacaaataaggtaatagaaaatcaatttacaaagcttacagaaacttttaaccttccgtggcctaaggcttttccaatggtcctgaatgaaggaacctacaaaccagctctccttaatgtgagctcctgggagacaaaaatatcaaagatcaagggctccaacctggagattttgtttatgagaaatgccatctaataaaggactccctacaaccatgttgaagagaactccagcctgggcaacatgatgaaaccccatctcaacaaaaagaacaaaaaaagcaaaaattagctggcatgcacctatagtcccagctacttgggaggctgaggtgggaggatggcttgggcccaggaggcagaggttgcagtgaggtgggttgtgccactgtactccagcctgggcaaaagagccagaccctgtctcaaaataaagaagttgagggaggcatatcagatattcttaaccaatccttgtgcaagctaaattcaaaggcattgacttgcagattcacatttttcatttttaaaaaatgcagcccatggccgggcgcagtggctcatgcctgtaatcccagcactttgggaggccgaggcgggtggatcacgaggtcaggagatcaagaccatcctggctaacacggtgaaaccccgtctctactaaaaatacaaaaaattagctgagcgtcgtggcgggagcctgtagtcccagctactcgggaggctgagggaggagaatggcttgaacccgggaggcggagcttgcagtgagccaagatcctgccactgcactccagcctgggcaacagagcgagactccgtctcaaaaaaaaaaaaaaaaaaaacaatcctgcttgagtagacatcttcgatcattccagatctccaactgaggcagtcccattccccaagaaggaagaggacaaaacttaaaatgtcatggttaaagatgtgattgtcaaaaaaaaaaaattggtcattttagtttttgtggccgaaatctcaataatcataattatgactgatagcataccatataccagtcatcttatagctcacacgaggatgagaagtagaaaatttgttagaaaatatcactcaggcggtcgggcgcggtggctcatgcctgtaatcccagcactttgggaggccaaggcaggtggatcacctgaggtcaggagttcaagaccaggctggtcaacatggtgaaaccccgtctctagtaaaaatacaaaaattagtcggttgtggttgcaggcacctgtaatcccagctactcaggaggctgaggcaggagaatcacttgaacctgggaggcagagattgcagtgagcagagatcacgccattacactccagtctgggccacagagcaagactccatctcaaaaaaaaaaaaacacacacacactaaaaaagaaaatatcactcaggccaggtgcagtggctcacacttataatcccagcacttttggaggccaaggcaggcggatcacttgaggtcaggagttcgagaccagcccaacatggcaaaaccttgtctctactaaaaatacaaaaattaggtgggtgtgatggcatgcacctgtaattccaactattcgggaggctgaggcacgagaatctcttgaacccaggaggtagagattgcagtgagccaagattgtttcactgtgctccagcctgggtgacagagtgagatgctgtctcaaataattaaattaaaaattaaaaaatgaaacgtttgaagagttaaaatgcctccaaatattcatacattgcttaaaatggtaataatgcctctaagcatttgatcaaatcacaactttaatactacttttttttttttttgagacagagtcttgctctgtcacccaggctggaatgcagtggtgtgatctcggctcactgcaagctccacctcccaggttcatgccattctcctgccttagcctcctgagtagctgggactacaggcgcccgccaccacacccagctacttttatttttgtattttttagcagagactgggtttcaccgtgttagccaggatggtctcgatctcctgacctcaagatccgcccacctcggcctcccaaagtgctgggattaccggcgtgagccacagcgcccggccacagcttgaatagttctaagtgttggggttttttttcttcagggtttttgaactttaatacttccttttttttttttttttttttttgaaacggagtctcgctctgtcgcccaggccggactgcggactgcagtggcgcaatctcggctcactgcaagctccgcttcccgggttcacgccattctcccgcctcagcctccccagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccaccgcgcccggccctgaactttaatacttctaagtgttggggttttttttttccccctcagggtttttgtttgttttttcctgagacagggtctctctcttacccaggctggagtgcaggggctccatcatagctcactgcacactccaactcctgaactcaatcctcccacctcagcctcccatgtagctggtattacaggcatgcaagaccatgctcagctaatttttatatttttttataaagatggggtcacattttgttgctcaggctggtctcaaactcctaggctccagtgatcgctcaccttggccacccaaagtgctcagattccaggtgtgagccactgcgcccagtcctgaaatgttcttaaattctttcaaagtagcaaaatttatattaaaacattccaaacatgatgagctcccttgctctacaaggatttacaagtagaatcaattaggtggacagttatagctgacagttgacagagagatagttatagatggaggtaggtatagagggagggaggcaaaaagagttaaggaactggacagctgagaactgtctacaggttccaaa

SEQ ID NO: 494 - DNA, 13316 bp, Homo sapiens
ccctgcgttagattgcaataagacttgacagttttctcatcattcagtatgttcactttttaaaaccggatttagttctactaaatctgcctcattttaatcacaagtctttgctaggaaatgtagagctaaaccaaagtaacactataaccatggaggagggactgtgtcacacaaagtccacagtgggcctgtgcgatcccacattgattcattttgagtgcatccccccatggtagtcattggttatagctctatggtctgaggagatcacaaagttacaaatgaactcttttacctttagccacagtgacagccaactgcagctgtatgaagtcatgaggaatttctttagcacaaaaatgtcaggccaccttcaaggagagaagcttcttgtttgtaaaggtgagggataagcgggagtggaaaaaatgtcattcacactttactcgtgaatatgttcatgtatactaatatggtttaaaagtcagctgagaggcctggtataggtggctcacacttgtaatccaaacactttgggagtccgagccaggaggaatgcttgaggccaggagttcaagactagcctgggcaacacggcaaaatatcatttctaccaaaaattttaaaaaaaaaaaattaggtgtggtggcacacacctgagaggctgagcccaggaatttgaggctgcagtgagctatgatcatgcaactgcactcaatcctgggaaacagagcaagaccttgtctcaaaaaaaaaaaaaaaagttatctgaagtaattttaatttttttattttgaaaatttcatacatacccgagtatatttattacatatgtattatttaaagtataataatatggatgtgtatgtacctaccactcagcctaacagacactatcaataattttaaaataccttatgtgtgtctctcattcacatttccctgtctccccagatataaatactattttgttatttatttagttttacttcttttcactgctgaagccagaatggattgtgatgtgtgagagaaagaaatctttgtgttaagcctctaaagtctgagttattttttatagtcataatagagagattaataacttgaatttaggtgctgcctaaacaaaatactaatatgtgtggcattaacttagcaggtctgcagtgagaggcacagaaagaaatatgggaggttggaagcctgggatccctgttatgccatagcagaccaagtgcttactaagactgtaggtcaaaggaaggatgttgggaaaacaacgaataataatgtgttgatatggtttggctatgtccctacccaaatctcatcttgaattgtagttcccataatccccacatgtctgggagggacctagtggggagtaaatgaatcatattggaggttacccccatgctgctgttctcatgataagagtgagtgagttctcataagaactgacagttatataaggggcttttcccacttttgcttggcacttttctttcttgctgccatgtgaagaaggacgtgtttgcttccccttctgccatgattttaagttttcagaggcctccccagccatgctggaactgtgagtcaattaaacctctttcctttataaattacccagtctcaggtatgtctttattagcagcatgagaatggactactaaatgtgtactaaatgttactggctgcctttggtaagagagaataaattgatgagcttgcaatatagctaactagtttgtaaggagaaataaaagggaatagagagagtctaggaaagaatctagaaatttggggcattgaagggcattaaagagttggaaaggccaactatttctaggtcccaaaaagaaagagataaggctgagaaaagtcaagccacaaaaggccactaatactcagccttgtggcaaggatcagattatggataggtgttaacttcacatcaccttaatcaattagttaaataacctgcatggtagctgccattaggcagagagaggtatgggccaaagaaacaaatcatgctctgaaattatattatacatagaactggctactattttgatggaatttatataaactaggactaaaaagcctttgaactgtaaaatcagctttagacacccaattttgttcaaacagattatgagctctgaaagctatgcatccccaatagagggcataacctcatcatccacttcgaatgtgggcaagaagatgaaaaaggaagaaactcccacggactggagccagtggctactaagaaaaaatggacaagaacattcctcccaagagcagagtcagagcccaagaaaggaaccgaccccattcccagtgaagagggctttcaccatatcttcccaatgggattttataaatgctgtggatgagtgatgctgtgcgttcttcctcatctgagcaaaggttattatgggcatccttccatgctcacacactgactgctacattccacagttgtttgggcccagcaagtatttgcctatcagattttacagtatttgtactaaggcttgaaagaacagcatcctagaaagacattgatggaaatgcaaaaagattgtttagttaaaaaaaatcattgttttagttatgttcagcagacttgaaaatataccaagttagaatcaattttaaaataccaattgagattcaagaacctgattcagtgatgcagcaggccaggagccatcaccatcaatgaatagctcaatttctctctcatgtagttgccaagaaagatattatctactgaagaaaacctaaatacctgtaagtcttactaaaaatattgtttgatacaagtgagcataggctgactgcttcaaccagtaaaacctaaatctcagtgtcttaatacacacagaaacatacaaaaggatttccttttctctcacataaaaaccaaatgaggattaacaaagtgagaggaatggatgtgctacatgaagtgattcggggacccaattttcttctaccttgtggatctgctatccctgaggccttggaatttgcttttagaccctctatatccacccataacacaatttttttttaaagaaaaagcacaaacaagaaggatcacctgggacgttttaatgggctagtcacagaaacgacatgtatcacttatgtctaggttatattggcctgaagtcagtcgcagggtcacacctaagtgcacacagtgtttcacacgcctatctctaaacacagtagcatacataccacacactaccaaacagtgtttcatgcatatatcactaagcaaagaagtatgtgtgcatcatcacacactggcaaacaaagtgtttaacacatacactttgttatgtatgtgtagcctagttctgtgtcccatagaaaaagcctagttctgtgtcccatagaaaaagaaaacagtttggtgagtgcatagcaacagtttttgccacagtccatcaatttgatcaccaaataaatagcttttgctctttcttcccagaatatacttacctccttgccaaggtaagacaaagccccatccagtcattttatccagtgcaaatttcattgattaaggtgagaaaaatatatttaggtgataacataaaaaaaagttacagatgcatagcaaaatggatttttatattagattttaaaatattttctttgcttttattttaatgctttatcctttacttctggctttgagagtaacaggggaaagatttagcttcttactgtgaagaaacagaaaattagtcaaaaatatatgaaacaactgcagatattgacatgcaccttaagactatgacccctgagaggaatgaagtgaggcccatccatcattctagatttctacctgcaggcacagacctcagagcagggtaggggatcccaaacaaagcatggtggtttcatgtagttgagaagacagaggctggagttcagggaggctgaagtggctgaagttgcagagcagagtaccagagagctaacagatatgtaaaaacagaattccagaaatctgcataggagccccttgagaggtggctggatattaagacatgtaagcctagagcaaaactctacgaggtcaagcagagtgccacacaggcctgtgaggcatctgaggtccaactagccagtgttgagtgtcccagctgatcactcacagaattttctagtgatcccacaatagctatgccttagaaatggtgttaaactctctgtggggtgaagctcactctatacttaccctaacaaaggcttgaaaagaagaaactgaactgcaattaatttaactgcctataagaataaatctataaccaacaatgtgaaatcatcaatgcctggcatctaatataaaattagtagatattacaagaagcagaaaatgaaacccgaaaccaggagaaaaatcagtcaccagaaacagactgagaaatgaaaaagatactgtgtaagtatgctaaaagtcattatatgcctatccaattacttaaaggaaaacataaatacagtgacagaagatataaaaaaagaaccaaaaggaacaatatcaagtggtttacaacaggctgtaattaaagtcccaggaggacaggaaagggcagaaaaataatacaaaaatggcccaaaattttccacatttgatgaaaactacagatataagctcattgaacaccatgcaatataaacacaaaaccaccctaataaaactgattttgttagttattagctaatggcaaaacgtttttgaaagctcatatttatagtctatatgtatacaacctatatggtataatcaacatatattttatggagttatttttgtctcatgttttgttgtgtgataaatgagcagggaattacagaatgttagtatcagaaggcacactgacagcaatcaaatacacacctccaccactgcaggaatccttcgtatactattcctgaggaatggtcacctaatctctgcttaagcaatttcaacgatgataaacttacgactgggtagttctccagatagtaatattttctgtatttctgtagctgagttggcaaattgctttaataaagttaaatgaactctacaaattcaagatttttctaattcatagtcagattaattgaatgttaacctgtaaaaataatgccctactgtcaaatatatgatatgagctcatatttatgtagtgctttattatcttaaaggtactttttcataattcaattatatgtagtgatttcaataccagttttcaatattctggtatactctgccctttttaaataccaaaatcccagcactgttgttacagtttggttattctgatatttaaaatcaacaatctaaattttttaaatattaaattagtatctataactcaattacctaatttatgaacaaaattaatacaatgtacatagtatagaagtctagacaggtcctcacctgtgcacacagcaaaaagcaatcaaatagtgttactgataagcttctgttgcaagaataattcttagttccaaataagtaatttcttatccagtagaatatgaaaataatagtactaaaattgatataggtaactctgctttggaatctcctatacatgctaaaactaattcagatgaagaaaaggtaggaataatttatttgaaatcaatactatatagctctttataaattttttaaaaatccagccccagtcaaaaatcaaaaggtgttttataaatatctccacaaggtcattaagtaaaaaaattggattatttaaatttaaataagtcaaaggaaaatattgggaattagcatgtaatgctctcatcattattgttttgacatcttggttggaaaattctccccaaaatagctattttctattcaacatagtactggaagtgctagccagagcaatcagacaagagaaagaaaaaaaaaaggcatctacatatgaaaagaattcaaactatctctcttcaaggataatatgaccctatacatagaaaaccctacagactctgccaaaagggtcctggaattgataaacaacttcggtaaagtttcaggatacaaaatcaatgtacaaaaaatcaataacatttctatacaccaacaacattcaagctaagagccaaatcgagaatgcaatccaatctacaatagccacatacacaaagacatacacaaaaacccctaggaatatatctaaccaaggaggtgaaagatctctataaggagaactataaaacaccaccaaaagaaatcagacaacataaacaaatggtaaaacattccatattcatggggtggaagaatcaatattgttaaaatagtcatactgcccaaagcaatctacagattcaatgctattcctatcaaactactaacatcatttttcacagaactagaaaaactattctaaaattcatgtggaagtaaaaaggagcccgaatagccagagcaatcttaatcaaaaaggaaaaagccagtggcaacacattaccagacttcaaactatactgtaaagctacagtaatcaaaacagcatggtactggcacaaaaacagacacagagaccaatggaacagaataaagaacccaggaaaaaaaagccacatacctacagccatctgatcttcaacagtcaacaaaaataggcaataaggaaaggactccctattcaacaaatggtgctggaatagctggctagccatatacagaaggatgaaactggacccctacctttcaccatatgcaaaaattacctcaagatgaattaaagatttaaatgtaagccctcaaactataagaatcctagaagaaacctaggaaacactttttttttttttgagacagggtttcattcagttgcctagccttaagtgtagtggcatgatcacagctcactgcagccttgacttgccaggctcaagtgatcctcccacctcagcctcccaagcagctgagaccataggcatgcaccaccatgcctggctaattttttactttttgtagagatggcagtctcactatgttgcccaggctggtctcaaactcctgggctcaagcaatcctcatgccttggccttccaaagtgttgggattacaggcatgaactactaggcctggcccctggaaacaccattctggatgtcggccttgcaaaagaatttatgagtaagtcgcaaaagcaattgcaaccaaaacaaaaactgacaaatgggacctaattaaagagcttatgcacagcaaaagaaactagcgatggagtaaacagaaaacctacagaatgggagaaaatatccatgaactatgcatctgacaaaggtctaatatccagaaactgtaagaaactgaaacaactcagcaagcaaaaaataaccccattaaaaaaaatgggcaaaagacacgaacagacacttatcaaaagaagacatacaagtggccaacaaacatgaaaaaaatgctctacatcactaatcatcagagaaatgcaaatcaaaaccaccataagatgccatctaacaccagtctgaatggctattattgaaaagtaaaaaagcaacagatgctggtgagactgtggagaaaagggaacacttagacactgttggtgggaatgtgaattagttcagccactgtggaaagcagtctgaagatttcttaaagaacttaaaactaccatttgacccagcaatcttattactgggtatatatccaaaaaaacacaaatctttctactaaaaagacagatgcacttgcatgttcatcgcagcactattcacaatagtaaagatacagaatcagcctaggtgcccatcaacagtggactgagtaaagaaaatgtgctacatatacaccagcagttcccaacccttttgacaccaagggctggtttcatggaaaacaatttttccacggactgtattttggggaggggatggttttgggatgaaactgtttcagattaatcattagttaaattctcatctggcattagagtctcataaggagtatgcaacctagatcctccacatgcacaattcacaagagttcgtgctcctatgaggatttaatgctgctgctgatctgacaggaggtggagttcaggtggtaatgcttgctcacctgcagctcacctcctgctgggcagcccaattcctaacaggccatggatgggtaacagtccacggccagaggctggggactcctgatacacaccatggaatactacacagtcataaaagaaatgaaatcatgtcctttgtaacaatatggatgcagctggaggccattttcctatgcaaattaacacagaagcaggaaaccaaatactgcatgttctcgcttacaagtgatagccaaacactgggtactcatggacataaagacagcaacaatagacactggggaccactagagggtggaggaagaaaggagagcaaacattgacaaataactttcggctactatgctcagtccctgggtgatgggattatttgtgccccaaatctcagcattatacaatataccacgatagcaaacctgcacaggtacctctgaatctaaaataaaaattgaaataaataacaacgaagaaaaaataaaatccttatctctcactgtaaaaaagtaaaaataaaaagaccaaggtgaagtcagctcgaggagagttggaagaagtttcattcagtttgagagatgaagccacactaaaccagcagagtgggtcccaatcttttctgtacaatttcctgggggaggcttaaagaaatacatgtgagatcacaatcctgggggtggtgcacatgtctgagtattttacttttagctcttcaggtgagtctgacacacagccaaggttgaggacccatgtaagcaggcgggccagagtgctttttgtccgaggcatgtcctattctctggtccagccacacctgcagcactgaaacccaatgtctccaagcagctgacctttaaagggtccaattcttcttttaagaggaggctgtttgaagagatgtgaatagaacatgaataaggacagcgaaggtacaaatatgctaataaagcagatattccaaccagtttattgtatttttacacacacacacacatatacacaaaaataaataaataaataaaagctctatacccagtgatagcactagtgatgatgcacttttgtatttttaggatcatattattgagaaagatcaaataatatttcattaacatttatctactaatattaaaatgttaatgtatatttaacatttttacaacaactttactgaggtataaatcacaaaacatacaattaacccacttagagtatacaatagttttcattagtttcacagagttgtgcaactgtcactgcaatcaattttagaacattttcatccctccaaaaaagaatcctgtacctattagcagtcattctccatcaccgaccttcccccaaccctcagcaactattgatctattttctgtctctatggatttgcctatttgggacatttcatataaatggaattatgcaatatatggtcttttgttattccattatttcacttaggataatgtttccaaggtttacccatgttgcagcatatatcagcatttcattcctttctactgccaaataatatccattgttggaatatactacattttatttacccaatcatcagctgatgaacatttgagttgtttcgacttcttgactatttgaataatggtgccacaaaccttcctgtacatgtttttacgtggacatgggtttccatttttcttgggcatataccgaagagacttgctgtgtcatatagtaactctatgtttaaccttttgaggaactgacagttttccaaagtggctgtatcactttatatccccaccagcaacatatgagggttccaggtttttcacactcatgtcaatactcatgatctgtcttttttattatggcaatatttgtttttaaaaatggtatgtcttgatattttgtaatacatttagatatcttaaattttttaatatatattgttttactgatggttttgctttatgaattctgaactttccaatgaaagaaaacaactactgaagtcaatacatatttgagtatcaaagaccctaaactgtcatttttgctgtggttattgcaacaaataattggatttttttttctttttctttgagacagggtcttactctgttgcccacgctggagtgcagtggctcattgcagcctcaacctcctggcctggctcaagtgatcctcccacctcagccttctgagtactaggctacaggcacgtgtcaccacaactggttaatttttgtattttttgtagagatggagttttgccatgttgctcaggctggtctggaactcctgggctcaagcaattcacccgcctcaccctcccaaagtgacagggggtgtgagccaccatgtccagccagtaattgcattttctttatgacaaaattattttcagagcttagaactggataaaactttttctctacttgtatattccttctacaaaggaaagcagtcattgcttctttgcactgactggtagaaagcttaaaactaaaacttttcttggttggaaattcttgctaaattttaatttttattttcatcttttatcttgtaggtattttttgatacctctatattagtaaaagctaattcacatcccttctagtgggaaagagactataaagaagtaaagaaataaatatgtggtaagtacccttgatctgcacagcaatctcaaggcagtaattataaaggataaaactgaggatatgagaagttatttaccaaagtcagaagcttataagtggcaaaactggtattagaatacagatcttggagtccctcatttcagttctttatactctctcaacattccatcattctgtttaatacagacattttatggtatctgaaaagtatcccaaagtagctcctgcagaaccaacacttaaatgtaatagagtccctgtgataagatgttcaactgatattttatcccagtgattgagataactttaaatgttcctcaatagtccccacaatagcttagctctgtaaggaaaaaatgtgtttatttttcattgataattataattattataataatgtttttttttttttttgagacagagtcttgctctgtctcccaagctggagtgcagtggcatgatctcagttcactgcaacctctgcctcccgggttcaagtgattctcatgccccagcctcctgagtagctgggactataggcatgcacaaccactccaggctaactgtattttttgtatttttagtagagacaagttttgccatgttggccaggctggtctcaaactcctggactcaagtgatctgcctgccttggcctcccaaagtactaggattacaggtgtgagccaccacacctggcctataattattatttaaattattaattttctactaatgctgagaaagatggtataagacataaaaatctaatgtttgtctaatgatatgggtcaaggcacctaatattaatagttagctaaagaataggggaaaatatttacaaataattccaatgtagaatgatttatagaaagttactttatatttttccacattacattttaaagttacttaaaatatttttggctacatgaaatttatatattcttccttaaggaaagaaaataaacttttatagaagaagttacagaaatgcacttggtattcattactggtgatacataatagaatttaggtttagtgccagatatagggtgagaacaccattagctggaaactatacttacctctaggtgatttctataaatctgaagtccaatgatttcacttattaaagtggacaaataagttatatgttccggacctaggtgacagttacaaaaactatctaaaagacaaaaacagtctaaccatgaatgagaggattcaatacattttataaatgcctcaaaagaactcttttcttatcctcattctatctccacatctggacttgagtattgtgaacaattgcagtttggtctaaagaattagtccatcactatgaattaccacacatcacaaaatgacttaaatcaccagtgttaagtaagtggtaggaccttatgattgaataaatattggttttctagaattgtaaaaacctcagaaagtgtatagttttgcttcaatcattttacaggtgtgggaaataaacatgaggtgaagggacttgcccaagatctcctaagttcatggcagagtggagactacaaacaagtttatttaagattgaaggttgttctacgataccataatatttcaagtcaaaacttaaaatggacttgattttcggctttgtttaaacctgcaatttaaaaaactgagcaagatccagcccaaaatggcaaaaaggttttatgaatacacactttttgctaacagtcaactagaaaccaaatagaatagcaacgttactatcagagcagatcatgggtatattattgaaagcaagtgtaatgatgccagccttcagattccctaggatattttaaaactctcaagcacttctattacatagtttagggtcactggagaaaattacttttatgcagacaaaggaacacacgtctggaaaaggaactaaagaaaaatgtggcagttcttatctattttattccctgaagaaatgtgctgaccattaactttataacttgaatattataaatggaaaaaaaaaggaagaaatagaaatccatccagttctggaatcatggatggagttctggaagatggtttggtcttgtaatcttttttactggtcctctcttggcactcactgtcttctgcttagctggattatatcttccactgaaataaataagtgttaatcataatttttcagtcaccattatgtacaacaaaaacattataggccacacaggaagaaatgtatattgcaccttgttccccccaacagaccttcacacggaaaccttcctgtgaatagtttctgcttacagtgcaaatcttaggcagccttctgttatagcacatcatctccaccgctacagaggcatacagcttaagggcaggtaattcaaaggctggaagcagcatgtcaggtgccctaatgtggaaagttctgtctaatgaggataagacagatccgtgaattccttttcttagatttccatgagatcctttttccattaatgacttatgtggcactaaaaagccaacc

SEQ ID NO: 495 - DNA, 13377 bp, Homo sapiens
ctgaacagttttgctgtgatggccacaaatttgccagcctggatttacccaacctcccactgatctgaccccaccaccaccatcagcacgggcagcacatctacccagtgtcatctccaactcttctcatcgcccctgagtcctgtctctctacctcgcctctcatggggtgcccatccccactaccccagcactatttcatcaccatcccttaccaccacccctggccactccctagctgggtgcctgtcacttctttgaacctcagtttgacctgtgtatgggacagcaaccgtgtagtaacagtatctgctcaacagtgtctgtctgggggtgactgagaattcatgtaaagaggtgaacaccgtgtccggcacataagtgcccattcattcatccaatattcactgagaatcaacgcgaagccagaccagtgctagcaacttgggatacagcattggaaaggattggcagggtccctgctctcactggcctcggtttgggaggtgtggggaatagccaataaacaaacaaaggatatcaacacaatcacaacttgggatacctgttatgacaaaaataaacagagtgccgtggtgtgacccagcaaggagggtgggaggtagtaaggacaccacataccattttgcaggttgagcccttcatgagggggtccatttaggacaactgggaggaacagctggagtccagcccattcaggccacaaagccatgtgcctgccacaggtctgcgtgcatccaaagccaaagagcatcttggtctaacttgtctgcacaaaagggcatcattttctaattctcccaaggacgctgtttatgccagcagagaccctgggtgaagcctacatagggtgggctgggctccctgcctcttgactgcatcatccccagccctaaattggcttgttgggctgtctcaagaatgtcatctcagtgcttggaatgctctatgaacgcctgctgcctctagacaaagccgcctctccttcggggcactagatgccctccagtaacacctgcagttcccgtcgcctctcagtcttcaccactcaagcccagtcacgtggccaggccaccactctcccactctcctcctggaaggtccagtgcctgttcactccctacttcagtcctgccttccctgaccctctcccaccatgatgatgcccctgctctgtgcacaggtgcaattctgacttcttgctgcacttggcagacagatcttattaactgtcctcatctcctcctaggttgggggtcccccaggcctggcacatagtaggtgctcaacaaaagggatgggacatcctggttgctatgattggtgccctttggtctccgctgctgggagaaggaaaaagtcaactgtctttcatcatagctcctgccagttgcagctgggaggatgcccagaaggtgaagtgggaaaaccacagcagaatgggccagacctgggttcaaaagcatggtccaccacttaccactgagcgatcacgggctagtcacattgacttcctgcccctcagcttttctacctgtagattatcctcacaggagggtcatgagttagatgtgatgtatactaggcattcagtgcctagtaggcactcaaagaggagtaaagcacccatgataattatgtatattattaatgtaacaggacatacagcaatacacagtatttttaccaactggcaccagaattccttttaaagaataactgcaatcttttaaaagaaaagtgtttaaggttgcaaggttaggatctgagattatgggatagagaggtacaattatatagaatgagagagagaatttcttcagagcaaactaatttgttctgttaaggaagtgaacagttatttgaggatgggagagggatctagcaagggggcgaaaggggagaacaaagaggggagttggacagggtttagggaagtggctaaatagcagggtgggaggctggccccaaactgtgaaaaagccaaggaaccatttaagaacagagatctctaacagcaaagtataaagtgtgcgtctctaatgtaaatcccccctgctcctctgatcctcagtaaaaccttctatatcccagaaagcttcgtggtgggaggtctctgtgtgtgcctgtggatgtggatgtgtgtgttaagccagaagaacagatttaaagtctatgtctgaaccagggtgatagagaactagggtaatgaagacccacaaaagcaattcaaggcctttagagggtccacgcgaaaacacaagcccgtcccaggctctcaaccttggagagactgggggaggggggcgctgccgttcccactgcctgtgggatttccttctggtgaattccacctgaatctcccaagaacagactactatcttgaatggtgagtgttcaattaatttaaaaagcaattttgttttggcaccaggaaggactagtgctatgtgtctggaagaatgggatactcatgccctttcacacccatttgcccagaaccccaggggaggaggatggaggtgccctgcagactctatggcagccaccccctcacctgccaggggtagaccaccctcttggtgcaggtgcttttgtcacagccgaggaggctgtgcagggcatgggccacagcatagaccgcagagtacacgctgtagacgacacgctccccagagagcctgagaatggtgttgaaggacaaggtggcgttcaggcagttgtcgcactcctggttgcaggtatagctctggctggtcctgctgaggggtggcggcccagcctgtgggccccactcgcggaactcactgaagcccgggatgggcacgctctggatggtgatgcccaggaaggtgcccaagtggcgcagctccgtgaggttgtgcaggaccgggtcgatggcccaggactcggaggcgatccacacggcgccagtgaagttctggcgcagcacctcattgaagaagtggtacagggtcaggtcgggcgagaacacgaccacgacgcgcgctgtgctctgctgcagcttgtccacaatggtcaccaggcgctggcgctcctctgacgtcatgttctggttgggctgcagtgtgggcagcgtctcctggaaggcgatgcagatgtcgcgccgggccacgcgctcgccaagcagctggccattgtcgcggccataggtgtcgctgctcaccagcacaatgatccagttccagcggaagtgcagcatcagctgcaccatggcctcgatgtggtggtcggcgctgggtgtggtacgcagcaaagccgggaagcgcaccttgtctcgcagctcatcgctgatggcgctgtaggtgatctgcaaggggaagggctgtggcatgagcgagtgccccgctgggtgctctgcccccaccccagggctctatccaccatcatcatctgggaagcacctagtgcaagccaccccaggggtaggtggtttacaccatcgtcaatcatcatggtccccaggtagccccatgcaataagaacctactgtgtgccaggccctaggccaggtgccttatctcagtcttatcacgattattgagcacctactgtgtaccacaccctgggccaagccacatacaccatcatcctcatggtcatcagcacactggcttttattgagaaccacatcctgggctaggtgaatgacatagccatcatccccatcatctagaaactcttactaagcacagcgctttcctcctccccctcatcaccgtcaggctcatcaactagccacatttcttccctccacctccagggctccatggtttccttcccaactcactgggagttccatctcctttcctggttccttctcttctctatgacctcttaaccttggaggaccctgggctcaggcctcagtccctgccttttctccagctgctctccccctcccttggtggtcccatccagcctcatggcttaatatcccatttccacgtcaacaactcccagtggatagccctggccgggacttctctcctgaacttcagatgcataccacaactgcctgcctgacatctcaaacttcacagatcgaaactgaaccctgttctcctctgagcctgctccatccacaccctcccccatcttggctggtgatgaatccatcattccagtgactcagggcaaaaactctggagtcgtccttgactcttctttcgcacacaggtcacactggatccatcagcaaatcctcttggctctacctttaaaatgtatccatccagtgcctaccagctccccactccctcctgtccagccaccatcatccccggcctgcactgcaacattacccatccacctttcccctatagtctatgcttaacatggcagcccagtgaccctgctcacacacatgtcaggtcactttactcctcttctcagaactcctcaacagctcctaacgtcacccaggaaaagccagtccttgaatggcccctaagggctccgtcatttatctgcacaactctcgcctgtctgatttcatctccttctcctctccctctggttccagttctgctcatctagttccgcaaacataccaggcacctcctggccttggcacttgctaacccctcttcttggaatgttcttctgctaggtccctcatggctccctcactccttcacctccctcaagtcttcgcccaattgtcagtgacacccacctgaccaccctgttgaaaattgcaatctccttctaccaactcctcctttccactgacatgccagacacccccaccctgcccacatttttattttattcattgcacttctcacctctaacatcctgcatcacctattattgtttacatttattttctgtctctctccactagaagagaaactccatgagggcgatgatttctaagttgttgccagctgtatcccagcacctacaacagtacctggcacatagtaggtgctcaataaatatctgttacatgaatgaaagaatgaattcagtcctcagctagatgcttcatgtaaaagtactaacattaaacagtaacaatcacaatatttgtgactacctactgtgtgccaagtcttttgctagctgatctttaatgaatatatagcctgtaccagtactgcacttggcactttcaatcatgattatgataatagttataataatagtagtaatacaaatcacccttttgtgaggacctactacgaggcagaccttgtgctaggcagctgtacagaataatactaagcacttcaagtttttattcctgtgcaagatgctttataaaacaacattatttactacctactgtgtgccagaaatttacacaggttgaacactaaccttcagacagtcctgggatggaacgcttatcatcccactttacaggtgaggaaactgaggctagaagagtcaagagatttgccaaaggcttcactgtggccaaggctcggtgccaagttgcacaaccagatctgcccgcttccaaagcctgagcccttactccataagctgggctaccttctcaagatttgggctgatgtcctgaccctgcttctggtcctatcatcacctcccatgattgatggaggaagtggcttctgaggcctctagacagccattcctctgcccccctccccaggtccttctccagggcccaggggcctcacctgtggaaggagaaatagggagaggaagttggccacagtcatgacagactcggagttgtcagggccaatgacagccaccacacgggaaatgtagttactgtagtcctcttggatgggaaggaggttgtcctcgtgtgccaggaagtagagcaccggctggacattgttggagatgtagcacacatccacgatctcatagcccagcagcacaccaggcagcaggctgctgtcattgttgatctcctccaccgcaaagcgcatggcctgcatgaggttgtagcctatcaccttcacttcatacctggaggggccacagcatcatgaggtggaagcagatccagaatgaggaaggaagagataagagaaccagcccactcctccttcctgccacaggaaagccaaggcattgactgagaagagccactccagaagactcgggcattttcaccatgtcattgtcaccataccacatctctagggtcaccattgcccatatggccaccactgatactgttatccatgtggccatcatcactactatccctataacctccatcaccactctaccaatgtccaccaatgtgaccatcattatccactaagacttccatcaccaccatcaccactatcaccatcatcacccactacccatattaccaatatcaccaccagggccatcactgtcaccacaaccttgtgaccatcatcaccaccatcatcaccgtcaccaccatcactatcagcacgaccattatcacagccatcatcaccaccatcaccaccaccatttccaccatcaccaccaccaacatcatcatcactaccatcaccaacgccatcagtaacaccctcaccaccatcaccatcatcagcaccatcattatcagcatcaccatcatcaccacccccatcaccatcatcactaccatcaccaacgtcatcactaacaccatcagcaccatcatcagcatcactacgatcaccaccatcaccaacaccatcactaacaccatcaccagcatcactaccatcgccatcatcaccaacaccatcaccaccatcagcaccatcttcagcatcactatcatcaccaccaacaccatcatcactaccatcaccatcatcaccaacactatcgttaaaaccatcaccatcatcaacgcaaccatcaccattatcactaccagcaccatcactgccaacactattaccaccactgccatcatcatcactaccatcaccatcatcaccaccattaccactatcatcatcatcatcaccatcatactttttatcattgtcatcatcaccagtattactgttatcaacattatcagcatcaccaccattactttcatcacaactatcaccatcattatacaccccaccatgatcacaagcattagaaaacccagcatcatgcctggtgccatcaccttcaccattctcaagccagcatataatcttccccagtgtcataaatgatgcatttctcatactcaacccttaatcatcttttgcactgttcttcctttctccttgtctcccgcaataccttcaccctctctgcaagaggtcactcttttttagtcccaggctggctccatgtccttcgtgcttgcatgcagatgcacacagcccccacaatctccaagtgatgctgccaccccaaggggctcagggaggaggtgggggaagaggaacttccctctcggcccaaaagcacccctacccaccacagaacctgctacagaaaaatcacattctgcctcccaaaggttttcagaatgggctttgacatggacccattgggagtcccccagttgccaaagtgggtgggagcagtcttgatggcctctaagagccctctaggctcaaacattctgtaactctatttaaaaaaaatggcactgagatgaccccagtctcagtgtttcagagcacagtcgccaaagattttggtaacccatattatacggggcctccctgaggactaggggcatggatccagaataagggggttggcaatgaatggggaggagtgctttaagcccttggtcctggtctggctcccaaggacccacaggaccaggcctggcctcccaccccatccccactgccacttccagccccacactggagactcactccttgcacatgggcacctgcaggaagttaaggtgaacaatgcccttcatgttggcatggagggagaagaggccacccaggaggtaatccccaggcaggtagaagtccgagttctcagccggctcagccaggacccataggaggaagaacagggaggagatggtctttgccctgggccccatggctgggaagtgatggtctcaggaggtagtcctgcctcactggagaattggcagcttgacaccagggtatttgcacagacatttacatagcgatggtcctgccaccgactgtggggcacctggagcaggtggagaggtttgggggcccagagggaggaaaggagggtggaattatgatgattctttcttagagcatagaggggctaggtggtctaggggaaccctatttggaaagagagagcatcctgataacttggccatgccctggccttctgccacttgtccaaggacaagtctcatcttcctgacatttcaaatatttcaggagtaaaggacataagtgctgtcaggaaacagagtactgtggccaaaagagcccaagctctggagtccagccaagttaggccaggcatgtagtgatgtataggtgtggagaaagtggtagccattgtcaataagaaccaggcatcatgctggtgtcgcggttcatcatctcatataatggttgcagtaaccgggactattactaaccccatttcaaagatgaagaaatggaggcactgagaaattaagaaatccagcccaggcttcctgactagcagagctgagattcaaaccacatggtctgactccggggctgggtccttcatcgctacatcacattacatcacaaaattagtgcttttgataaaaaaaaaaaaaaaaaaaaaacccagcggtgtcaaagagggtgggggaaggagggaagggaggggtggtctcactccctctgaaggctgccatcagtcagcctagcaacacccactctgggtccccgaccccttggaccccacaccaaagggcagggttgttggcaaaacagaaagttgaaaattcctaaattcaaaggtgaatacgcccaaggagtcagaagcggggaggtggctccagtgaattagggacccatttgaatcagagacccctgtccatttagtgctgttttgctcctttccaggcctaccaacatgtggccgagccctagggaacctgccacacaccacatggctggaatgggtctgtcacaggcacatacccggctgctgcgctccatggttctgatgggcagaggcttcaaggtagaaaaaggtgatcaaaaaccccatgatcggctgggcacggtggcttacgcctgtaatcccagcactttgggaggccgagacaggaagatcatctgagctcaagagtttgagaccaccttgggcaacgtggtgaaacccggtctctactaaaaatacaaaaaattagctgggtatggtggcacacactgtaatcccagctactcgagaggctgaggcacaagaatcgagaatcgcttgagcctaggaggcagaggttgcagtgagctgaggtcatgccactgcactccagcttgggctacagagtgagactccatctcaaaaaataaaaaataaaaacaaataaaaacatgctctctcctgccccaccccagccaagccctgctcctccttcagggcccagtctgagcttctcctcctcctaggaaccactcctgcccccagttcaagggaacctccccggctctgagcagcaacaagcctcctgtctgcgtcatcgctgggcactggctaccagccttacaccgttaaccggatcctgctgcgtgtgtccactctacttgaggacccttgaaaccacgtgacgtggacccacctggatttgacatcagctgtttgctggatgagcatgggcaggttccttaatctctctgaggctctgtttcttccccgttgaaacaaggataacaatttcagcctcatggacttggtgtgggaattaagttaaataaaactggggggtgtggagcaggcttggagaaaggtgagtttgccaaagtgcgaggttgtttctttttacaacgaaatcaactgccgcagggggcaccgtgggctccatgaccagctgaaattgcccctttgtgtcccaaagcctctcgaagttaccctgaaggatgttggatgtctttagctactgcagagccgaagtggcgcctcctcccctgcccctgacctctcctgggacggggtcatcccgtgggcctgtaagccaacaaggggaggcctcctggtgctgcaggaagaggcagaattggctgtgtgatctgggcttgtccctgcccctctctgggcctgtgtaaaccagtggattggaggtggggactcataaaataaaaggaagcgccctgcaaggggtgtttggaggtgtgggttctgggcctgactctcctctctctgggtctcagtcccctcatctgtacagtggggagcccctctttgcactgcccgtgtctgcctccatgtcagctggcccaaaaccccagcactgacccgtcaccactgccccatgggttctctccatgccctcccactttccacgccacaacccccgcagaccctcatcaccccctttctgcacctctccatctgccccacactgactgtttaaaaccccaaaccacagctgtcagctaatcactcctctgctctaatacccgccggggctccccgtcaccagctggatcaagtctgagctccttgtcctggcatttgaggcctccccagcccagccccagctcactcatcctccctttcctggcctttccagcctggtctctcctgcaccacgtgccacaaaccacagccacactggcctccttgggtctgggtccctggaggatcttcctggggtggcattctaggggcctccgagaccatagacgcccgccctgccaaatacctaggggtttatgagtgggttgtaacaacaaatagcgcctttcccagagtgtgatgtattgtttctgttttttagagacagggtctcactctgtcacccaggctggagtgcagtggcatgatgaaaactcactgcagtcttgaccttctgggctcaagtgatcctcccacctcagcctcctgagtagctagggctacaggcacgtgccaccacacccagctaagtttttttaattttttgtagagatggagtctctttatgttgcccagaatggtcatgaactcctggcctcaagaggttctccctcctctgcctgctaaagtgctgggatgacaggtgtaaatcaccacgcctggtgtgtattaaatccacccagagtctattaaacaccaggcattgtgccaagcattttatatacattatcatttaattcttacaactccccttcaaagtagccatttttactaccattttgaagatgaggaaactgaggctcaaagaggctaagcaactttccagaagtcacaaagctactaggtggtgaagccagaatgtaaatccacgctgcccaagctcttagcccctgtgctaagtgtgttctgcctacagaagctgtcactgcacctcctgccatgggggttctgggatggccctgccctccctcaactcaggtcccaccccagctgttggggaaggattcgttcctggtacagccacaagaaggcacatatgactgcacatgtcagttctgaattggggaataaagaggccaggaggcactgggatgtcctgaagacttctagaaaaggcacattatttggcaaagcttaggggtgggggtatgccagagagagagagagagcatctaagttaactgggaagcccaggatgtagccctgatctcagggcacgcccctccctgcccctgaccacccctggggcagggccatcctgtgggcctttaagtcaagatggggaggcctcctggtgctgcaggaagaggcagaattggctgtgtgatcagggcctgtccctgcccctctttgggtaaaccactggatgggaggtggggactcataaaacaaaaggaagcaccttgcgtggggtgttgggacgtgtgggctctgggcctgactctcccttctctgggtctcagtttcctcatctatagagtggggaggccctctttgccctctttgcactgtcttcatctgcctccatgtcagtcggcccaaagccccagtctcagggtttgggacggggagggtggtagaaaacaagaatggttaagcaagctgtttatccagtgggcaccagctgagcccactgtgtgacagggtttaccatccggagacagaaaccagggcccgggtgagggcagtgcacactggaagacaccggggaaccaggcccatccgcagtgtgatgtactgtgtcagagctgagagagcctacggagacccacaaacccacccagtatacagatagggaaactgaggcctggaaaggggcagtcacccaagtccagaaaggcatattgactttcaggaccaagttctttctggaccaagtccagaaaggcagatttctttcaggaacaaggggctaaggctgggatttgagacctctgctctaataaagtcaatcaaaagtacatcaggacggtgtgtgatgccaccgggatagagtaaagaggaaggaaggcaccgaccagccaagagctccttggggaaggcagggtctgtgccttgaaacatgggacaatgatggtgatagtgagcacgagtgatttatgttgttaacgtgatttgagtgctcactctccaccaggtgctgcgctgagcccttgttatgctccgccattctgttttattctacctcttttttttttttttttttgagatggagtcttgctctgacacccaggctggagtgcagtgacgcgatctcggctcactgcaacccccacctcccggttcaagcgatttccatgcctcaacctcccgggtagctgggattacaggcatgtgccaccatgtctggctgatttttgtatttttaggagagatggggtttcgccatattggtcaggctggtctcaaactcctgacctcaggtgatccacacaccttggcctctcaaagtgctgggaatacaggagtgagccactgcgcctggcctattctaccttttaaggtgctactatgtcctcattttgcagaagaggaaattgaggttcagcgaggaccagtaacttattcaaaagcacatagcaagtatgtggattggaacaacccagcaccctaatgggggctaatgggagtggtagagatgcaggggctccaacgaggaagaaataatgggggtcccattgacagggagagctttttttagagtgggctgccagtatggatagatgatgtccctgaagaccgaaatctgaaggcacactggacagagagccaaaatcctggtccagctctgccccaacttgcgatgctgcccttgaacaagtcacttccattctctgggcctcatcctcccatctgtaaaatgga

SEQ ID NO: 496 - DNA, 13738 bp, Homo sapiens
aggcaaagcaggagaagaaaggtcaaaggccaaattccagatgtcttggctgggcctacttgcaagtggaaggaggcctgagccagcatgagggatggagaaggcaggaaggggcacctctggcctctgtgaggctaagcgtctggtggattgggaatgagacttggagaggtatctggttgctcagttcgggagggtgcccagcactcagcagcctccccaaggttgtgtgaggtaaggttgaggctgcccaagaactgttttatctagtgaggctggaggatgtagcgggcatagcatcagggatctgggtttaaggggctggagaggggttggttggggtcttgttcttcctgctagtctttcagcctagcagagagaagatgctaattgatacaataaatgcttggaggatgggtgggtggatatatggatggatggatgcatggatggatggaggcatgcatgagtggatggactgatggacggatggatgaatgcatgcatggataatgaatgagtggggtggctggctgggtggatacatggatgttgatctggggtgggtgtgtgggtggatggatgcatggatgggtgaatgcatgggtgtgtgggtgggtggatacatgagtagatgggtagatggatgaatgcatgtatgcacagatgtatgagtgggtagaaggatgcttgggcagaagatggatggatgggtggatggatggatggatagatgtatgcatgcatagggctgtatgtggctggacagatgcatgggtgggtggctggacagatgcatgggtgggtggatgagtgggcagaggcatgcatagatgatgcatgggtgcgtggtgggtagatgcatgagtagatgggcaaatggatggatgcatgggtgggtgggtggatggatgcatgcatgcatgtatgaaggcatgggtgggtggatgcatgggtggatagatggatggatgcatgggtgggagagtgaatagatggatggatgcatggatgcatgggtgggtgggaggatgtttacgtggagaataggtggatgggtggttgggtggacgggaggctaaatggaaggatgtagaaatgagtaagtggatggatggatagatgggtaggtgggcaggtgtgtggatgagaagattttgagatgcatgtttggatatagggccacaggcagaagtgggaggtcctgagtcataactagcagccaccatgatgaatgacatgctcagaacagaactccgcggctctgcagaagtgcagcccaggacaggacaacttagactaccactggcagggatcaggtgtgatgcttctcgtggtaccaaacagcctgttttctgctgggttctgaggccaacatgtctccctggctgagggtagggacgatgtaccttccaagctcaggaggccaggctcagctcacatcaggggtcaggaggctggggttccctgctctgatcatggcccatatgaggggagctcatctgaagaacagcatgaacacagaggcccatggcctgagaaggagccttgtcttgcagctactgggacaggcaagaagcagatggtggttttggatgccatgtgtgggcctgtgggggtgagggtgagggcggcctgaagaagggctggcccagagagggcccagtggaacagccagggtggggtatcgagtgtgattaggggacgccccccaggcaggcgtcctggacggccttggcacgccaggccgctgagccagcacattgctttgtgtacaaatcacctccttttctccttttcttctgttcccatcccccacctccctccacgcctaaattcttcccaaaccaccccagccttcggactgtcaggaggaagctttgatgtgtggtgggtgggaggccactggtcttgggtgggcgctggggggtccctgccacccaagtccaggcatctaccccaggcaggagttggggagggaagggagcgactgcagcctcctgctcctcccccccaacctgtgtgcttctggatgggagatccctgccggaaggggaggcagtggtgctggggagtgggccgggtgggaggaataggcttggggaagggggacccaggaaaagtgtggtccagaccaggcctagcccctgagggtaaaggatcttgccgaccgaagggggctgagggttgggggtgtatttaccatggtgagaggccatgttcgtgttcctggatgcttgcatgtgtgcatgtgtgtgtgcacgtgcatgtgtgtgtgcatgtgtgtgtgcgtgtgcatgtgtgtgcttgcaaaggcctgggactgctgtgagtgtacagctgggtgatgtgcgtgtgtccccgcgagtccacacctgtgcccacagctgtgagggagcagcatatggctgcccccagattgtccaacctgggcccagctgggaccccacttccctctcgtggcagaagcctgacctgaacatctggccccatctgcccacaagaaagggagtcccagagcacgtgtcagagctagaagggcccaggcctcctgccccagtgtaggagcagcccttctcagggtcacaggttcctcacctgtgcaaggggtgcctgtggagtggacactgtggtccccgtggtgtctgccagaggcctaccacccagggcaaccaactcgtccaggtttgctgaccactttcttggtttcagcactgaaagtcccatgtcctgggacaccctcaacacccctgccaatcccaggaaatcgagatggctggtcccacttgccagggacacttctctttccaccacatccttccccctgctacccctgtccctgcctccccccaccccatctctggaaccttctctgaaggttcttactttcccctttgcttcctgtcttgtgccctcttcctcctgccccttactgtccccagggtctcactccgtctctctctggctgcaggggtctctttctctctgctcccctctcttccctctctgtctctggagtctctgtctctctcctctcctgccctcaggatcgtcccctgcttggtttctggggtctgtctctccattctctgctcactttggtctccccctccaccaccggtgtctccctgtctctgtctcagggtctctggctcgccaccttccctgggtggtccagacctccctcttgtctgctggcaccacactcccacggggctggctggggtggaagccaggtctgggggctgtgaccaggccgggaaggggaacccaagcagacatggtatttatgttaggacttcaaagtggggcagaggccgcagtgggggtggaggggtggagggcggagggtggagggagggagggaggtgctagcagaagccagactaaggtcagcaccggcccctcccagctgagggtctccttggtgacacacacctccctgtgggaccctgagactcggcgtagggacagaatggactatttttgtgcagagttccaagaaaggcacttcctgcacccccgccctgcccccagccccatcctttcttcctgtcaccctgcagctgggtctgggcgctgcaggccccacctcctctgagcatcagcctggcctgggagacaggggttctgagggtggcagaagcacagggctcgatctcagcaggaaaacatccctggcatggggacagcccgtgcgttcccggctctctggcagaggcctcgcctggcagggctgtgcggggctgtaacccagttggccccaacccagccaggcggacccagccctttggggcctctgagctgtcagcctgagggcctgaggggccaaaatgggccaagagggtcaccacacccctgcccccacccttggcctaacccctgctaaagacacccagctgctaggacctggaaggcgtggggtcaggggccctggccctgggtggggtgggtgggaagggccgattgtctcatcctgcggctcagctgagccccgagcccctcccaggggctgcgtccagcaggcacccttcaggctgggccaccccctcaggaagtcctctgcccccagactcaaggctcgctctggacccaggaccctctggtccaaagcccattcaggccccaaatgccccagcccctgggccagtgtctcctccagggtcctccccaggctcttcctgtgaatcactcaggctggaatctgatgagctcaggcctccccacccagcgttgcctgcctctgcctcctgcctggctagtggggtcaccacacccctcatgggggtcttttccagcaacccacatctcccaccagggtctagcatgggctggggtgggtgagtggtggtgggacaggacagggctggagtgaggagactcgggagagggcttggaccgcttctgtgtgctccaaagtataaaagtctgtgtgtgtctgtgtgtgtgtgtctgtgtgtctatgtgtgtgtgtgtctgtctttgtgtgtctgtgtgtctgtgtgtgtgtctctgtgtgtctatgtgtgtctgtgtgtgtgtgtctctgtgtgtctgtgtgtgtatgtctctgtgagtttctgtgtgtgtctttgtgagtgtgtctctgtgtgtgtttgcacttcaaatgcttggagagtgggaaggggcagccgtgtgctgtgtctcgggagagtgtgcgccgttgcgtctgagtgggggatggagtgtgccggtggcagttctgcacaggtaggtctagtgcatcatgggatcccagtgtaggtggtcaccatgtgtctctgtgtcagcctgtccccatgtgtgtgtccaggagtcacactctgaacccaagaacaagggtgctgaaatatttcagtgtttgcagatccagggatgtctgagtgggtggctggtctgtgtcagggtgtgtctgggaggaggggcgccagtgtgtccctgcaccccatcccgcaggagtgaatggctgacagtgtcagggtgtgcctgttaaccctgggggtgccccagggttgttgcacgtgcccgtggctggcaggatgtgcaccctgtgtgggaatgtgggtcagacagtgtcactgtgtgttaattgtgggtgtgaacatgggttgcaaggccatggcagggtgctagatgctctgtgttgaaggtgtggcagggtagggtgggtctcaatgactgccttctgctgcaaccctttcaggccaccagtaggcccctggttcctagagcacactggcccacagaaccagggatatgcagcccttccctcaccccccattcgcagggtcccagggacccaccactgggtgctttcctcctagcagcaggctgggagcactgagtcccctgggtcctccgcctcagcagaggggaccctgcacgtggccaggaatgaggtgcgctctgccccctggtggcagcaatgaaggatgcgccaccctgcaacccaggaaagcggagggacagtttaggctgcgtctttccgaatcagtcattccacatagattcacaagtgccagttccggcccggccattgttcaaggcccttgagatttaactgcgaacaaggtgggggtggctctggcattctagtgagggaaacagacaataaacttgcatacagaaccaccgtgactttaggagtgataaggtcaatgcttccaagtaaggaaatgacccgactgctctttcatagatccaaacgtcagagttccagtcttgccctgcagcagcggacgctgggccaggcatgtcacctcttggagccttggcttctttttccataaggacaaaggctggggaaggggtggcatggaatccctaggacacagtgagctttcagttaccacccagatcacgccatgcaaatggagagatgtgacctatttccctttggctggagctgggggcgcttggtgcttggtctataacagacacttctgttgttgttgttgttgtttgatttttttttttggagtcttgctctgtcgcccaggctggaatgcagtggtgtgatctcagctcactgcaacctccacctcccaggttcaagcaattctccagtctcagcctcccaagtagctggaactacaggcgtgagccaccttgcccagctaacttctatatttttagtagagatggggtttcaccatgttggctaggctggtcttgaactcctgacctcaggtgatctgcctacctcggcctcccagagtgctaggattacaggcctgagccaccttgcccggcctataacagatgtttgatagatgtgctgagtggacatataaatcagcccctctgctttgaaggactacagaacctggtgtctgagccctttgtcctgtaacaaggcactttccctgagcaagtctgagttttctcatctgtaaaatggggctagtgagactggtcttacactggcctatcattgtctgccttgcctggaggctctgccccaggatcataatcttgttgatgctgatttggcctggacccctgaccaatcagtttcttttttgttttcttttcatttcttttttttttttgagatggagtcttgctctgttgcccagggtggagtgcagtggtgtgatctcgggtcactgcaacctctgcctcccgggttcaagtgattctcttgcctcagcctccccagtagctgggactacaggtgtgtgccacgacgcctggctaatttttgtatttttagtagagacggggtttcaccatgctggccaggctggtcttgaactcctgacctcaggtgatccaccggcctcggcctcccaaagtgttgggattacaggcgtgagccaccaggcccagcccagagtttcttgagaagaaaaaccacaagacccaggcagcagctccctgtggtgccccatcactggggagggcagggagggggtcaggtcatgctgagcctggcaagggtgggaagggcttgtagaggccccagagcctcattcccatgaggccagttgtacatccggcccctgggatcctccgagcaccctctacaaacattccaggtccttcctctgggactgagcttgacacatcccgtgtttgattcccagaaccgagtcctcccttatactccccaggtttctgcctcactgtccctcactcctggttatcaaactccaatcagtgaacaacatttattgaacacctatggcatttgtgctcagcattggactgtgtgaggcactaggggtgagtggtgaaacagggaggggaatagaagagccaacgggacacttcctatcagcgagaaccttgggagggcgtggaagtggggagggaagagctgctggtggcctagtgacaaaaaaaatgggagccgtgcaactgggctgtatctggactgctcatctgaaagtcaatgtctggctgggtgtggtagctcacgcctgtaatcccagtactttgggaggccaaggcgggcggatcacctgaggtcgggagtttgagaccagcctggccaacatggggaaaccccgtctctactagtaacacaaaaattagccaggtgtggtggtgcacacctgtagtcccagctactcgggaggctgaggcaggagaatcacttgaactgggaggcgaaggttgctgtgagccgagatggcaccactgcactttagccagagcgacagagcaaaactccatctcaaacaaacaaacaaacaaaaaaacccaaaaagccaatgtccacgatttctacctcccagttgtcatgtctgacatttgggctgacgtcccctctgtgctcagtgcccgaggagagagcctctggggtcatcctccataaggggacaattccttccttcctggggatggcccccaagaggctggccttacccagaccccagaatctaagggacctgggggccagtggccttggcccctgcgctgtccccaggttgcctgatgctgctggactgcaaggcccgggaccccctctgctgctgcagccttggaggcgccctcacccctgggtggtcaccctctcggcagattcccgggccgtgcacaccccctcgtggttggtggtcggcacttttccttgtttggatttgctgcctgctctgggcttccttgggggctgccccggcctttgtgggtggcttagaatggagggtggagttggaacctgatgccctggtttgggcgggggaacccttaaggacttgctatatgacatcctgggagtcactttcctgaccctcagtgggcccaacaagtcatggccaagtaaagcttttgtgagggccaagagtttagtgcagagagcatggtttctgagccccctctccattctggaagcttatctgccagctggtggatctccccagagatgctggagggcctgggaggactccaaatcttggggagagactgtaacttgggtactttctccccagggcctgatttccaggggaataacctccctgaactgggcatcagcaggtgggagccctgtctggcagagagcggactccgggagagagttagcagcccagctctctccctccctttctgccatgagctctgcttgtagcaaaatcacccattttgatcactgggacacttctgggagccgagcagggcagcaatagtgtccccactttacagatgagagtactgaggcttgcaggtgcaggtccttctggtgtccaggacaggggtgggccccaagcctttgctgctgttctgtggcctctctaaatcctcctgacacctaagagccattggaaccttttagggtctggaagtcccagcctggtgggagatacttgggtggagccctgcctcagccatgcccatgaggggaagggtaaaaggagctgagaccgtcaccctccccacgtcagaggttgggcatctgtcggattcgcccccacttggcacaccctcattgcaggctggctcaccctcagctgggggagaagaacaagaggcaaggggccttgggcacacagtctgggggcccccgaagccccctcatctttattccagttcctcagatgtggcagttcccccagcttccctggaaacaagtatcagacaaaggtggtggcagacacaggacagggccctgggtggggcttgctggcgctaaaaggatttctcagcaggctcagggtctcccgccccgaatgacccttctggccacttcaagctactcctctgctgcccggcttccctctgcctctggttcccctggctgagcagggccttcctgggcttgaccctggcccccttcagcagttgtctcagactgttcccgaatgtccctggggctggctttgaccccagcatccccatctccctggcacccttgctcctcccctctgcttcttgcctctgactgcccactgccctcctcctctgtcacagccccctgggtctcaggccactccgcccggcggtagacgaggtagccagtggtgggcagcctgtgggccagggccccagggggcaggcggtggtagccctgctccttgtacaggaagaggccaaaagtgttgggctgggtcactcggaacttggtggcacagagctggttcagggtggcaatcgaggcttctgggggcacggccagggtcttggaggtgcagccactgctgggatcctgataggctactcggaggaggtgctatgcaggaggagaagcaaaaacaagtactcagccccggctggcatgcatctggctccaaagctgagacatcagctttctgggctgtgcagggacagggtgggtaggtggagatccagtgggagaaccaagcggcaaaagctctatgtgctccaggggtcggcttgtgggccacagccgcaggtgcaaggacagcccagtggggcgctcacaagcctgagatgaagatttgatagtgagtaatttgtgccccaagcactctcctgcattaactcatttaatcttcacctcaaccccaggaggtaggtcctattaccccattttactgatgagaaaactgaggcacgaagtagttaagtaactcgcccaagtccccacaacccagtggcagagccaggattagaacccaggatctgtctacagagtctggactcttcaccaaggacaggaaggtgaaaggcggggatggcgtctggctctgaggacacggtggagggcctgttacctggaagcagtgggtggcaggcaggcggcgctgctcccagaggctgagggagcgccgtagctcctgcacggggctcagtgggagggtgtgggcctgacccaggccactcagcagggccaggctggcagagaggctggtcaggtagtagccacctgggacacagggtggaagaacacggctcaggctgggtgtggggcaccccatcccctctccccttccctgcttattcagggcccacccagacagggaggtgggtgggggtccctcaccctctccagtaagcaggctgggctccagcagctccgacatgtactcggcctccagcagcagctcaggaaggtcacagtgggccaagacgaggctcagcagaggcaggaactcgtcggcacccgcgccctcccctgtggggacatggtgagaggaagaagcttcaggtacagtccttgctttaggcagtgacccctccccatgccctagcaaccattgaggggcttcagaaaggatgcgctcctctctaggcctcagtttcgccatctgcaagaggggagggtgggctcattctctcctgcagggctgttctagggtcctggggacctgccgctggggggcccgcctctgactcaaaggggcagggcagggtgaggtggtggcagggacataccttcctgggtcctcagggccatgtagagcagcttgcaggcctgcaggagccgcttgacctgggcgctgggtgagtaggtgcggagcagctgcagcagcttctggcgcacttgctccaactctactggggagggcaggctcaggtgggacccgaaggctccggggccctgggcccgggccaggcggaggccctcagctaggcggcccagggagccgtctgcggcaagccggcgccgcaggcgggctgccaggatgggccggagaggcttgagcacagagcaatgcaatgacttctccaggacatgttctgccggagggacagggaggggtcaggggaagactgggggtatggggggcagaggcaaggggagaagggagcaggggtagaatcggggaggagaggcaaggaaagcaggaggaggtagcctgggtgagacggaagagttgggggagagaggggatggaactctctcgaacagtggtaagacaagatggatttgtaaagcagcagaacagaatcagacaggctggcgctgtggaggggagcagagggtcggatggggcagtgctggagctatggagagacggagcctcacccagcctcttaggcgacagcagcttctcagggcccagctccgcactcagcatggcccgggcccggctcagcgcctgacggatgccctgcagctcctggggctcgggcccagcccgcacctgggtcagtaggtcctgcaccagctggcccgcggctgtgtgtcggtcctgcatcagtgctgccgcagcccggcccacctgccgctccggtgccagtagggagcagaaggcggcgctcatggaccgaagcagaggtcgtcggcggcccaggtggggtgaggtcgctgggctcccccgggaccctggcaccccctcctcctcggagctgctgggggagccgcagtccacctcttggagggagggcataggcggaaggctagggccactgcctgctggcacgcggtaccccactgagctctccctccgtagcagctggcaagggggcagccgctctgtctggctggggactgcccctggcagcacggggacggggggaggtggcacggcaggtggagacagggggctggaggtctctgtggacacgcgcactttgaagcttctcttgaatttctcccgcttggtgggccctaggtcccccgggaacagggggttgaagaagcacaaggcggctccggtgccctggtccagctcttgaggggaccgggccttcagctggggcaacactgggcctccagccgggccccgctgagccttgatgttgagggaggagctccagaactctagggaacaagaaaccgactggggcctccgggactggttaggggaagtttcccaaccaaggcaaggcaggggcttcgggcggtgtgctgcgagccttgccttcccctcggcctcagcttgttcatctgtgcaatgggtggcaggaagcccttaccaatgcccagatgggagatggcctccagctctttgtgagtggctgcgtggtggatggctctggggagctgcagcgggaggagaaggatgtccctgaggccagagaggggagcagaagggagtgagggccgaagagggcgggaaggatgggctgtcccaaggagcagggcccgtggacaccaggcaccctgcgggcagactcaccgggtgtggcagtaggcacagatgagctggactaggtctgggaacatgagctccgagccctccaaggagacgcctgagagaggagggaagtgaggtgcttctctggggaacctccctgcttccagccccttcccgccaggccagcccctcaccgccagggctctccaggatgtagtggctggagacgaaggaggggccactggcttcaggcaaccgcatgcacagggcctggcactggcgggtgttagatttccgcacgaggaacgtctgcaagtggatagggctcaggcagctcaggaccttggcgtcccatccctctccctcccacccctggctggccagtccctggagtgtggggcaagactcacccccgggggctcggtcctcagcatgtgcagtgcggccgctgcgttggcttgcagctgcagccacacgggccgggtgagcagcaggcgctcccgcaggctcacaacgcgccccggccgctgcggcccgcctgcctgcccgccgctggcattgggcacgtcatacagtgggtcctgggctggcctgggggcaggcacccagatctgagcagggagccaggggctgggacccttgctctcctcttccccactcccgggtttcccactttctctatccccggataggccctcctctcgcagcccctccctgccccacctggctgccctgccaacttcactaacttttctctcgccaggtgcccagtagtgaagctggacgggctgggggctccaggagagcccgcgcctgactctccagggctttccatggctgggagctccttcgcttcaggaagagaatccagtcccaaggcaaggcacgcacatccccagtgagtaacacttcctgagggcggtccgcctgtcacacccgccagttaactcttgtgtgtccaccctgcctggccagtgcccgcctcctctgttctggaccctgctttgggggtcaggggtcccctccatgctagccctgctctgagggccccagctgggggatgccacctccacacacggcctcctgcagcctcaccagctactcacattgcacacgtgggcgggaagtggttaagcggcctcagtccccacaggccccagccatgctctgggggcacctttggctctgtggtcagttgctcatctgcccctggcctcaggtcagccttgtgggagagcaccctctactgtcca

SEQ ID NO: 497 - DNA, 13799 bp, Homo sapiens
gaggtgactgagaaactgaataagtgactgagaaactgaataatccagcaggaaggagggggctccagcgtggcgggaactgagtcacgcggttgcctagcccgactcgagactgagacgggagccgcaccacgcgctttcggacaaggagggtgctgcggcccggcccctggacaatggagagagcggggcacccgggcgcatcaccagagctcatgcccgggaaaggggcgaggcccggggggagagagctcagcgtagctccacttggcagctaaagaaacaggcgcccgggacggaaatgactcgcgcccggacacggcgacagggagagcatgggaagtgcttccttcgcccggcgggttcgagcgagtagcactttactttccctacaggtggaggcgggccttggtgcgcggctgtccatctccggaccgcccacccgggcactggcccatgcgtctcctcccccggaagcggtaagcgaatcaggcgcgggggaagggagaacgttgctcctcgggcccctcctcccgataagcctggaatgtcaaatatttgttcgcggggcggggcgcaaccgcgagtaacgctcctccccctcccgcccggtagggcgcctgcgcttggtggaggcggcccttcctccggccacgcccttccagccaactcccctaaaccagtggccctaaccgccgcattcctaaagctccacagaagcacgtcgcttcctccttggctcctgtctgggttccactcttacagcacagggtcacagcgtccccgcccgaaggtctgggcgctactcggtctccttctcgcccctcctggcgacctcatctgtgcagcctctaggccctttttcctcttcagcctgagtctcgacgcccgctcttcccggaagccaccttcgcgaggtgactgctccattgtggcgtctctggcagtcctgagcgctttcccacggaagacgcgcttatgcgtgtccaagtcgccgctgggtcgtgaacctgaggcacgggctggtagcacagtgcggctcccctaaactaccccggatgcccatccggctgcccccatagcaagacaactcctgcaacttagattctttttattttattttatttttttaatttttattattcttttctttgagacggagttttgctcttgttgcccagactggagtgcaatggcgcgatctcggcttactgcaacctccgcctcctgggttcaagcgattctcctgcctcagcctcccaagtagctgggattacaggcgtgcaccaccacgcctgtatttttttagtagagacggggtttcaccatgttgatcaggctggatggtctcgaactcctgacctcaggtgatccacccgcctcggtctcccagtgctgggattacgggcgtgagccaccacgcctggctaatttttgtattttttgcagagacggggtctcgccatgttgaccaggctggtctcgaactccgcccacctcggcctcccgaagggctagaattataggcatgagctaccgtgcactcagctccaacccttgcattcttctttaaaaaccaaattcgtttaaatactgggcaggagggtggggtcctgttttgctgagatcccttactcatcttcagatgagtccttccagatgaccccattattactaaacaacccacactcctgaccccaaccgaccctcattgcttctttctgccccccaaccccccaacttaaccaacttataacacgatttattaatcgtgtattgtctccccgctccatcatcctatcctcgaagatagaggcttacccccaacgcctgtcactgaatgaatgaactgttgtctaaggctagcttcttctgccacagggtatttcagcaatggtaagacacaggcctttgcagtagggtctcatctgtgccctttcctcctctccagccctaccccttctctatctagggctccagctcttcctccagaatttttttttttttttttttttttttgagacagagtctcgctctgtcccccaggctggagtgcaatggcatgatcccggctcactgcaacctccgcctcctgggttgacgcgattcctctgcctctgcctctgcctcagcctcccgagtagctgggactacaggcgcgcgccaccatgccgggttaatttttgtatttttaataaagatgggatttccccatattgaacaggctggtctcgaactcctgacctcgtgatccgcccgcctcggcctcccagagtgttgggattacaggcatgagccaccgctcccggccttcctccagattttctaccttccgcaggggtcccttctgtagtttgagatttctgtacttctctaaaaattgtcccccacccccaccccactcctcgctcccctggggttcatgaattaatgaataggagattggtacggcagagaggtaagcaaggccccgacggcccaggccgcctgaggtcagccgcctttctcaaaaccgcgtgccagatatttggaagaaagaactgggttccgtgggcctcatactcgcgaaattttaccctcaccttggccctcaggcctgcctgggctgcactcctaaaggcagccggcgctgttgcctcggggacatgaaagcccgggcagatacagggtgggaggcgggaagcgtggcgggtctcctggaacctccagggcgtctaggagtggtgcgaaaacgccctccctccttcccttcgctaccaagaaagatctcgcagtggaagaggattcgacgctggggatcaccgcggagatccacactcgtctgcccagacccgtccccgctctcagcgaccctccttatgtcccgggccaccccactagccagcgcgttgggccccacctcccgggttgggatccccgcacctgtgcagagtggctgccgagcacccgccagagggcgcgctgactccgttgccagaaccaggggggcaggggcgtgcgcccgaggtcgagcaaagcaccagtacagtggtgaaaagggggtcccctagatgcccccatcaggccaataccctttggctttgtttttattttattttattttaattttattttgagacggagttttggtctcgtctcccaggctggagtgcaatggtgcgatttcggcccactgcaacttccgcctcccgggttcaagccgttctcctgcctcagcctcctgagtagctgggattacaagtgctcgccaccacgcccggctaatttttgtatttttagtagagacggggtttcaccatgttagccaggcaaatctcaaactcctgacctcaagtgatctgcctgcctcggcctcccaaagtgctgggattagaggcgtgagccactgcgcctgacctattttattttgttttattttattttaatttttttgagacagagtcttgctctgtcgcccaggctggagtgcagtggcacgatcttggctctctgcaacctccgcctcccgggttcaagcgattctcctgcctcagcctcctgagtagtgggattacaggcacgcaacaccacgcctagctaatttttgtatttctagtacagatagggtttcaccatgttggtcagcctggtctcgaactcctgacctcgtgatccgcccgcctctgcctcccaaagtgctgggattacaggcgtgagccaccacgccaggcttattttatttttatttatttttgagacagagtctcattctgtcacccaggctggagtgcaatggcacgatctcggctcactgcaacctccacctcccaggttcaagtgattcttgtgcctcagcctcctaagtagctgagattacaggcccacaccaccacgcctggctaattttttgtatttttagtagagacagggtttcgccacattgcgcaggctggtcttgaacttctgaactcaggcaatatgcccacctcggcctcccaaagtgctaggattacaggtgtgagccaccatgcccgggcttttattttatattttattttttaaaattttattgaaacggagtttccctctgtcacccaggctggagtgcagtggcatgatctctgttctgggccctttgcctccagggttctgttgtggctggatcagtgttaggcatctcggggctgcagggagactggctgcagaggaatgggggactgctgagccatgagctttagggagattccaccggcctctaaatggactcagctctggccaccaaatcagcccgaaagccctgagcttagtttggttgcctcaagcctgggatccacctagttcaggtaggggagcttggagcttaggccagcgagagggagtgcaaagggccaggtagcaggaggggcgaagggtgttggctgtgtgctcacccaaggaagatagcacaactagactggctcctaagtctctggatttattctgttgatgaaaagagtcaaactctgtaaaatatttggacactttttttttttttttgagacaagagtctcgttctgtcacccaggctagcatgcagtggcgcgatctcggctcgctgcaagctccgcctcccaggttcacgccattctcctgcctcagcctcccgagtagctgggactacaggcacctgccaccacgcctggctaatttttcgtatttttagtggagacagggtttcattgtgttagccaggatggtctcgatctcctgacctcatgatccgcccgcctcggcctcccaaagtgctgggattacaggtgtgagccaccatgcccagcctggacgctttttttggatggagtcttgctctgtctcccaggctggagtgcagtgacatgatcttggctcactgcaacctccgcctcccgggttcaagtgattctcctgcctcagcctcccgagtagctgggactacatgtgcccgccaccacggccagctaatttttctatttttatagagatgggtttcgccttattggctaggctagtctcaaactcctgacctcaggggatccacccacctcggcctcccaaagtgttgggattacaggcgtgaaccactgtgcccggccctattcagacctgtgaaaggtgctaaactcttaatctcttcaggtttgggagggcctggaagaaaatctagctatgttaatagagattctttacagatgcaaaatttcctccacaaaggacagttttgcaggaccatttccaagtatggcaaagaaacattgttttggaatattttgactttcttgtcacctaatgttatgccagagtcagattgcaaagtaagttccgatatataggattaaataaaacccatctaatgagaatttatggtttgtagggcaaaccatacaatttgagatagtaatttgagcaatattaaaaaaaaaaaatcagggccgggtgtgatggctcatacctgtaatcccagcactttgggagacctaggtgggtggatcacctgaggtcaggagttcaagaccagcctggccaacatggcgaaatcccgtctctactaaaaaatacaaaaatcagctgggcgtggtggcgggtgcctgtaatcccagctattcaggaggctgaggcaggagaatcgcttgaacccaggaggcagaggttgcagtgagccgggatcacgccactgctctccagcctgggtgacagagcaaaactctgtctcaaaaaaaaaaaaaaaaaggtgtcagcctggcatgtggagaacgacccacaggaacgagggcgtgcattgggacatcagtgacgaggctgttgtgggaatagggtagtgtggtttggggagtgtagagctggcaagcccttatgaccacctgagttgtggttctgagaagcatggaagcatccagagctcaggatgatgccaagtctgcagcctgggggatcaggtggatggcagagtcattgtgaaaagggaggaccctcactttctgacccttctccacagtgccagcatgggtcattgctgaccaggccttgccatcctgcccctaatggctgtggttcctaacacatgcagggcctgtggggttgaagcaccaaggaacccctcttgaggacagggctacccttccaggggcccatggtcaccggatgctgctgggctggcaagacatttagactgtggccagagtccaaggtggcccagcacctcttgatccttctcttcctccacataacctttgactggacttctgcccgtccctaggcctgcagaagagtctctggtctcccacgctgggttttcaccagatgggtcttcactgatcttctgttgggtcacgggtgaaggtgggggaggcaggggctttgggagtgggagttctgagccagggccttagcgggagatggctggaccttaagagagggtggggctggtcacagtggcacacatctgtaatctcagcactttgggaggctgaggcaggtggatcacttaaggccaggagttcaagactggcctgggcaacatagtgagaccccaactctacaaaaaataaaaaactagctgagcttggaggtgtacacttgtagtcccagctactcaggaggctgaggtgggaaggattgcttgagcctgagaggtcaaggatgcagtgagccgtgattgtgctactgcacttgggtgacagagagaccctttctcaaaaaaaaaaaaaaaaaaaaaaaaaaaaggaaagaaaagaaaaaggggccgggcacagtagctcacgcctgtaatcccagcactttgggaggccgaggcaggtggatcacctgaggttgggagttcaagaccagcctgactaacatggagaaaccccgtctctactaaaaatacaaaattagccagggtggtggcgcatgcctgcaatcccagctactcgggaggctgaggcaggagaattgcttgaatccgggagacggaggttacggtgagccaagattgcaccattgcactccagcctgggcaacaagagcgaaactctgtctcaaaaaaaaaaaaaaaaagaaaaagaaaaagaaaaaagaaagagggagggtggtggtagcccagtcaccaacatgtttcactataagaactcgagaagggcagggcaagatagtggcttcatagccaggtcagctgcttaccaagaagaaggaaggaaggggcaggacaaatttcttgggaccaggtgggatgaccagggtgcagctgccccttcgaaggggtgggtgtgtggaggatcaagacctctatttcccaaatactctcgtccctctatcccacagtgacctatggtgctggcatataaccagctgtcaggtctttgcccactctgttcgcccctgcttcctggcgcagggagtccatgtcctctctggttccccaggtttgcgagagtggagggggaccacgagctcccgatgcctctcctgctctgcaggggaacttgcagatggcccatggcgcagggtcgagactcaagcccactcccaaccccgcgcccgaactgcccggactggcggggtgacgctgcactctgcgcccctaaaacgaacagattaacccctctcttgggaactgaacatgctgacctggcctctcccggttccccccgcatctgtaaccccggggcagagttacaggggctgactggccgcacccaggtgccctcggggcagggtgtgctaagaattggtgtgggggctgcacaaaggtcctggtcagctcctggtcacctgaggcccaagaactgtccgggactcacttcctctcttcttgctttaaccggggtcgctcagcagcggccagcgctgcaccccttatcctctcccggtcttgtccgttccagatcctccaggtcagggggtcgccaagtgagagctgcgcagcgtggatttcgggtacccagggctgggcggggtacagcagcggcgagctgggttcccgggtgggcgactgacagcccggagccaggcgatacctcgatccatcgatgcgctcggcgctcagcgtggtccaggaagcagggggttgggcaagggcggggcggcgacctccgactgggaggggcgtatatggcggcgagtccctattggccagccatttgcgggaggcgggccctgattggccggggggatgcgggggatgcgggcggcggggttaagcgcgtcgccaccgcccccgcctaggcgagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctgggtgaggcacgggtctcgtggtggatctgtcggtcgggcgggacgggccgcgggcggggctgccttcccggtctgcttctgttccagtcacgaaatgggggagcgtattggtatctgtcttgtcacttaggtgatctagatctgccggctcacctcccgccatgctgggcgcgggtgtggtcagctccccacctcctgtcctggtagaaaatgggggtgagtgggagagttaccatctggttattcatagttccacctgtccgcatcattcccaagccttgcctccccttatcccatttttaagctggaaagacaggtgcttcagccccactcctgagggatggtgggggtgtgtagagtggctcctgagttgacttctgcatcgacctgggcctggttaggaggctgtcaccctcgacccctccaatgccacatatgccagaaggcattgctgaaaggaacctccttagggaaaggattgctgtcctagctggccaccaactcccacaacttatcagatgtgtggcattgcctgagggaaaaggcctaagggaaactgaagacaactgaagtcaggggaaagggttgggacaatggccatgaacctgtgtcaggcaacatgcttgtactcttaccctgccacacatgcttggactagactatgtggaggctcggtgacctcccctgctcaccccgctccttgatcacaaccctggcaactctacaacggccactgtatttccttgcagggatgggcagggatgagacctctgtctggggggccttgggtgcctcattgaggccgtcactcccatccagagctggtgtgtccgtggccagccaggattcctgaaagcagaggcatctgaggcatgaattacacgtggagtctagtgcagcatgatctccatgctctttctgctgagagtactttaaatggggacgatgcaaatcacagaagggtagagttggcaggtagggtggtgccaggcaggccccaccaggagttcccagccaggaaaagctccagggggatactaggcccaggttcaccatgggatttgggcagacttggccctgcctccccaaagcttgcaggataggaataacagtgatccccagagaggaagtctgtgtggggcaagcacagagaatccaccaacccagcctggatgggtgggtgtcaagtaaggcttcctggagtatatagctggagctaaggccaggagagagtaatgggtcggggagagacgtgagcatctcaggctgcctgggatcgagtcacaggaggagtggactgcacaggacttgtgactggttgggtcatctgaactttatcttgagggcctcagggagtcctgggttggcctgcagagttctaagtctgaggggcgtggcattaggaagcatgtggtctgtggcacacaaaatggcacatagccattttgcctggattgatgctaaccgcactcatcaattcagtcagtctgtttatccttggtcacagcagaagagcctcagaccccacccagaatcacagagcagcaggagtcctaacatgcccagcttctcagggagtgaggctgctggccttagccctgggagacctcacggtgggcagttggataagcagctcctgggcacagagcagggatctgaccttgactgtcagaagatcagaatcctctaggggtggatcctgaaatggtggtggaggaaagagagaccagcgatgtgatacagaagaccctgggcaaggggaagggaccataggcaaggccatttccacctcttgcagcctcagtctccccatctgttaagtggaaatagtaaggctgtcccctcccagtgttacttgaggtgaaaggcatgtggatggctcttttcctagttccaggcgcagatgggctcaggaagtggccactgctatttttaggggccacacagcctgaccagggtaaggagcatctgagcaaagcagatctggtgacttcctcttttaccatttcccctttggtagagacagtgaccagggtctctgccctgccctgcccagtccacaggcatgtcatccagaggctgtcatgacagggactccctccctctgcacccataccatgaagggaggtgaaggcatgtgccgcccctgcctctcatggcaccctgaagacactgggatggtgcccagggagggcacgccctgttcagggtggatttacggtcagttcccagtgaatgtccaggagagccaagtgctggtttttcactcaatgatcatggaccctaaacggggatgtgtttgggaagtggcgagagcatggcatgtgggggcaggtgaggcccgaaaggtcaatgggagtaacgagactgtgaagggctttgacgcagtggggagggatttgggtgtcaccagggccccagagttctgagtacactgaataggatggctgggatggagagaagtcaccctagggcctggactgtggtgataatggtgctggttcagggtggctgtttccaatacgggctcccagccatgctagggccctccagatgatctgctctctggcaccttactggactctggcctttagtaaggcctgggcccttggtaggctggcgggtgccaatgtaagcttctctcagctgtgtttctgttcatttccctcccaccagcctgtcctgcatactttgtctggttgaattttagctgagtggcccagggctctgttctgtttccttcttcctctctcagggcgaacaggaccctgtcttctatgtagcctgggatagctatgggtggaagacttttgggttcaagcctccagggtatatatctttttttttttttgagaccgggtcttgctctgtcacccaggctggagggcaatggcacgattttggctcactgcaacctctgcctcccgggttcaagcaattctcctgtcttaggctcctgagtagctgggattacaggtgtgtgccaccacaccaaggtaattttttgtatttttagtagagatgggctttcaccatattggccaagctggtcttgaactcctgaccgcaagtgatccactcacctcggcctcccaaagtgctgggattacaggcatgagcccctgcgccctgcctcgaaggtatatatctaatgacaagggccttggccaaactttggaggttctggaatgcaaaggggtctccaagcccctcctcccaggcagagctcccatcggggtccattaaccatagaaaccatgtgtagaggtgtgtctgtgtttgctgggggtgattcagaccaagatctcatttaacagatacggaaactgaggcctagtgtggggagtgacttcaccctgaacccccttccaataatctgaatggcccaggaggatgttccagtgaaaatccaggagacttactttatctggagttggagacaatgttagggcccttccccaaacatgtcaggcctctcccaagccccccacaggcatctctgcaccacacagcagtagcagcttttctgcacaaagatggttccctggcctttgggtcaaggtccctgctctctgaatttcctgccaccagcactgtgctttaatttgagatgtggaactgcacaggtctgccatattatctgtggctcttcagggggtctgctgcagacatcaaagttcttgggagtcttgaacctgccgggctgagggctcacacatgtcctgtgccccctgcagtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggtgggggctggggcacacagaggggggtgctgctcaccaacagtgcctgagaggcctccagagtctgttccttctatcctcatctcgaggtcactgacctctctccttccccaggtcctcggtctggtctggtctggtctggttggcaccacctctgcactcccaggcagaactaactttcccttcctgctgcccttgttcctctactctccagtcctggcctctcatgcctacacacaattttttttttcttttattttgggatggagtcttgctgtgtcactcaggctggcgccatctcagctcactgcaacctccgtctcccaggttcaagcgattcttgtgcctcagcctcccaagtagctgggattacaggtgcccgccaccatgcctggctaattttttgtatttttagtggagatggtgtttcaccatgttggccatgctggtcttgaactcctgagctcaagtgttctgcccaccttggactcccaaagtgctgggattacaggcatgagccactacgcctgcctacacaaaatttctgtgtcccagcccctattcagagcctcggcatggcccccacccctttccttgtctgtgcctcggcctcccctacctctccagctgcttattcttcttgggacatgccatgtctttgtacctgctgttcttttggcctggaatctatttctacaccctttgcctgataaatggcttccattcacttttttttttttttttttttttggagacggagttttgctcttattgcccaggctggagtgcaatggcgcgatctcggctcacaactcttttttttttttttaacttttattttttgagacagagtcttgctctgtcgcccaggctgggtgcagtggcgctatctcggctcactgcaagctccgcctcccgggttcacgccattcttctgcctcagcctcccaagtagctgggaccacaggcgcccgccacagtgcccggctaattttttgtattttttagtagagacagggtttcaccgtgttaaccaggatggtctccatctactgaccttgtgatccgcctgcctcagcctcccaaagtgctgggattacaggcgtgagccaccacacccagccccattcactctttaaaacatgaccctaggccaggcatggtggctctgctataatcccatcactttgggaggctgaggcagtcagatcacctgagctcaggagttgaagaccagcctgggcaacttggtgaaaccccatctctaccaaaaatacaaaaaaattagctgggcatggtggcatgcacctgtagtcccagctacttagggggctgaggcaggagaattgcttgagccagggaagcagaggttgcagtgagcagaccactgtacccagcctgggttgcagagcaagaccctgtctcaaaacaacaaaaacctgaccctggtccctttgtgacatgtcccttttgactccccagagcggtttgcctctcctcccaggccccatgcttgcttcctct

SEQ ID NO: 498 - DNA, 14012 bp, Homo sapiens
ggtcctgtcatgttcggttactttcatatacacagtctacattcagtaattaatatgtccagtctaataaaataaaatgctcccttctccagctcgggtcttctttggtctggatgcctgcctccaactcactaggctgcctttgactcctccagactgaattgggtggaggaaagagaagtgaggggtaacaaaattctcatctgatgtataaggatgagtcatgtgaacttgctaatatttgtcctgcaaaaatgtcaatttaatatggttcaatgtaatactgttgtcatctgcatgagacctgtctgggctaagacggcatttaaaactacatttttcctttttagaactcctttctgtattcctaggaggacccttaagattgtggggaggtctttcatccaaagtaccctggatgcttttgaatctgtctcctccaaatggcagctcataactccatctttagctgctgggcatctagatcacacacctcagcttccctcttctgagggcttgccttattcctactaaggctgttttgatcaggatagaaaacagttccatgctgacttgctcttttggcatatctagttgagggaaaatgctcatgctttctctgatcctgaacattcaggagatgcagaccactcctagcatagcacactcttagctccactgccagcacaaatattataccctttagagttttcaggtgtgtcaacagcctgctcactgacagcttgaggatgctcccagggacacatacctagttgtctgcattgtctatggaagcccgtttccctaggcttgaaatgagggccaagcaactctacctgatgccccagggtggggtgagtgccactcctagctcatcgaaagctctctcctgaaattcccttctagttttatttttatcttgacctttccaccttggtgatgggttaagagttacaaaaccagtttttggaaacctcctttacaggtcctgcatccttcacctgtggaaggtggacatagttgacatctattgtcttgggggctaaacgcaaaactgagtctgaaatagttcccttttaacctcccgttatgtgcagatttaacaaattcagtgcctttcttaaagtaaaaggtacatccagacactggagagtagtgctaaaacaaactattagggaattgaaatgaccataaaagaacataatgaacaaacagaaataatccaaccagcaccttagttttgattctggcattgctttttactccagaagcaagagttgaaagaaactgacctgcattttaaaatatattttttaatggtcatgtaatatgctatatttcttcaaatctgttaaaaatagaaactcaagagttggatggcatcatggttagggaagaaaaattctgtaactggaatagatggttgtagtaattcacatgtctcaatttgtattctagtcataacatacttcttaaaagggtggtaaaaataatgtgttttctctttcccacttcatttgtctaatttctgtaacatacaccctcacaatgaattattgactcagggacaagaggtagagaaattacagaggttgctaagaatacctgctgactcttattttctacttctgctttagaagttgtttagaaaatctaatcaaggccgtcttacatccagtagaaacagagagtttctactggatgtgctttggagcaggtttttaagagagagctttccccatggaagagtgaccatattggggaaagaagagctcaggagacatgagttatgcttctcttgcctggggaggtgtttgcttaaaagacatgctgcccaagtatttaagccttcaggttagggtcttttttccagttgttggcagagtgaatgagcatgaactgtatttgatgaactacagttaacacaaatactcattttgaagcagataaaattattttgaaagtgaaggaaaattgtttcataagagaaacttgtacttcctacgaaaagactgtgtttttttgctccatgtttttagtaaagtttagtcaaatttagtttagttcacctagaacgaacactgaacaatttggaaatacattttattcctttttttaaactagaggttagcaaaccctggcagaaaaaccaaatgtagcctgacacctgtttttgtgaataaagatttattggaacatagtcgtgctcgtttgtttacaaattgtgtctggctacatttgcattgcaacagcattgttaagtagttgggacagagaccatatggcctgcaaagcctaaaatatttactatcccactctttacaggaaaagtttgcagatccctgttctagattaatgaaagtactcagtatcagtgtttttgtggttatatatggcataaatggctattaattctctgaattattattaattttaaatatttcagtatcttttgtacttgattatatatctcattaaaataattgaattaattctgaaaattggtatggtctgtttgcctaatggacaatacactggacattacaaaactaatttctgcttttcaaatcccttggacagtaaaataatttatttcttgatttgcattttaccacatatgagcaccttgggaagacattgtgtagtagaaagcatactgtcagcacccacttccaaaatgttttctagatttattggaacaatttaaaatgtcagtgaaaagaagtacttttcttcctttgtgttcttcatttttctatgatggctggatgcattcactccttggggcattcatgttccttccttaaagggcagagttaaggttactctgtgggtcatttgcctcttcagggttgtttgatccttctcaagagaagattattttaatgtattgcaggagatgctgcctgataactgaggctgatctgttgagcactgtaggaaccagactggggacaagaattgactcatttattcatttatacttatgtttattcaacaaacgttgaaggcatgctttactaggttctgtgctctcaaggatttcatagtctcttacaggagatggacacaaagcaaatgattatcatatactgtgttaggcaagatgattgagttatagtcaggatattataggagagaaggggcatctaatccaccatggggagagggcaatcaagaaaagctatttgaaagaggctaaatccagatcaataaatccaggacattctgtcagaaattcagatggagatgtctggcaggtggatttgagtctcaatctgggatagagataaggatttaggtgtctttattctaggaatggcagttaaaaccctgagagctgatgagagcctgaagagtgggaagagggctcagcatgggaaaggccaacatttaaggatcagaaagagatgcataaaggaaacaaggaaggggtcagagagataattaggaataccaagagaacaaaagacaatggtgtttagagactgagtgaggggaaggagacggtcaatggaaagatggaaaatccaggattgatcagggactggcaatgtaggaggcagaggggagatggaattcatttcaaatattctaatgtaaactacttatgtgttaaacaaatgatgacctaaaacttagtttcaggctgttgtttaaagtaggctcaaataagtaagttgatttcctatatttgtaaaagctaataatttttatttaatcaaacacacatttattgagcacttattttgtactaggtgctataacaggttggcaccctaagggataaactatgcgggatataaaaatgatcaaaaagtgaagtagtaatatttaagctaagccctggaaaatggggagggatggaagtacatataagtcaagaataggcaagagttagagcaaaaacacagtgcatgaaaccccaggacactgtcagtcttgaattattgttcttgactatgtctgtctccaccactagactctctaatgctgaggactgtgatttatagagcctcacatggtgttttgcatgttgtatttactcaattaatgtttgctatatgaatgaaacttgagaaacagaaacatcataattgttacttattccatagtcttgtctgtgctggcctcagtaataaagcaaaaactaacttaaagactagcattcttatgttcattagtaaaacaggtaatagataaattaccttcttgatttgacttttgagaatgacgtgttagaacttataaatgaatcaaatacgtgtaatttataatgttactatatgatatgaaaacaatttgagatagaagtcataaatatgaagtttcttaagactttgatcaaaacaacaaaatttctttgagattttctttttttaaaacttttatttttcaacaacagctaaccaaagatgggatcttctttacatgacaatgttgaagccaattgatacacaatttatttgttagcgtgttagtggttctatttgttttatattttgaagtgaactatggccttcttttaggactgaaaaataacttcgtggtgtacagatattttagattaaccaagggtacttgttaacaaaagctattattttatagctgcatctccgtgtttgatttgataaatttgggaattaaatttacaatgcaaatttcattagtggaattacatagccaatttggagaggttctatttaatgtgctaccttgatttagaatgagcgatttagaaatatgaagagttgactgggcatggtgtctcatgcctgtaatcctaggactttgggaggctgaggtgtgattgcttgagctcaggagtttgagaccagcctgggcaacatggcaaaatcctgttctacttaaaaaaaaaaaaaattagctgggcatagtgacttgcccctgtggtcccagctagttggtgggctgaggcaggagaatcgcttgagtccaggaggttgaggcttcagtgagctgtgtttgtgccactatactccagcctgggtgacaaagtgagaccctgtctgaaaaaacaaaaacaaaaacaaaagcaacaaaaaaaggagaaatatgaagagttagataaatgatacgataatagcccacgttttcttgttgattgtggaaaaggaaataattaacagtatctattataaccacataggatgtattgatttaagaattacagtagaaaataattcaaggaattggaaaagtgaggcatgttgttctatgaagattttgcatccttaattatttataagtatttgagttatgtgtaacttcattttctccattaatttttgataatgatatccaaaacaaatctgcagttatttgttagtttgacctgtgttatctttgcttcataaattcctcaattatctagtttaatctagttcttatttcacaaatgatggaagtcagattaagcagtttgtttaaatgacccgcaatgaattatagagataggtcaccattttatgctaacgggttggcaagaaaaattcatgaaattttacaggcttcatgttgcagttgtctacaaatacacttccataaatgaaaataaacaagtttgttcattgcatcattataaatgtaatttaaaaattaattttctaaattgttttatgcaagtaagtaagcaagcaaaataaataagaactcatatactttcctgtcttttttttctcccctgcccaataggaccagacatactatcaatcatttcaggtttcagaatatggtaagagttcctcaatctattttggaagaaaaaaacatttgttactttcagcagagattagagaaatttttaagagatgtattatttgaagtaaaaatctcaatggagttaaaattctggtgttttttaaaggcctaaccatattttttttcctttgtaaaaattctaaaatctcattatacagaaaaaagtagaaaaaaatcacctatagttgcattgtgctagtctttttcttatccacaacatgatttttctatttttctactttgttgtgataaaaaaatatttaaagtgttgcacttaaaaatacttaacaaattctcttccatatttttcatttgattgacattggtaaagatggtctgtttctcaggtaaatcctcttcttgcaggtgccatacttacaatatctgttagaaacccatagataaaaacagtgggacccatctattttgttggtgaatggagaggaatgagagatgagactgaaagcataggatcttagtattagttataatttgaatagttattttgaggttgcacatgcagtttttcatttgatttgagcttcttttttgagattgggttttatttaggcagtagaaattataatatacaggtagtaatacctcaggctctgtgggccatatgtctctgttgttactactcaattttgccgtggtagcatgagagcagccaaagataatatgtacatgaatgttgctgtggttcaataaactttattttatgggcatgaaaatttgaatttcatataattttcatatgtcatgaaatattcttcttcttttgatttttttcaaccagttaaaaattgtaaaaaatgttcttggttcatgctggtcatagtttgctgaactctgatctgtaactgtgctctccagtagcggggccacttgccatgtgtggctgttgagcacttcaaatgtggctagtccagatggagacagcagatgtcaaagacttagtacaagaaaaatgaaagaaagaaaaatagttcattaataaccatttttaaatttttattatttgttgaaaagatactattttagatatatagggttaagtaaaatataaaaattaatttcacctgcttatttttactttaaaaatttgactactagaaatgaaaaattacacatatggctcccattttatgtcttttagacagccctgatctagaagaataagtcataggggaccaacatttttataggctatctttatatcccattgtgatggtatgctgggtggttgtatgttgttgaatgaggtatagtggaggtggggaattgattgcaaacctatgatgtttgaggaagaggcatttggattttcttggtggtgggggttgcgggggcggggtcatagttgactcacgtgactttttggtctccctgtcctagactgatctagagtctaggagtgtcttggtacattcagggccattagccttgattggagctgaaggtctgccctatattgttgactatttggcttttttgatacttctcttatgttaattgaatggtgaggtgccttgttatgagagtggcctgtttctttggtcagagaactatagaaaaaaagttttatcgactgtaaagaaacacacattttttactctggtggagtgctttatatcaattatagtattagtacttataaaatagtttataccttaattattattattatttttcgagacggagtctcactgtgtcactcaggctggagtgcagtggcatgatctcgggtcactgcaaccactgcctcctgggttcaagcgattctcctgcctcagcctcctgagtagctgggattacaggcatgcaccaccatgcccaacaatttttgtatttttagtagagataggattcaccatgctggccaggctggtcttgaactcctgacctcaggtgatccacctgcctctgcctcccgagttctagaattacaggcgtgagccactactcccagcctcataccttaattatataaagctgaccaaattagggatttctagttttgggtgaaacaaagggcttttcatctgtcttaatatgtatttggattctaataaatttaagttcaaatagtacaaattattaactccttcacaacaattttatttttcattttattcagtggaagatgatagtgaagtagattctttaaaagatttacccttgcttcttcgtctcaaaaagaaaaaaagatttacccttgcttttcttttccagtattaccaaaatttgaagtgactttgcagacaccattatattgttctatgaattctaagcatttaaatggtaccatcacggcaaagtaagtgtcatttttcttttgatatgactcaaaaccattataaaactgtgtgaccaaaagctgattgtatacttcagaatattagggcaatttttgcttattaaaataccttagtggacagtaaatgactatttataataaataattaagcatgggacagagctccacatttcactgcatctatcactctgcttgcaagccgacccagtcttaaaatatttcccatatttcttagacttattaagggatttatattatagatagcactgtttttttttcagatgacatggacttgaagccaccacgcctggctaattttttttcctttatagagatggggtcttgccattttctccaggctggtcttgaactcctggcctcacatgatactcctgccttggtctcctaaagtgctgagactacaggcatgttccaccactcctgggctgatttgctttttaaaaattagtcaagcttttattttctgagtgattaacttatcccaaatgcttcccggttctatttgggacaataattgtatctttgtttcacaattattataaccagcttggtgtttggaaaactaaatctgcttcacattaaagtcaaaattaaaaatttttatgtctgagagtactttaaattatatttggattttaaagatccttttactaccatgtgatataactctgttaaaatacaatatcctggcattctagttttgcttttatttaatctttagcacgatacaagtagagtcaggtttcgaagactcttgaatgagtgaatttgatgctcaggttgctaaccagggtttccactgactttactgtttttgtttggaagtgtggtgcatttgaacttggatttttttttttttcttcttagtttggaatatgctatattttaagatttgcttttgagttgagttgatccagatgaggggctgtttctgtgttcagttaatggattcaggaagccgccgtttactgctgtgatttatagactgcaaagcaaaattgacttccatgtctggctcagcatttcacaatagagatagaagcaacccaggaaatgtacttaaaaaaggctttctgggccgggcgcagtggctcacgcctgtaatcccagcactttgggaggccgaggcgggcgggtcacaaggtcaggagatcgagaccatcttggctaacacggtgaaaccccgtctctactgaaaatacaaaaaattagccgggcgcggtggcgggcgcctgtagtcccagctactcgggaggctgaggcaggagaatggcgtgaacctgggaggcggagcttgcagtgagccgagattgtgccactgcagtccggcctgggctaaagagcgggaccccgtctcaaaaaaaaaaaaaaaaaaaaaaaaaaaaaagcctttctggcagtaaaatgtattgcctcttcttcacatgaagagactttcctataatgagagaggataaaattaatacatagaaagaaaagtagcagagaatatttgacttacgaagctaagtttgggccaggtgaggtggctcgtgcctataatcccagcactttggggggccaaactgggtggatcacttgaggtcaggagtttgagaccagcctggccaatatggtgaaactccatttctactgaaaatacaaaaattagctgggtgtagtggcagacgcctataatcccagctattcgggaggctgaagcagagaattgattgaacctgggaggcagaggttgcagtgaccctagatcgcaccactgcactccagcctgggtgacagagcgagactctgtctcaaaaaataaaataaaataaaattcgctggacgtggtggtgtgcgcttgtcatcccagctactcaggaggctgaggcaggagaatctcttgaacccctgaggtggaggttgcagtgagccgagatcatgccactgcatccagcctgggtgacagagtgagactgtgtctaaacacacacacacacacacacacacacacacacacacacacacacacacacacacacaaacccagaaactaagtttggtactacagattttaaaaattattcttattttaaattttttggcaaaaaatcaatttttgacagccatgagcacatttggtgcttcagaatctatggtgtaataaaccttcctcgctaatattggaacatgtagcaatagaccatggtgattgcactatcagctgacatttaaaaatcttctaaagctgcgaagtttcgtgggcattcagttaatgggccagtccagatttctaggagtgaaagatttatgtaatctttaaaaaatctttggacaggaaactgtcacttccaattatgatcaggtattttctggagtctttcagatggtcagaggttgggcagagtgtgtgttaagaactgttttaagctactatagttaaaagtcttcccattttggaaacttaatttcaaggatcaccatttattttttatttatttatttattttttgagttggagtctcactctgttgcccaggctggagtgcagtggcacgatcttggctcactgcagcctccacctcctgggttcaaacagttctctgcctcagcctccaagtagctgggattacaggcacccaccaccacgcctggctaatttttttgcatttttagtagagatggggtttcaccatcttggccaggctggtcttgaactcctgacctcgtgatccaccagcctcggcctcccaaagtgctgggattacaggcatgagccaccgtgcccatccaggatcaccgtttattaaagacatttttgttgggtttagtttaaaaaattatagtaggagtatgtttttaatgtaacttttttctttttaaaattttctctttttagtgttttgccatcccataatgtatttttttttaatttatttattttgagacagagtcttgctgtcttgctgtgttgtccaggctggagtgcagtgatgcgatctcggctcactgcaacctccacttcctgggttcaagcagttctcctgcctcagcctccaaagtagctgggagtacaggtgcctgccaccatgcccagctgatttttgtatttttagtagagacagggtttcactatgttggccaggctggtcttgcactcctgacctcgtgatccacccgcctcggcctcccaaagtgctgggattacaggcgtgagccaccgctcccagcccaatgtaattttttaaaatgttagattgctaattgctaatgtatgctattgaaagtagtatttttattgtgttctgacaatatcaagttgatacataaaaagactatgtttataattattcaggtatacatatgggaagccagtgaaaggagacgtaacgcttacatttttacctttatccttttggggaaagaagaaaaatattacaaaaacatttaaggtaacttttgcagacactttataacttgtgatgggtaaaatatgtgtatttttctagaaataagatttagtactgaattaacaaaaagttaagtgtaagaaaatcaagagctttccagcattgaacaaatgagaatttatgcaattatagcgattaaaatggtaccagagctatcatattgttgtgacttagtttgagttttatttctaaaatttgaattgctaaaatggtaaataatactgaacttttaaacaaaacagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtttgtagactttaaagtggaggtaaaactattcatgtgacactgctttatcatctttcttattataactggcactttcatttgggagcatcattgactttctaaagatgctatttaatgttgaaattgttatgactgttagtctaagttgcaggatgattttataagggggaccttattttctatgaaagtcactacttcaaccacatgtgatagctcttcttaatttttttttccatttctactctttccccctgaaaactacatggaaaggcttacattttcagctggtaaccttcttctttttaaaatcactgaaatctcagctgttcctagacagttttcacttttaataagaaaataaagttgagtttcttggacctttctgttactatttcaacaactttagccaatccctgaaagagcaaaagactattctttcattggccttaatttgctgctgttgtacatgtcactgcggtagaatggcagcaatggtgcttagaggggatccatagagaacataatagaactgtgtggtgcttgtagtgtcaaagtcaatatgggaatgaggcttatgtgccctgatatttttaaccctttttgcaataggttagatggagagatttggtggatagaagctttgggtgaaacattacttttgctttctaaattgtgcaatttccaaaaaaggtatttcaagaaatgtaagcactaatgtgttcttcaagcaacatgattacatcattgagttttttgattatactactgtcttgaagccatctctcaacttcacagccactgtaagttggtatatttatttccagtccatagcagtaagttcagcttaatgaaatagaatgggaaataatattttcaatgcttttctaaaaatttaagccaaaaagtatataactttgtctctttagacatgtggggcatgtagatttgtttccaaatgacctttgtctattttttctaaaaaagtagttttcaacaacagtaaaaatattttttgaaaatgtatttttttttacaagcaatttaagttagatgtggattgctacactgaagcttttattaattaattgaaataattacatggtagtcaaaaatttcaatttcaatttggtttttataatgattaattgtagttctaacaaagatgttacattaaaaaattatcaacaaatctcattttttggagataatgttgaattaacacattaattgtgtgaatgttgacaatgagcaaggcatggtgttgggcagggctatagagccaagaagggctcagtccctaccctcaggttcacagtttttgtgatggtgacaggaaaatatatacttaactataactcatggcagattaagattagtgttacaaattaatttctgtagggatttaaagcaggggttgccaaactttttctgcaaagggctagagagtaaatattttcagctttgtggccatgtggtctttgtcacagctactcagccctgccattgtagtgtgaaagcagccatagccaatttataaataagtgagagtggaatgtgttccagtaaaactttgtttacaaacatactggattggcctatcagcttgcagtagttggctgatctctgatttaaagaaaggaggagtcaggcctggcgtggtggctcatgcctgtaatcccagcactttgggaggccgaggcaggcggatcacctgaggttaggagttcgagaccagcctgaccaacatggagaaaccccatctccactaaaaacacaaaaaattaggcgggcgtggtggcacatgcctgtaattccaactactcgggaggctgaggcagaagaatcgcttgaacccgggaggcggaggttgtggtgagtggagattgcgccattgcactccagcctgggcaacaaaagtggaactccatttcaaaaaaaaaaaaaaaaacaactaaaacgacaaagaaagaatggaggggtcacttgttgaatgggtcggtagacgtttcaggtagtttctgatttcaatgatcttaatttaggcagtttgaaaa

SEQ ID NO: 499 - DNA, 14660 bp, Homo sapiens
tggaaaactgcctattatacacctattataaaggtggaggaaattttcatatttcatggaaataaagccagaactcggagcggtggatcacatctgtcatcccagcactttcagaggccgaggtgggaggattgcttgaacccaggagtgtgtgatcagccagggcataatagtgagacctcgtctctactaaaaataaaaaaaaaatcagccagatgtggtggtgcacacctgtgttctcagctgctcggggcgctgagatgaaaacatcacttgaggccgggcgcagtggctcacgcctgtaatcccagcactttgggaggctgagacgggcagatcacctgaggtcgggagttcgagaccagccttaccaacaaggagaaactccgtctctactaaaaacacaaaaaaattagctgagcatggtggcccatgcttgcaatcccacctactcgggaggctgaggcaggagaatcgctcgaacccgggaggcggaggttttggtgagccgagatcccgccactgcactcaagcctgggcgacagagcgagactccgtctcaaaaaaaaaaaaaaaaaaaaaaaaaaaaaaaaaaaaaagaaaacatcacttgagccagggagttggacgctgcactgagccctgatcttgccagcacactccaacttggatgacagagctagaccccgtctcaaacaagcaagcaaataagtgagaggcgtaattcctccttcaaaaataaaggaagagattttctttcatgtagtctcttttcttaggatatttatttagaaaatgtgtaaatgaattttctctgtcttctgaagcggtatgttatttgagacagagtttcgcgcttgtagcccacgctggagtggaatggcgtgatctccgttcactgcagcctccatctcccgggttcaagccattctcctgcctctgcctcccgagtagctgggattgcacgcatgtgccgccacgcccggttaatttcgtatttttagtagagaagggtttttccgtgttggtcagactggtctcaaactcctgacctcaggcgatccgcccgcctctgcctcccaaagtgctgggattacaggtgtgagccgctgcactcgaccagaagtggaatttttttagaaaagaactaaactgttttttagcttaatgacccagggatgtatttccgaaggacttgggagctctctttgaaaggcaaccaacaacagagatagcacttgtgtctcagtaggaaattaaattattcaaacatcaagtgattccaatttaaagcaatggatatttaaataattctgagccttgagaggaatgtggtcatgcaaccagagtccagtggaatgcaggcgcaacttctaagagttttcctgtaaataatttggaaaactggccatgcacagtggctcacgcctgtcatctcagcactttgggagactgaggctggcagatcacgaggtcaggagacagagatcatactggccaacatggtgaaaccccgtccctaataaaaatacaaaaattagctgggcatgttggtgcatgcctctagtaccgtctattctggaggctgagccatgagcatagggagtcggaggttgcagtgagccgagattgcgccactgtactccatcctggcgacagagcgattctccatctcaaaataaatacataaatagcaataaaaataaaaaaaataattaggaagactaagcagccccagcgatatgacctcctcagagcattgtgccttcttacgcagtgataaagtaaccttccttgaagtgtatcaatccatcaccaatcaacttgctgcaacctatgcactggtcttgaatggaaaacgtggtgattctgctaaagcatctctgtctttccctgtgtgtgaaaccttaacgtctctactttggaacgctgatcccatttatttggagttgatgtttccaggtggctttcttcaagctttgtgttcacattaactctgtacttaatcatatattttaaattttattatttactgctgacatcaatttctgtcgtatggtaggcgcctgaccagagagggcacctgtcgccatgttgtaaaactcaaacttgccaaaaagacatgggttagggtttcttcccctccctcgggatgaagctagttagctgacacagatggtcacctccattaccaagtagagccaggatgaactatgtgcgaccaagggtgttgtcaagtcctcttccctgaggactgattagtgtttatcttgaaaatatgtccttaatgggttgtatagaacagtgaagtttctttctctcttttcaacctcttagctgtttgcctctatttcccatcacattctggtcaaggcttattgatttatttatttagagacggaatctcttctgtcgcccaggctagagtgcaatggtgcgatctcggctcattgcaagctccgccttctgggttcacgccattcttctgcctcagcctctccgagtagctgggactacaggcgctgggcaccacgcccggctgattttttttttttgttttttttgagaccgagtcttgctctgtcacccaggctggagtgcagtggtgctatcttggctcactgccagctccgcctcctgggttcacgccattctcctgcctcagcctccccagcagctgggacacaggtgcacgccaccacacctggctaatttttttgtatttttagtagagacggggtttcaccatgttagccaggatgacctcgatctcctgacctcgtgatccgcctgcttcagcctcccaaagtgctgggattacaagcgtgagcccccatgcccggtcctaaggtttatttattaacaaaatggtttttatttctttctctgttatcgtcgtggagatgatttctcatttgggataatattttttagttttcaattatattttgtcaacatttaaaaagcaaagtaaagaatatttcttgggccaggcatgttggctgacgcatgtaatcccagcattttgggaggctgacacaggcaaataacttaaagtgaggagttcgataccggccaggtcaccgtagtgataccccgtctctatgaaaaatacaaaaattaaccgggcatcgtggcacgcgcctgtaatgccagctgctcccgaggctgaggcaggagaatcgcttgaacccaggaggcagaggctgcattgagttgagatctcgccactgcactccagcctgggcaacagaaatactgtgtctcaataatagtaataataataataataataataaagtaatagatctcttccacaaatgtgctgggacaactaactggatatccacatggaaaagagtaatgttggatccctatgtcacaccatcaaaaattttatttaaaaaagttttttttttttttttaaaaagggaaaaggcccgggcgcggtggctcacgcctgtaatcccagcactttgggaggccgacgtgggcggatcacctgaggtcgggagttcagcctggctaacatggtgaaaccctgtctctactaaatatacaaaattaactgggcatggtggcgcatgcctgtagtcccagctactcgggaggctgaggccggagtatcgcttgaaaccaggaggcggaagttctagtgagctgggatcactccacggcactccagcctgggcgacggagtgagactctgtctccaaaaaaaaaaaaagggaaagagagagagagagactaggaagggagacctgccgcagtgggtgttactttgtcgcccaggctggcttgggaccccaggctcagcaattctctccgttgcttcctgagtagctgggacctgaggctcccgcccccgcgcctctgctgtgtttaagcagcaggtggtgacctcactccttcctggcctaagcactccgtcccgcacccctggcggtggctttaaggaagtctctgaagctgagctcagggtggactctccctccctagtgaatggagatagaaagggagaggacatctattctgttccgtgggccgtcaccatgacatcgtacatgccgcccaggcagggctttgcatttcacattctagtttgcatcccggttccagacaattccagggctttggaatcatgcctcagactttctggcgctctcgcctccacaacctaaaaacagagacgctaggagagaggctgaaagacgcgcaagtcccgccccggccccgccccggccccgccctctgccggttctaaagggcaaggtctcagcgcctcgcgccccgccgctacctcgcccaggccccgcccacctcctcccacctcccgcccaggcctggcttccgtcctgcgcgcggagattaacgcaaacccggaagcggatcgggtggagtgaaggtcacgtcgccatggtgagttttgctctgtgttgcattaagtctccgcttcccaggtccccgccgcttctgtccctgggacgtggggtccccacagacctggaaattctcgcccgtcttccttcgcccagagcaaattgagacagcccagtgagaggccgggtgtcgcttcctttcgggtttaaagtcgtctggaggctggtcccgtcccgggtctgtctgctatagggcaatgtatacactttctattgcgtagtttttctgctcaaaaccttcttctgactcttccctcctcgcgctatttaaagtcttcacccacgaggtggattcttgcccggggcgcacctcccagccacccctcgtcggcccctggagcgtcgcgccgcagccccagtcccagggaggccgcgtcctctgcctggtcctgggatcttgcagaccccatccttctcccaaggcgccgtcccccctcctcccacctccctactcgtgccagagcctgcggctccccaggtctctcctccgcagtcaccgcttccattgaacccacactgggaaggacgcagggccctgtcctgtgacatggggtcttcttgcctgccgagctccagcccttggaaaacgcgctcctccgggatgcaggcgtcttactccaaaccctcctgcgattgtgtgggccgaagggatcaggagacagacagcagtagaaaacctgagacagagaaagaataagaaaggcccataacagatggcaaaatagaggattggtgagggatatgccaagatatggtgaaagtggaaaaagaaagcaacaaaatacctagaaaagcaggtggagaaaagcaactggagaaatgtagagaaaagctagatgtacacagagatgaaggacggcaaggtagggagagtggcagcaaagagggaggctcatcagagtgagggagagagggagggatttggagccagggcagacagagcagagtggtgctggtgtcaaggagaaccgagggagaaacacagcagggaggacacctggggatctggggtgacacagagtggggacaggggagtatatcagggaagagagaatttaacagggagagcagaggaggcgcagagatgggtgaagaggcagaaatagatggagattgaggacgattgaaagattggggagaaggagcaataagaggttaaataagttgcgaggatggagcagaagagatggaagagaaggaatagagggaagaagggggataaacagcagaagagaagaggggtacaaaatgaagagcagaatcccagggagaaagaaaagaaaacaagagctagagagagaagggggagaatgagagatatgtacagaattagggagggaagcgcagtaatgaagaaaggggggctaggcacagtggctcacgcctgtagtctccacactttaggagactgaagcaagagaattgcttgagtctaggagttcgagaccagcctgggcaacatagtgagacccctatctctgccaaaaaaaaaaaaaaggaaataacggggcataatcgtgtgcacctgtactcccagctgctctggaggtggaggtaggaggatgacttgagctcaggaggtccaggctgcagtgaactgagatcatgccactacactgcagcctggtcaacagagcgagatcttgtctcaaaagaaaaaatggggcgagagactgggtttagatcagtggatgagttcattggatatgattagttgtgacatgttgacttccctgtatataatctaataactaaaaacttgtttaaattatacagattgagaattttaaaattggtgtctataaaacatgtacattctataaatcttggcatcagaggttatgttccacttggaatccctattcaaccagagggaagtgacttattcagttgtgaatcactgtcttcccttttcctaggattgggaggatgtggggtagagaagtgggaaaaaagtcgctgtctgttattacataatacttttaatttaattaattaaatgatattttgagtcagggtctggctgtatcacacaggctggagtgcagtggcgtgatcctctaactgtagcctctacctcttggactcaagtgatcctcctacctcagccttctgagtagctgggaccagaggcatgagccaccaagcccagctagtttacatatatatatatatatatattttttttttttgtagaaacgtggtttcactatgtttcccaggctgttctcaaaaccctggggtcaaagggtcctcctgccttggcctcccaaattactgggattacaggtgggattacagggatggcccaccgcgtctggcctacatagccccccccttttttttgagagggagttttgttctttttgcccaggctagcgtgcgatggcatgatctcagctcaccacaacctccgctccctggcttcaaacaattctactgcctcactctccagagtagttgggagtacaggcatgcaccaccatgcctggctaattttgtgtttttagtagagacgaggtttcttcatgttggtccaggctggtctttaactccctacctcaagtgacccgctgcctcggcctcccaaagtgctgggattcctggcgtgagccaccactctcaacccatagtagtttttaaaagggacatcaaggcatggtggctcacgcctgtaatcccagcacgttgggagacagaggtgggtggatcatgaggtcaggagttcaagaccagcctggctgacacagtgaaactcaatctctactaaaaaatacaaaaattagccaggcatggtggcagatgcctgtaatcccagctactcaggaggctgaggcaggagaattacttgaacccgggaagcagaggttgcagtgagccgagattgcatcactgcatgccaggctgggcaacggagctagactccatctgacaaaaaaaaagagagaaagaaaaagtaaggaacatcaaagttgggcctggtggctcattcctgtaatcccagcactttgggagcaaatcactgaaggccaggagctcgagaccaacctggcctacatggtgaaaccccgtctctaccaaaaatacaaaaattagctggccatgtagacatacgcctctaatttcacctactccggaggctgaggcaggagaattacttggacccggctgggaggcagaggttgcagtgagccatgatcacactactgcactccagcctgggtgacagagtgagactccgtctccccgccccccaaaaaaagaaaaattagccaagggtggtggcatgcgtctgtagtcccatctactcaggaggctgaagcaggagaatctctttaggcaggagaatcatgccactacactgcaagctgagtgacagagtgtgacttggtctcaaaaaaacaaaaaaagaaatagcaatcagctctttaatgtctccctttatataagcagtagtcctggccatgttcggtggctcacacttgtaattccagcactttggaaggctgatgtgggcgaatcacctgaggtcaggggttcgagaccagcctgaccaatatagagaaacccggtctctataaaactacaaaattagtgtgtaggtgtggtggcgcgtggctgtaatctcagctactcgggaggctgaggcaggagaattgcttgaacctgggaggcaaaggttgtggtgagccaagatcgcgccattgcactccagcctgggcagcaagagggaaactccatctcaataaataaataaattaattaattaattaataataaaaataaaagcagacgtattcacgtgtagtcaacacgcatgaccaaattctctcacaggcaccatctgcaggaacatcctattggacaataagaactctgaacatcgcttttggccaatataaacattcagaccaggaagtctgcatcatatttttgatgtttttattgtgcaatttgttttatacaatgttttctgtgatctcagtttataaattttcccagtacacattctatgttttatattttacacacagtaactagataactaagggcaatgaatatatataaaattgctgtattgcctggtgttatgtaactgtacttgtgacattgtaattgcaccctctgacactgttagtcagttcttattccttttaatgctgtgtatttacttgaactcatacatcagaaggtagtgatcttaacatgtatttcagtcttatagtgtgtgctggtggtaagtagaagttgtggcttttttcttgagagagaattgtttagaattctgcaggctgtataaatgtacttattatttgcttgctggttttatcatgggttagaatagtttactgattaatatttaagatttcacatatggcttttcagtatatgatatgtaatggaactgacacactgcacttgttaatttcaataagtgcctgttctgcgtggatttaggtaattttatgacaggtattcagaaaaaggttgtattaacatttttttttttttgagatggaatctcgctctgtcactcaggctggagtgcagtggcacaatcttggctcattgcaatctctgcctcccaggttcaagtgattcttgtgcctctgcctcctgagtagctgggactacaggtgaccgccaccacgcctggctgatttttggaatcttttcttatcttctctgtgctacgattatttgataatacagaatttcaattgattttggttacccttacataagcttctggtggattatttaccaatataatatattgtgtggtcttttaggatttatttgtgtacagtagatattgtgtaaatatgaaggatctatacttttcattgatgtgacagtgatatgttttttgcaaactgtgatacattttagggtcacagtggaaaaatactccttactttaggcttacacatgtttgtgccctgtcagcgttttgtcatattggaaataggcttccatagaaatgatttgaagtacacgtaaagtatttattaagtatttattaaagaatcttactccttttgtgttcctaaactttgaagatcatgtttgggaagttcaaaataagtattgttttttgtgtcatatttacacatttcagtatgttttaccttctggacttaattggaaacgtattggtgtttatattttgtagatatctcttccaaatgcttgatgaaaaaggtggaagggtcacttgacccagggagttgaaggctgcagtgagccctgtttttgccaccacactccagcctgggtgagtgagctacaccctatctcaaacaaacaagccaataaatgagaggtataattcctcctttgaaattaaagaaggagattttctttcctttcatctcttttcttaggacatttattagaaaatttgcaagtgcattttctgttttctgaggtagtatgttttctttcttttcttttgtttaattttcttttatttccttttctgttgttttcttttctttcctttccaacggagacacagtttcgctcttgttgcccaggctggagttaaatggtgcgatctcggctcactgcaatttccatctcccaggtacatgagattctactgcttcaacttccagagtagctgggactacaggcacccgctataatgcctggctaatttttatagttttgtagagacggggtttcaccatgttggccaggctggtcttgaacttctgatatcagatgattctccagccttggccttccaaagtactgggattacaggtgtgagccactgcgcccggcccagggatgtatttctgaagaacttgggagctccttgaaaggcaaacaacagccacgcgcagtggctcacgcctgtaatcccagcactttgggaggccaaggcgggtcaatcccgaggtcaggagttcgacaccgcctgacaaacatgttgaaaccctgtctctactaaaaatacgaagaaattagccgggcatggtggcacatgcctgtagtcccagctactcaggaaaattgtttgaacctgagaggcagaggttgcagtgagccaagattgtgccactgcactgtagcctgggtgacaaagtgagactccgtctccaaaaaaaaaaaaaaaaaaaaaaaaggcaagcaacaagatagattgtacctgtgtctcagtaggaaattaagtaattcaaacatcaaatgattccaatttaaagctatggacatttaaataattctgagccttgagaggaatgtggtcatgcaaccagagtctagtggaatgcaggtgcaacttctaggagttttcctggctgactgtcatggctcaagcctgtaatcacaacactttgggaggccgaggcttccggatcacttgaggtcaggatttcaaaaccagcttggctagcgtggtgaaaccctgtctctactaaaaatagagagaaattacaggcgcctgccaccatgcccagctaatttttgtattaggcttagtgttagggtttctccccctccctcgggatgaagcttgttagctgacagagatggtcacctccattaccaagtagagccaggatgaactatgtgtgaccaagggcttttcaagtcctcttccctgaggactgattactgtttatcttgaaaacatgtccttaatgggttgtatagaacactgaagtttctttctctcttttcaacctcttagctgtttgcctctatttcccatcacattctggtctaaagcttatttattaatgaagtagtttttctttctttctctattatcgtcgtggagatgatttctcatttgggggaagactctttgtttttcaattatattttctcacatttaaaaagtgaagtaaagaatatttcctgggccaggcatggtgactcacgagtgtaatcccagcactttgggaggccgaggctggcggatcacttgaagtcagggttctagaccagcctggccaacatggtgaaaccccgtctctaccaaaaatatgaaagttagctgggcatggtcgtgtgcgcttgtaataccagctactcgaaaggctgaggcagaagaatagcttcaacccaggaggcagaggctgcagtgagccacgatctcgcaactgcaccccagcatgggccacagagaaatactctgtctcaaaaataaaaggaaagaaaaaagtaaaaaaagagaaagtaatagatctctttcacaaatgtgctgggacaactaactggatatttacatggaaaagaataatattggatctctatgtcacaccatgaaaaattttatttaaaaacgggttaaaaaaaaaaaggctgggcggggtggatcacatctgtaatcctagcagtttgggaggctgaggtgggcggatcacaaggtcaggagatcaagaccatcctggctaacatggtgaaaccccatctctactaaaaatacaaaaaattagccgagcgtcgtggtgggcgcctgtagtcccagttactccaaaggctgaggcaggagaattgcgtgaacccgggaggcggagcttgcagtgagccaaaatcgtgccactgcactccagcctgggtgacagagcgagactccgtctcaaaaaaaaaaaaaaaaaaaaaaaaagagagaaaaggaaaagagcgagggagagacgagggagggagccctgcgggagggggtgttactttgtcacccaggctggcctggacccccaggttcagcgattctcccgccgctgcttcctgagtagctgggacctcaggcttccgccccgtgcccgcatccctgctgtgtttaggcagcaggtggtgacctcactcctccctggcctgagcactccgtcccgcatcccaggcggaggccctagggaagtctctgaagctgagcacagggtggaccctccctcctgaatgaatggagaatagaaagggggaggatttctgttatgttctgtgggccatcagcatgaaatcgtatattccgccccggcagggctttgcatttcacattttagtttgcatgcccgttccagacaattccagggcttttgaatcatgcttcagccttcctggccgctctcacctccaaacaccgaaaaaaacaggcgctgggtgcgaggcggagggatgcacaggtcccgccccggccccgccctctgtcggttctaaagggcaaggtctctctgcctcgcgccccgcctctaccccgcccaggccccgccaaactgttcgccggccccgcccaggcctggcttcagtcctgggcgcgcaaaccccgaggcggatcgcgtggagtgaaggtcgtaccgcggcgcgtgagttttgctctgccttgtattaagtttgcgcttcccaggtccctggcgcgtctgtccctggaaagtggggtccccacggacctggaaattctcgcctgtcttccttcatccagagcaaattgagatgtccccgtaagagtccggaagttgcttgcttttgggtttgaactcgtccggaggctggtcccaaccccggtctttctgctatagggcagtgtatacacttcctgtcgcttagttttcctggtcaaaaccctgtgctgactccacccaccccgttctttttaaagtccccgacccgcgaggtggattcccgccctgggcgcctcccagcctctccgtcttcggcccctggagcgaagcgctgtgtccccagtcctggggaggctgcgtcttctgcctggtcctggaattctgcaggtgccacccttgtcttaaggcgccgtcgccccctacatcccccctcgtggtgggccctgctgctccccaattcttcccttcgcagtcaccgcttcccctgaaccagcgtagggcaggtcccagcggcttgtcctatgacaccgggtattcttgcctgcccagctccaccctccggaaaatgcgcttctccgcgatgcgggtgtcttaccccaaacccgcagagtggtgctggtggcaatgagaacagagggagaaacacagcagggaggacaccgggggatctggggtgctagagagtggggacaggggggcgtaacagggaagagagaatttaacagggagagcagaggagacgcagagataagaggcggtaatatgtagagattgaggacgatcaaaagattggggagaaggagcaacaagaggttaaataaggaccgggcgctttggctcatgcctgtaatcccagcagtttgggaagcttaggcgggcggatcacctgagatccggagttcgagaccagcctgaccaacatggagaaaccccatccctgctaaaaatacaaaactagctgggcgcggttgcatatgcctgtaatgtcagctattagggaggctgaggccagagaatcgcttgaacttgggaggcggaggttgcggtgagccgagatcgcaccattgcactccagcctgggcaacaagagtgaaactctttctcaaaaaaaaagcggttaaataagttgtgaggatggagcagaagaggtggaagaggagtaatagagggaagaaggggataaatagcaggagagtagaggggtacaaaatgaggagcacaatcccagggaaaaagaaaagaaaacaagagctagagagagaaggggagaatgagagatatgtacagaattagagagggaagcacagtaatgaagaaagaggggccaggtgcagtggctcatgcctgtaatcccagcactttaggagactgaggcagagggattgcttgagtccaggagttcaagaccagcctaggcaaaatagacaccccatctctttcaaaaagaaagaaaaaattaacggggcatgatagtgtgcagctgtaatttcagctactctgtaggcggaggctggaggatcacttgagcccaggagctccaggctgctgtgagcagagatcatgccactgtactccagcctggtcaaaagagcaagaccctgtctcaaaaaaaaaaaaaaaagggtgggggactttgggtacagatgagtgtgtgagttcattggatatgattagttgtgacatgttgacttctgtctataaaatctaataacttgtttaaattatacagatgagtttgagaattttaaatgtcctatctgtgagccatgtatgttctataaatattggtatcagaggttagcttccacttggaatccctattcagaccgagggcagtgacattcaattgtgggtcactcttcccttttcc

SEQ ID NO: 500 - DNA, 14908 bp, Homo sapiens
aaaaaaatccttgtgaagacttgtcaatccctttcttatcctacctccacaatgagtctacataatctgtaagcttatcccacccttctcctaattcaacatgagaaaatatgcgaagcatcatgcctctgatgaaaaatgggatatttggaaagtttctattttgctaaatgagttccctaccttctacatcttctgctccaccatctacccttgtctctgcgctgtccctcctgctctatatagacacatgcacacgtatgtttattgcggcactattcacaatagcaaagacttggaaccaacccaaatgtcaaacaatgatagactgggttaagaaaatggcacatacacaccatggaatactatgcagccataaaaaatgatgagttcatgtcctttgtagggacatggatgaagctggaaaccatcattctcagcaaaatatcgcaaggacaaaaaaccaaacaccgcatattctcactcataggtgggaattgaacaatgagaacacatggacacaggaaggggaacatcacccaccgggactgttgtggggtgggggaggggggaggggggagggatagcattaggagataaacctaatgctaaatgacgagttaatgggtgcagcacaccaacatggcacatgtatacatatgtaacaaacctgcacattgtgcacatgtaccctaaaacttaaagtatcataataataaaattaaaaaagagacaataatccagattaggccttttgtaatctttctgtgagttcagaagttaattgtaaagagttgacaggtttttcttgttgaaaaacatcagacattccttgtgtgtaaccattaggttttcatttgatattacataaggcagcttatggaccttattgatttaatgagccaaaatgtatgtgcctcgtaaagcaagtcaggacatacatttttataacagtttggagaacaacatatctttgaagcatgtggcctggattttgaggccacattgctaccgtatctctcatctctgagaaactctatttgtttagtttagcttttgttttaaatgtgttttcctaatttgctatttaatataaacaggaaatttagtactgcaaggagcataaaactgatatggattttgaattacataatttcatgtcaaataaaacaaaatttacattctataggcatgaaacacttaatggcattaggatatagaacaaaaacctttacaataggtaactttagttaacttgtacatatttgtgagaacatcttatatatttcctagtatttcctactttcccttattgaaaagtaatcttattagagacttctttttcagttgcccaatatcctcatacactgatgcagtacatgccaatagtacaaccaatacaaaggggaaattgtcaaatccagaaaattcacagatacgtttaccgtttgaaacagcaatcccatttctaagaagctatcttaaagttacagctagaaaagtatgtaacatgtcccaactcattaattgtaacactatttgtaatggcaaaaaaatggaagcaagtctaaatgtctatcagtagggagggagttgaataagttattatattatcccacagtgaagtatatgcaaccatatgtaaaatgaagaggatgtctgcataatgataggttgtgatcatcaggatccattaagtgaaaaaggcaaggtgcagatcactgtatatagcaagctatgttttgtaaaataaaaaagagaaaaatgtaaatatgtatgtatttcttgtatttgcagaaagaaatattggaagagtgaactgaaagcaaaaattactactataaatgcactggcaataagggtgaaagggttaagatgaaagccaaattttttgagtatatatatatatataacttaatgttttacatatttagaatataatacatagtttaaaacaacattaaaaagcacttgtcaattacagaaacaaatgttgcaggaagtcttcactttgcaagttgattgttgaggaaagaattgactcttcaactcagtttattgtataaactgtatataagaataatcatatggttcttgttaataaaataaagctctttttggagaaaaatgtcagctagtaggatcatttttcaactctatgaaataattgacaggcaatcaatgggcaatcactaatggatactaaaataattgagtgaaagattgatagaaaactgaacattcacacagggtccaagtaccccttcctggtacttgtgcagtagcacaccaaaagaggaaaaacaaccaaacgtgatcacttgaaacctgtagtcaggtttcatcatcaatagcaatgtgttgtccaattcacaacaagcaggtattaggtttatcctgatgtaatatgacataaagtacacagcatgacataaagtacacagcatcacctatgaagtattcttgccaaaatgtttaacctgagtttcatgaagattttaagtctaattatcagtttacatgaaattaaacatggtaattagacagcatattttaggggcaattaggggacataagaacacattaaacgagagcagggagaagcagtcagaccaatgcagaaggtgggacactctacaagatctgtggcctgttctaacaagtaaatttctgacaaagataaagaggttgtgataggaaatcaattctagtttagacaaacaaactctataatacattatgaaaaaattaaatgtggactaaatattagatggtattaaagaattattaattttatcaggattgatcatggtattgtgattaggtaggaaaatgtctttttgtcagagatgcaccctgagatattcaggggagaaatgccatgtcgtctacaatttatttaaaatatctaaaaataaacggataagaatttgaatatgatactaacaatcattaaacctgtgtgatgagcatattgagggggtgggtcaaaattttattctttctaccattatgtatgtttctaattttttatttaacgaaaaactaaaaattaaaattgaaacaaagaaacagcaattggctatgactttcctgggcccattttcccttcctgatggccaggagagagcgagagctgaagcagctgccttgaatttataagcagaaacctccagttggcagagcggtgccagccctgggccaccagcgctaaatcaccaaatcacctgcctacccagggaaagataattattataatcaagtcattgaaaaaacatttttaaaaaattgtgttgtaacatttcagaatatattgagatgggatttccactgtacatctcagaagtcccactctcccctcatacaccttcgagactaaatcttaggccttctgagacatgcaagagtgggagcacatggaaagactcactgcaacactggagcattgttaattcctaacaacagttgccagagagtttctttgatttacctcactaatgatgaaatgaagttcctccatgtaggtggcttataaaatagaaaggaagctggcttgaggactcagtgtcctcaattatttatttacataaatatcttttccaaacagtaaattttgtcaacactgagaaaggagaattgtaataaccagaagtatgtggatataagacagctgttttttttaaaaaaacaacacgaataaaaaacgtgtgaaatatcttcttggcagggtcctgagtgccataaatttctaggcatagtttgtaataagtggtagaaatgatagttaaatatttcatttgtttggaaactgttcttaattctatcattataggaccatttatttggtgctataaaatttttatattttaagaagcgtttgatgtgtctgacatgtagtaaacagcacccaattctcaaacagcacacctcttatttttttttaattatactttaagttctagggtacatgtgcacaatgtgcaggtttgttacatctgtatacatgtgccatgttggtgtgctgcacccattaactcgtcacttacattaggtatatttcctaatgctatccctccccccacccacaccccactacaggccccagtgtgtgatgttccccaccctgtgtccaagtgttctcattgttcagctcccacctatgagtgagaacatgcggtgtttggttttctgtccttgcgatagtttgctaagaatgatggtttccaatcatccatgtccctacaaaggaaatgaactcatcttcttttatggctgcatagtattccatggtgtatatgtgccacattttcttaatccagtctatcattgttggacatttgggttggttccaagtctttgctattgtgaatagtgccacaataaacatacgcgtgcatgtgtctttatagcagcatgatatataatcctttgggtatatacccagtaatgggatggctgggtcaaatggtatttctagttctagatccctgaggaatcgccacactgacttccacaatggttgaactagtttacagtcccaccaacagtgtcaaagtattcctatttctccacatcctctccagcaccagttgtttcctgactttttaatgatcgccattctaactggtgtgagatggtatctcattgtggttttgatttgcatttctctgatggccagtgatgatgagcattttttaatatgttttttggctgcataaatgtcttctttggagaagtgtctgttcatatcctttgcccacttgtcgatggggttgtttgatttttttcttgtaaatttctttaagttctttgtagattctagatattagccgtttgtcagatgggtagattgtaaaaattttctccaattctgtaggttgcctgttcactcttatggaagtttcttttgctgtgcagaagctctttagtttaattagatcccatttgtcaattttggcttttgttgccattgcttttggtgttttagacatgaagtccttgcccatgcctctgtcctgaatggtattgcctaggttttcttctagggtttttatggttttaggtctaacatttaagtctttaatccatcttgaattaatttttgtataaggtgtaaggaagacatctggtttcagctttctacttagggctagccagttttcctagcaccattaattaaataggggatcctttccccatttcttgttttcatcaggtttgtcaaagatcagatggttgtagatgtgtggtattatttctgagggctctgttatgtttcattggtctatatgtctgttttggtatggcaccatgctgttttggttactgtagccctgtagtatagtttgaagtcaggtagggtgatgcctccagctttgttctttttgcttaggattgtcaggtaatgtgggctcttttttggttccatgtgaactttaaagtagttctttccaattctgtgaagaaagtcattggtggcttgatggggatggcattgaatctatatattaccttgggcagtatggtcattttcatgatattgattcttcctatcctagagcatggaatgttcttccatttgtttgtgtcctcatttatttcgttgagcagtggtttgtagttctcctatgtccttcacatcccttgtaagttggattcctaggtattttattctctttattcagcaattgtgaatgggagatcactcataatttggctctctgtttgtctgttattggtgtataggaatgcttgtgattttttgcacattgattttgtatcctgagactttactgaagttgcttatcagtttaaggagattttgggctgagatgatggggttttctaaatatacaatcatgtcatctgcaaacagggataatttgaattcctcttttcctaattgcataccctttatttctttctcctgcctgattgccctggccagaacttccaacactatgtagaataggagtggtgagagagggcatccctgtcttgtgccagttttcaaagggaatgcttgcagtttttacccattcagtatgatattggctgtgggtttgtcataaatagctcttattattttgagatacatcccgtcaatacctagtttattgagagtttttagcatgaagggctgttgaattttgtcagaggccatttctgcatctattgagataatcatgtggtttttgtctttggttttgtttatatgatggattacgtttattgatttgcatgtgctgaacaagccttgcatcccagggatgaagccaagttgatcgtggtggataagctttttgatgtgctgctggatttggtttgccagtattttattgaggatttttgcatcgatgttcatcagggatattggtctaaaattctctttttttgttgtgtctctgccaggctttggtatcaggatgatgctggcctcatgaaatgaattagggaggattccctctttttctgttgattggaatagtttcagaaggaatgttaccaactcctgtttgtacctctggtagaattcagctgtgaatccatctgatcctggactttttttggttggtaggctattaattattgcctcaatttcatagcctgttattggtctattcagggattcaatttcttcctggtttagtcttgggagggtgtatgtgtccaggaatttatccatttcttctagatttaatagtttatttttgtagaggtgtttatagtattctctgatggtggtttgtatctttgtgggatcggtggtgatatcccctttatcattttttattgcatctatctgattcttctctctttccttctttattagtctttctagcagtctatcaattttgttgatgttttcaaaaaaccagctcctggattcattgattttttgaagggtgttttgtgtctctatctccttcagttctgctctgatcttagttatttcttgccttcggctagcttttgaatgtgtttttctcttgcttctctagttcttttaattgtgatgttagggtgtcaattttagatctttcctgttttctcttgtgggcatttattgatataaattttcctctatacactgctttaaatgtttcctagagattctggcatgtcgtgtctttgttctcattggtttgaaagaacatccttatttcttccttcatttcatgatatacccagtagtcattcaggagcaggttgttcagtttccatgtagttgagcagttttgagtgagtttcttaatcctgagttctggtttgattgcactgtggtctgagagacagtttgctacaatttctgttcttttacatttgttgaggagtgctttacttccaactatgtggtcaatattggaataagtgtgatgtggtgctgagaagaatgtatattctgttgatttggggtggagagttctgtagatgtctattaggtccacttggtgcagagcagagttcaattcctggatatccttgttaactttctgtctcattgatctgcctaatgttgacagtggggtgttaaagtctgccattattattgtgtgggagtctaagtctctttgtaggtctctaaggacttgctttatgaatctgggtgctcctgtattgggtgatatatatttaggatactgagctcttcttgttgaattgatgccttcaccattatgtagtagccttcttttctcttttgatctttgttggtttaaagtctactttatccgagactaggattgcaacccctccttttttttgttttccatttggttggtagatcttcctccatccctttattttgagcctatgtgtgtctctgcatgtgggatgggtatcctgaatacagcacactgacgggtcttgactctttatccaatttgctaatctgtgtcttttaattggagaatttagcccatttacatttgatgttaatattgttatgtgtgaatttgttcttgtcattatgattttacctggttattttgatcgttagttgttgcagtttctttctagcattgatagtctttacaatttggtatgtttttgcagtggctggtatcagttgttcctttccatgtttagtgcttccttcaggagctcttataaggcagtcctggtggtgacaaaatctctcagcgtttgcttgtttgtaaaggattttctttctccttcacttatgaagcttagtttggctggatatgaaattctgggttgaaaattcttttctttaagaatgttgaatattggccctcatctcttctggcttgtagagtttctggcgagagatccactgttagtctgatgggcttccctttgcgggtaacccgacctttctctctggctgcccaaaacattttttccttcatttcaaccttggtgagtctgacaattaagtgtcttggagctgctcttctcgaggagtatctttgtagcattctctgtatttcccaaatttgaatgttggtatgccttgctaggttggggaagttctcctgcataatatcctgcagagcgttttccaacttggttcctttttcccccttcactttcatgtacaccaatcaaatgtagatttggtcttttcacatagtcccatgtttcttggaggctttgttcgtttctttttactctttttcctctaaacttctcttgtcacttcatttcattaacttgatcttcaatcactgataccctttcttccacttgatagaatcagctactgtagcttgagcatacgtcacgtagttcttgtgccatggttttcagctccatcaggtcattttaggtcttctctatgctgtttattctagttagccttttgtctaatcttttttcactgtttttagcttctttgtgatgggtttgaacatcttcctttagctcagacaagttttttattaccaatcatctgaagccttcttctctcaactcgtcaaagtcattccccgtccagctttgttccattgctggtgagtagctgcgttcctttggaggagaagaggcgctctgatttttagaattttcagcttttctgctctggttccccccatctttgtggttttatctaccttcggtctttgatgatggtgatgtacagatggggttttggtgtggatgtcctttccgtttgttagtattccttctaacagtcaggaccctcagctgcaggtctgttggagtttgctggaggtccactccagaccctgtttgcctgagtatcaccagcagaggctgctgaacagaaaatattgcagaatggccattgttgctgcctgatccttccctggaaacttcatctcagaggtgcacccggctggatgaggtgtcagtcggcccctactgggagttgcctcccagttaggctactcggggtcagggacccatttgaggaggcagtctgtccattctcagatctcaaactctgtgctggtagaaccactactctcttcaaagctgtcagaaggggacatttaagtctgcagaagtgtctgctgccttttgttcagctatgccctgcccccaggggtggagtctacagaggcaggcaggcctggttgaactgaggtgggctccatctagtttgagcttcctggccactttgtttacctattcaagcctcagcaatggaggatgcccctcccccagcctcgctgctgccttgcagttggatctcagactgctgtgttatcagtaagcgaggctccgtgcacgcctcttatttttaatgttcggtttgcttcatgagtccttgtgtcgaatactattctgggcaatgattattcattaatacaaataaacattagattataggaagagtaagcttcccatgataaccgaagttattatcagatcctaaaagcaataattaaaaaccctgttcccaggtagaattgtaaagtggatgactcctgcatccagcattctcccattcatttttagagccatccaactccctcagtcacttcactgccattccctttcccaagccccggctgccgtctagatagtcagagcttcttggcccattgcaagcactcatcatgatgtttagccaccaacccagcattgtttggcatctttctaaatttcttggttttcactcaaacctcccataatccaaatgatgactgctatagaattccatcagaagacttatgaagacaagtgatttgacagcaaagagtcagaattcttaggttacagtggcaaaatcctgtaggctccatgtctgtcatatattgctatttgttcagtcttactttgatctactcactaaacaattcatcctctatagaactgagggtgcaaaggtggttggtagtgggttaaagaggaaagtcaaatcagaaatgaagaagaggttgaagagaccacatgtagattaaaaataaacttttttggggcattgattttcatttagtcacaatatttttattttcaaataacattaaagaaaaacaaacagtctttatgttttttaaaggagaagcagagaaatattacactattcctagtcaaaagtaatgttagcaggaatgtctagactatttctatgtgtttatttctctttattttagttaaatgatagatttactcacttgcaactaactcttgctatatttctcccatttcaaaattcttaaactattgtagctaaaaattgtatctattttacttagctgcctttggtagcatttgaaagtgaatgcaaaatttctggacaaaatagaaacaggtacatgggctaatataggaatatacacaatactgttaactgtcccaagatttttcattgattatgtcttccatggtgagatttcaggcataaaattggtttgggttagtacaaagtctggcccaacatatgcttacttgtagttcttcctaataagtcaaacaagctcacatttatggtgctgaatatattctagattcattgtatctgtagttgctaaaaatttagttccatgccttaggatggtattagaatgtccatgataagaaaaataagtgcagcaaaataaaagaaatgccacgcctatctttctgtattattttttccactggagaaggacagattttactcattaaaactacaaaagtctgagaccaactgctccatattcttttgtgttcgttaaatgttgttatttggaggtgacttaattagactaaagctagaagagaaaacaatagaatgtcaaagatgcttttcaagttgtaaactaatgttttaagttataaactacttgatactattttcttaattaaaaagatatttctgaatcgaaaagatcaaagcttctgagtaaatttagaaagcatttttttgtcatttacagaaaagggctttaagagcctatgttcctttggctttaagagctcttcactgtgacttcaaagtaatcattttcagattaataaactggagctcgtctttggaattatcagtttttcttttattacagaatctgaggttagccagaatccatctgcagaacatgaggcagaagggagaaacacctaacaaggtgaggccttccttaactattttaacacaagcaattaaccatttatactcacttaaaagcagacagctgggatgatggtgtctgctaaaaaaaaaaagtgtaatgaaatgttctttagttttttgatctttagtaaaatttcatcttcgtataaaattttattaaccattccactaacttgttacttctccactccacctccccactccctttagaatccttagtttgaagacataattctttaaatgatctgtctcagggaggggggatcttgttacttttaaggactgcaaatagcattataaactttgtttttatttttaaatacgaatatcgactgaagctctcaaatcaatcaatattgttgccaaattttgtaaaacgcactgtcttagctctctaacgatagagttctaatataaatgtaaaaaccaacctatcaacatgttttcaaaaatactttttgtaaagaacagtacaattttgtggtgtccaaatattcctttctttcttacaaaatattattggatctgtccagttcataaatattcctgccctctcttcctccctccctgcctctctctccctgcagtttttttgatgtttgttcttttctttccattttctagttattaattggttcaatggatgacctttgtgcgacactgttataccttatcagcctcgccagggcccccgcgccgcccaatcccagcaactctggttctcctgtgaccccaagccttccagatccctgggtttccccccacgggactgtcacattcttccccgccggagacgccagtcgcggggcctcctccctggggtgtgagcaggtcggcgcgccacacttctctaggtggccggacgcgcgcccagggaggagctggcggcggggcccaggctgttccggctgcggcacgccaggggatgtggttagccctgagcctggaggccgaaggtgggcaggcaacactcccaccatgtttcggaggagaatacactaggctagcctaacgacactcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggtctggaaagtcctggggaactcgcagggcacgggccgctgtcgcggttgggaggcgagggcgcagcgctggggttgtagattccaagacccctgagggtggctgtgttggtttctcgcaggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcaggtagagtatggggtgtggtctgcctatacagaatggcagcccacctgctttcatacccttttttttttctttaggataattcgtaactaatattttgggtgagtgaagtgtgcatgttaagagtacaaaatagttttatgattctatgctggtttaacaactgtctcctcccttcaggcacgtagtttcagaaaacttttatgaaatctctgcttcctaccattttgagacagggacagttttactgctattggttccttcagtgagtgcaagaacacacagagaacttggtcacttctaaattttatcagctctgacaaaatggtgaataggaaagttatctgacttcattgtgacacgtctacctacctctaattgtactttatcagggatgactacatttgcagaagagatatgtttaaaggaaggtacctgaattcctttcttcatgtctgctcttattttatactgtctgcaagctaggacttgcctagcaaggttgcgctcccacctgtgagccagaacgtgggctcttggcagactctaggagcctttctgtttcttcttcttatccttccatgcatccttttctttttttgactaagttctacccttcctcctccccctgccttggagttaggacatcttaggctacacgtattttcactgaactgtaaagaaaagcctggggtttagtggctaattagtaaagaagctaggaagatgggttgcttaatgaaatagaagtgaaatatgaaaaatgatacttatttggtgtaatctaaatggtttatgcagagtcttcttcaatggggaaggaaggtgcggaaagaggaagatccattgcaaggaccataatgaaaatatttaagtattttagattaatagatacataccaataccttgtataaagtttttaaactcacagaacaatatggaaaaatatatttataccctggtgatctctaaggtatagaacttttcaaataacctttatgatataatatttgtatatcaaaccaaagtgagttaggcagtatatggaaaatgggctagcccttcaaggctat

SEQ ID NO: 501 - DNA, 14945 bp, Homo sapiens
gatcttgattgatcaattgatcatttccacataactataattatctttctttgatctctcattttaaaacttaaataaatttttaaaaataaattttattgtatatatttaaggtatacaacatgatattatgagatatatttagatagtaaaagttactatagtgaaggaaatgaacatatcaatcatcttatataattatacactttagttgtttctgtggcaagagcatggaaatctactcatttagcatgaatcccaaatacagtacaattgtgttaacaatgtccttatgttgtacaatagactcctagactttatcccacatagctgctactttgtatcctctaatctacatctccccatttcctctctgtccctggtaaccactgctttgttctctatctctgtatatctgaatttttcttttagatttcacatgtaagtgagatcatgcaatattatttctgtgtctagcttatttcacttagcataatgtcctccatgttcatccatgttttggcaaatggcaagtctcattattttttaggactaaataatatttcactgaatatggaatattattctttatccattcatccattaacagacacttttagtttctacgtcttggctgtcatgaaaatgggagtccacatatccttatgtggtggtaatttcatatcctctgggtatatgcccagaaaaagggattgattgatggatcacttggtagttctatttttaatttctttcaaaatctccatactattttattttttttccttttttttttatttgacagtctcactctgtcatccaggctggagtgcagtggtgccatttcggcccactgcaacctctaccttccaggttcaaatgattctcctgcctcagcctcttcagtagctaggattacagtcaagtgccaccacacctagccaatttttgtatttttagtagggacggggtttcaccatgttggccaggctggtctcaaactcctgacctcaggtgatcctcctgccccagcctcccaaagtgctgggattacaggtgtgagccactgcacccagccgaaatctccatactattttctataatggctgcaccagtatgcgtttccatcaacagtgtacaagagttcccctggctgataaaagctggaaacatcttgaatcaacaacctaacatcacaattaaaagaactagagaaccaaaagcaaacaaaccccaaagctggcagaagacaagaaataaccaagatcagagtggaactgaaggagatacagaacgaaaaaaccttcaataaatcaatgaatccaggagttggctttttgaaaaaattaataaaagagactactatctagactaataaagaagaaaggaaagaagtatcaaatagacaaaatcagaaatgataagggggatatcaccactgaccccacagaaatacaaacaaccatcagagactactataaacacctctgtgcacataagctagaagaaatgtataaattcctggactcatacaccctccaaagactgaaccaggaaaaaactgaatccctgaatagaccaaaaatgagttctgaaattgaggcagtaataaatagcctaccaagcaaaaaaaaaaaaaaaaaaaagcctgggactggatggatttacagttgaattctaccagaggtacaaagaagagctaacaccatttctactgaaactattttaaataattgaaaaggaggaactcctccctaactcattttatgaggccagcatcatcctgataccaaaacctggcagagatacaacaaaaatataaaacctcgggccaatatctctgatgaacatcaatgcaaaaatcctcaataaaatactggcaaaccgaatccagcagcacatcaaaaagcttatccaccatgatcaagttggcttcatcaccaggatgcaaggttggttcaacataagcaaatcaataaatgtaattcatcacgtaaacagaactaaagccaaaaaccacacgattgtctcaatagatgcagaaaaggccttcaataaaattcaaaatccctttatgttaaaaactctaaataaactgggtattgaaggaacatacctctaaataataagagccatatatgacaaacccacagccaatatcatactgaatgggcaaaacctggaagcattccccttgaaaaccagcacaagacaaggatcccctcttttaccactcctattcaacatagtattggaagttctggccagggcaattaggcaagagaaagaaataaagatattcaaatagaaagagaggaagtcatattatctttgtttgcagatgacatgatcctgtacctagaaaactccattgtctcagtgcaaaagcttcttaagctgataagcaacttcagcaaagcctggggatataaaatcaatgtgcaaaaatcactagcattcctatacaccaacagcatgcaagcatagagccaaatcatgaataaactcacattcataattgctacaaagagaataaaatacctaggaataaaactaacaagggaagcaaaggacctttttgaggagaaccacaaaccactgctcaaggaaatcagagaagacacaaacaaatggaaaaacattccatgctcatggataggaagaatcaatattgtgaaaatggccatactgcccaaagtaatttatagattcagtgctattcccattaaactactattgacattcttcatagaattaggaaaaaaactattttaaaattcatatggaaccaaaaagagcctgaatatccaaggcaatcctcagcaaaaaagaacaaagctggaggcatcaccctacctgacttcaaactatattacaaggctacagtaaccaaagcagcatggtactggtacaaaaacatgcacatagaccaatggaacagaatagagaactcagaaataagaccacacacctaaaaccatctgatcttcaacaaccctgacaaaaacaagcaatggggaaaggattttctatttagtaaatgatgctgggagagctggctagccatatgcagataattgaaactggaccccttccttataccttatacaaaaattaactcaagatggattaaagacataaatgtaaaactcaaaactataaaaaccctagaagaaaatctaggcaataccattcaggacacaggcacaggcaaagatttcatgatgaaaatgacaaaagcaattgcaacaaaagcaaaaattgacaattggggtctaattaaactaaagagcttctgcacagcaaaaggaactatcatcagagtgaacagacaaaatacagaataggaaaaaatttttgcaatctatccatatgataaaagtgtaatatccagaccctacaaggaacttaaacaagaaaaaaaaaacattttaagaagtgggcaaatgacaggaacagatgcttctcaaaagaagacattcatgcagtcaacaaacatgaaaaaaagctcatcattgatcattagagaaatgcaaatcaaaactacaatgagataccatctcatgccagtcagaatcacgattgttaaaaagttaagaaacaacaaatgctgatgagattgcagagaaaaaggaatgcttttacattcttggtaggagtgtaaattagttcaaccattgtggaagacagtgtagcaattcctcaaagacctagaggcagaaataccatttggcccagcaatcccattattggatatatacccaaaggaatataaaccatcctatcataaagttatatgcatgcatatgttcattgcagcactgttcacaatagcaaatatatggaatcaacccaaacgtccatcagtgatagactggataaacaaaatctggtatatatacaccatggtatactgtgtagccataaaaagtaatgagatcatgtcctttgtctggacatggatggagctggaagccattatcctcagcaaacgaatgcagaaacagaaaaccaaacactgtatgttctcacttacaagtcggagctgagccataagaacacatggacacatggggcgggggacaacacacactggggcctatcagtggtgagagaggtgtgcgggggaagagagagcattaggagtagtgaatggatgctgggcttaatatctaggtgatgggatgctctatgcagcaaaccatcacggcacacgtttatctgtgtaacaaacctgcacatctgcacatcctgcacatacactctggaacttaaaatgaaagttgggggaaaaaaagaattcccttgtcttcatacccttgccaaaatgtgttatcttttgactttttgataatatacaccctaatgggtgtgaggtagtatcacatagtagttttgatttatatttccctgatgattaatgatgttgaccacatttgcatgcacatgttggcaattttcatgtcttctttcacaaaatgtctattcagggtattttgcccattttttaatcatgctatttgtctttctacatttgcatcttaaccccttatcaggtatatggtttgcaaatatttttccccaatttgtagcatgctgttttattttgctgattatttcctttgctgtgcagaagctttttagtttgatgtagtcccatttatttatttttgattttgtggcctgagcttttggtctgatataaaaaaaaaatcatttctgaggccaatgcccagcagattttcccctatgttgtcttctaggagttttatagtttctggtcttacctttcagtctttcatccattttcagttgatttttgtgcatcgtttaagatagggtccaatttcattcttttacgtgtagaaatccagtttttgcagcaccatttagtgaaaagactatcatatacccattgtgtgctgttggtgtctttgtaaagaatttgttgacagtacacatttagatttatttccgggatctttattctgtttcactggtctatgtgtctgtttttatgccagcaccatattgttttattatagatttgtaatataattttaactcaggaaatgtgatgcctccaactttttttttattttcagaattgttttggctatttggggtcattcatgttttcatacatatttttggaatgtttttttatttctgtgaagaatgaccttgggattttaacaaggattgtgttgaatatatagaatattgctttttgacattttaacaatataaatttttctgattcataaatacagtgtatctttccatttatttctgtctccttcaaattcttttatcaatgttttctctttcagtatacaaatgtttcactttctcggttaaatttattcctaaggacagatggtcctcaactcacaagttttaactttacaatggggtttaagacataaccccattgtaagctgaggagcatctggacttgtgatggtttgactcaacaatttttcagctttaatatgagtttatcagggtattgagtgcatttttgacatacaacattttcaacgtatgatgggtttatcagaatgtaaccccatggtaagtcagaaagcatcagtaattttttatggtaccataaatgaaattgtttttttcagttagattgttatttgtgtatgaaatgctagtacttctggtaccatgttaatttttccttttgcgactttactgaattcatttattagttctaacagttttttctgtggaatcattacacataagattatttcatctgcaagtggagatttttttttctttttgattttgatgtcttttatttcttttccttgtatgattgctcgtgctagtacttctggtactatgttgaacagaagtgacaagagtgggcatccttacctagtactggatctgagtggaaaagctttaacttttccccattgattataattgtagctgtgggtttttcataaatgttttttattatattgagaaacattccttttatgcctaaactgttgagagttttttttttaatcaagaattgatgttggattttgaaaaatgctttttctgtgtcaagatcattgtgtggtttttatctttcattctgttaatgtcatatattactttgattgatttgtatatgttaaactagccttgcatatcagaaataaatcccacttggtcacaatatataattcttttggtgtgctgttgggtttagtttgttatgttgttgggtttagtttaatcctcaatattttactaaggatttttgcatctgcattcgtcagacagattggtctgcatttttcttgtcttgtaatatctttgtctgacttaggtatcaaggtgatgtggtccttataaaatgtggttggaactattcattctacctctattttgtttaaaagagtttaagaagtatcattattaattctctgaaggtttggtagaattcagcttttataaaactatctgtttctgggcttttctttgttgggaagttttttgttacttctttgatctctttatttgttattggtctgttgttcaagctttctatttcttcttgaattgatcctggtaggttttagtttttgtttttttgttttgttttgttttattctgttttttaagcaatttatctgtttagattatccagtcgttggcatatattttttcgtagtagtcttaacgatccttttaatttctgaggtgtttcatttttttcgctttaatttatgattttatttattagtcttccctttttttcatttagaccagctaaaggtttatccatttttttttattttttgaaagcaccaactcttaattttattgattcttcctatgatttttctgttctctatttatgtttttatttttattattttcttctttctgctaatttggggtttaatttattcttcttttgttagttccttgaagtgtaatgttagattacttatttgagattctttttgtttttaatgtcggcatgtattgctataaacttttctctttgaactgcttttgctacatttcataggttttggtatgttgtgctttaattattgtttgtctcaagatattttttaatttctctttttatttcttctttgactcattggttgttcaggagcacgttacttaattatcatataattgtggattttcaagattcctcttattattgatttctagtttcatagcattatagtctgaaatgatattagatattatttcaatttaaaatttagtaagtcttgttttgtggcttatcatatggcctatcccagggaatgttccatgtgaactaaagaaaaatgtggcatattatcctgctgttaaagtaaagctctgtatatgtctgttaggtctaatgggtgaaaagtgcaattcaagtctagtatttcttttttaattttctgtctggttgatctatctactctttttaaattattttttattaattttgtgttcttttttattttaatagcttttggggtacaagtggtttttttgttacatggatgaattatatagtggtgaattctgaggttttagtgcatctgtcacctgagtagtgtatattgtacctaatgtgcagtttgtattcctagcctcactcccacgttcccccttctgagcctctaaagtttattatatcattctgtatgcctttgcatactcatagcttagctcccacttgtaagtgagaatatacaatgtttggttttctcttcctgagttacttcacttaaaataatggcctccaactccatccaaatatctgcaaaagacattatttcactctttttaatggctgagaagtattctatggtgtgtgtgtatatatatatgtgatatatataaatatatatcacactttatttatgcactcattaatcaatgggtacttaggttggttccacatttttgcagttgtaaatcatgttactataaacatacatgcgcaagtgtatttttaatatgacgacttcttttcctttgggttgacatctagcagtgggattgctggatgatctatccgttgttaaaagtggggtaataccagcactttgggaggccaaggcaggcagatcatgaggtcaggagattgagaccatcctggctaacatggtgaaaccccgtcttgactaaaaatacaaaaaaaaagtagctgagcatggtggcaggcacctgtagtcccagctacttgggaagctgaggcaggagaatggtgtgaacctgtgaggcagagcttgcagtgagctgcgattgtgccactgcactccagcctgggcaacagagtgagactctgtctcaaaaaaaaaaaaagtggggtattaaagtccttcaatattataatattgctctttatttctcctttcatgtccattaatatttgctttatgtatttaggtgctccaatgttggttgtatatatatttacaattgtaatgtcctgttgatacattgacccctttatcattaaataatgacattctttgtctcttgtgacaatttttgacttgaattatatttcatcaggtgtaagtatagctactccttctctctttattatttgcatggaatatcttcttccattgctttactttcagcctatgtgtccttaaagcttaactgggtgtcttgtaggcagcatatagttggatcttgtttttattcattcaaccattctatgtcttttaactagagaaattaatttatttgtatccaaggtcattattgataggtaaggactcattgctgtcattttgttatttgttttctgattattggtagcttcgtttctttctctctcattgtctacctttgtaatttggtaattttctgtagtgttaatccttgattcttttctctttatcatttatatacctgctgtagtttcttatgttgtggttaccatgaatcttccataaaacaccttataatcaactattttaagcagataataacttaaattctgttgcatacaaaaactctatacatttacctttcccctcacaatttgcttttgatgtcacaattttcatcttttaatattgtatatttattaacaacttgttatacgtttagttatttttgaccattttgacatttaaccgtcatgctagagatacacatgatttacacaccactattacagtattagagtgttcctgattttactatgtatttacctcttcagtgagtttatactttatagatatgtcatatgtatttataatagtaattgtcattttttaagattcccatttgaagaactcctttaagcatttcttgtaaggcaggtctagtggtgatgaattccttcagcttttcttgtctgggaacaattttatttccccattttgaaggagagctttgttgaacatagtatagttggctagcaatgcttttgttctttcagctctttaaatatattattcaatctctcttgatctgcaaggtttctattgagaaatccactgataacctaatggcaattcctttacatgtgatttgatgcttttctcttgttgcttttaaatttctctttgtctttgactttgaagagtctggttataatgtgccttagagaggatctctttgggttgtatattttggagggcctttgagctttatgaatccaaatgtctatatctcttttaagatgtgggaaattttcagcaattattttattaaataagctttctgtctctttctttgtctctttttcttttgtagaatgtgcttgcttaatggtgttccataagtcttgtaggctgtcttcactattttttattctttttcctctgatggagtaatttcagaagacctatctttaacttcacagattttatcttctgattgatctcgtctgctcttgaagttctctaataaattttttatttcattgattgaattcttcagcttcaagatttctgtttggttctttttatatctgtcttttcattgaatttcctaattatataatgaattgttttcctgattttattaaattgtctatttgtattctcttgaatctccaagtttccttcagttcattatttaattttatttcatttttattatttttctgagacaaagtctcactctgtcacccaggctagagtgcagtggtgcaatcttggctcactgaaatctccacctcccagattcaagagattctcctgcctcagcctcccaagtagctggcattacaggtgtgtgccaccacacatggctaatttttgtatttttagtagagacagggttttgccatgttggccaggctggttttgaactcctgacttcaagtgatctgcccatctcagcttcccaaagtgttgggatcacaggcattagccaccacacccagcccagctcattactttaaatcacttttcagagagtttgtaatttctgcttctttgtcgctagttattggagaactatgatttccgtgtggtaccatgcttccttgctttcatgttccttgtgtccctgcattgatgtctgcacatttagtgatgtagtttcctttttcaaactctagtaggggaagactttcagttgcatatgggtctgaggctgccagttgggcagggcgcctctggttacatgtaggcacagtggggtaatcaatgtgcagcttctttagttgtgatcaatgtcagcaatgaatgtaggtgcctcagtggcctagtttgtaggttgctagggcaaaggcttaacaattctcctgttcttgtctttcccacagtggggagtcttagctgaagaaaactatttttgtgtttggtctgatatggcccacaggcaaccatagcagcactgggagccagggcataggtgatcagagtagctgtggatataggtcatgggctcagggtcttgtgagactactgtagcaccttggacttgaggcacaggttcactttccaagatacaaatgaatgcagtttccccagtaaggcagggtctgttcctctgaggtgcacctcaccatcttaggcccagagtgctgaaatatagctgaggttgtgaccctggtggacatgggacaccactggcacagcttggtagaaaaaggagttctctagaagcttgggtccagggagcagagaatagctgtaatttgggaccaggagtcaacagaggtcagcaaaaatgtagacacttagcgatgaggtactatgtagtggtgactctggaccctgggatggtgggacatatcactaccccaggctctatgaggccaggtacagcagcagcaatgatgcagaaatggcaagacactgctgtagcttggaccttggtgggaggggtgcagcacagcaccagtcccccaagaggcagcatgtcagactgcaggggtgtagtgcaattttgggtgggcaggcatgtggctgttcagcctggagggcagggtggcacagctcaagccaggccttatttctttgggatgtgttgtgccacatctgtctggccccagaaatcatgtccatatgggtcagtggagcctctggatgcctgtggggtacggtactacattagctatggcactggagtgtgcaattattcttgtgtgccaaaggctctgagcccctgtgggtagcatgctgtcttatctgtggtgccagggctgggagtttactgctctagtgtaagtctgtgatcctggatggtggtggtggggtatgctgcctcatctatggcattgaggggcatgactgctctggtgtgcagaagacctgaggtccctgagggttggagcgccatttcagttcagtcctgagaggagagtgcacagtaactggaatgtggggagtggagtagctccacggaacttggccctagagggtaggaagtagtagcagcttggctggtggatggtatgctattatatggcttgttgcagtggtaacaaaacatcagggatggaggggtgcaatgcatactcacgcttggagcaggatgcacttgttcccaagattgtacagggcagtagcagcaggagccatgagacaagaggtaggggctgagaagaggagggagggccacagcatcagctccttctctagggatagctcagtatgtagactctggggagcaccctcagctgggctcaaaccctataaggactgcagaagtctctagtgcaaagactgcatgtatctgtggagatgacggaggttgttggggtcctcttgcttacctttttcctgcagaaaggggtctcttctggttttgagttgatcccaactagggaaatgggatggcagaggcaaggtgtttcctcctgtttcctatgtggccatcctgtgtttcagtggtctacaggatttctgctgctgttctccagagctttcctttagttattttgatcaagatgtagttgcttattcattatttttagttttttgtgggaagtgggaagagcactagaagcttttagttggccatcttgctgatgtcaccaacatggatctatttttgttttataatgttaaaatactatatctatgtacaatttgtcataatttacattttatatagaatccttacttatttttaatctcccaaaaaggttctacataaaatcatcatcaatttctagacgcttaataatagtttttgaagtcgttgcaaaaatgtaacttttcaaggaaattaaaactagctgcataatgttaaagaaaatatcaaatgtgagaactgtgtgtgatatattcaaagactgaatccatatttgcttatatttatagaaaggaaacaggactagtaattctatgggctgtaattttatgtcaacttctacctaaaacagaaatatgaattatttttaataatatgcctgcctttaatcgcatggatgaatatttcacaaatttggtattttaacatctttgatgccaaatacataaaactaaagaagtctttaatctgaaaaaaaccagaagtataaagaataccctgttaataaatttgttaattcatcttttgggggatggtgtttcctgatttagtctttagctgcaattcatatttgaagtttgaatgtaaaaaaatgagactcaattttctagtggcttataggaccagtctcatttctttttaatccactacgcaaataaattgtttgttacttatttggcttaggaaaattagtttacataactcgaaaaataaaaatagcctaaatgagcttttgttccacaaaaatcaattaaacttatagctggcattttgtaaataaaatttatttaaacaaaatgaaggatccttcagtccctccttaaagagaactgacaatttggctgcttcccaattcttcaactctgacttctccttgatagtcaatctgtgaagcagagggaaaaaaatctcttcccagaactgcatcagtcttctctgactggatgcactgtttttgtcttgttttgctgtttttcctctagtgcctgccaatttttagcctatgaagatggaaataataaaaaatatggtgattaatgaattaaaaaaatggtgattagtggagtaaagggaattaataatataaaaataacttctttaataatgagatatatgatatagaagaagataattattaaaagttaaaagcataataatttgattcaaattccttgaacacaagaggtagaagttagactaaggtgattacttagaatatttgctgtgaaaatagagcacccataatttttagtgtcactcataatttttttatttttctaatttttaaaaagttttatgaacctataggtttatttcatatttttagtttatttattttcatttttaaactttaattttagtctcagggatacacatgcaggtttgctatataggtaaactcgtgtcatggggagttgttgtaccaattattttatcacccaggtattaagcctagtacccaatagttattcttaatgctcctctccctcctcctaccctccaccctcaggtagaccccagtttctgttgtttccttctttgtgctcatgaattctcatcatctagatcccacttgtaagtgagaacatgcggaatttggttttctgttcctgtttcatttagttttcatttagtttacatatatcaaagatgaccagcactgaaagcttatgagatttgtcatttgtataagtaccaggtaggatgtagaaagataaaaatccctcagataactatgatttctgaacaggaagactcaacattgccatcttcccctgcccaacgatcttcaattcctattgctccattatccaaaaaacattcagtctaaaactaagggtggcaaatacgagcactaattggaatgatagcattttaaattgttaactgtggtttctaaggtcatctttttggatactatgaccagattttgttagaaagtaagagaagacattttgtacttctgggagaggtcacactgacaacagaaacagatcaagaacagtgggtttcagggcagaggacagagggcaatttcacaggcttttatacattcgctagagctggctccactcaccttagtcacagaacacttagacatgtccttatatgttctcctggtctgcatttttttaaactcaagtttttctaaacattttatttgtgatgtaatgttttcccttgtgctatttctccctgcccccaaactgattggtgtaatttgttttattcttgagattttacccatgaaaatactaagagagagacagagaaaaaagagcttacctggtatttctgttgttttaattgaactctgagtttcagctttagaaggaaaaaaagaaaaaaaatcagtacaattaaatgttgaatatcagatctattctcacaattgtttcaggtggtaaatgagtatgaattttagctcatttctgattcactattttcaaatcata

SEQ ID NO: 502 - DNA, 14958 bp, Homo sapiens
acaccgagcacttatgttttgtgaactgaacttctttgatggttaactaatgtccttaaggtattttaatcaagacagtatattcgatataaataataacttgataaataacttgcttattttttcttaggtgtagacattctgctaattagatatgagcctaatatggtttttacccagcatctgtggtaatttgttctcaacatagactttttgataaacaaaagcatttggtcgaacattttttgttttaaaaagatatgaaactaattacagtgtcagtatttatataactgaatgaagttgatttagtaggtatttctaagtgtttatattgtttttaatgttaattatgccattacaaaatttagaaggtgaaatttggaaaaggcaattgtttttaattcttctacccaaacaaaccacttttaacatttagctatattttcttccaagatttattctgtgcacattaaaaaaagtaggtatgagcttgattttgttggttctgtttcacaccttcagaaacatgtactttttggttaaaagcatatcaagaatgaatttatttatttatttatttatttatttgatacagtctcgtgctgttgcccaggctgcagtgcagtggcatgatctcagctcactgcaccctccgcctcccgggttcaagtgattctctgcctcagcctcctgagtagctgggaccacaggcgggtgccaccacatctggctaatttttgtatttttaatggagatgaggtttcactcttttggccaggctggtcttgaactcctgacctcaggtgatctacccacctcagcctcccaaagtgctgggattacaggccgacttaaataatagatgacataaaaaagtaaaacgtaactatgcgggaaataaaaactttaagtgtattagaataatgatacaaattgtgatatgaagctcttctaaaatgttatagaactttagtttttaaataatgaaaaagggtagctggcagatgaatattacagggccatttcattagtctttttcctcccccatctgtcagatatttgattcaagtggcagccatggattttctggaactcagctacctcaaaactccagtaactccagtgaggtaaactttgctatagatggccgccatcttgttttacatgaatgacacaaatgctaactttttctgtttttttttgtttgtttttgtttttgtttttgagacggagtctggctctgttgcccaggctggagtgcagtggcacgatcttggctcactgcaagcttcgcctcccgggttcatgccattctcctgcctcagcctcccgagtagctgggactacaggcgcccgccaccacgcccggctaattttttgtgtttttagtagacatggggtttcaccgtgttagccacgatggtctcgatctcctgaccttgtgatccacccacctcggcctcccaaagtgctgggatgacagggtgagccacagcacccggccacaaatgctaacttaagcgaggaatgctggttcagaatctttacatgaactccttgaaaatagatttataattaaaatggtcccagtaggtattctctaaagagatagtcttgaatgccaagcattttggaggtatctaacctcatgttaactccattttaaaattagtgacatgactagactgaagtcataataatatctttgatttatacatctctattcctcagcagtacttaccttcgtttgagagttcagtgaatacaaaattgcattttcctctcagggttgtcagggatcttcacatagatagtacattctatgctgtgtctctccaggcgccgtcaaggggagcctgagtaatgtctcctcatccctagaattgcttctgaccaaacaaatcctcagaatgatttctgaatgaaatcctagagcatgaaatcccagatgtgcctatgcctcttcctagtgcctttttcaaacccacaacatccccatgaagctgtgttatttaatttctcctccaccaaataattttttttttttcagatggagtctcactctgttgcccaggctggagtgcagtggcgtgatctcggctcactgaaacctctgcctcccaggttgaagcagttcttctgcctcagcctcctgagtagctgggattacaggcacctgccaccaaggctggctaatttttgtatttttagtagagatggggtttcactatgttggccaggctggtcttgaactcctgacgtcgcgatccacccacctcagtctcccaaagtgccgagattacaggcgtgagccactgcacccagccagttcttactctgcacttaccatctcttactgttagccactctgtcaagtgcgtatgtcatggctcccaggaaagcttgtaatcgatatagtttatatatgccctatttctattagatgtagtcatttaatggctgaggatgactgatttgtaataaaggcccataattttagggtcctatctcttccagcattatataacaatgtaaaattcttactttgaaagttaagaggcctggcatggtggctcgtgcctgtaatcccagaattttgggaggctgagtcaggtggatcatttgagactagcctgggcaacatggtgaaaccctgtctctatcaaaaatgcaaaaaattatccgagtgtagtggcttgctcctcggaggctgaggtgggaggattgcttgagcctgggaggcagaggttgcagtgagccaagatcgcaccactgcactctgacctgggtggcagagtaagaccccatccctgaaaaaagaaagttatgaaactatagcatcagtacacttcctattaacagagtttatgttggactttgaaaataaattttgctgatgtagccacttacagtgagaatttaagcttagtgcttaagatgggctcaaatcaacaggtcccatcgatgctctaaggagtgagaagaaactatgatttctgcatttgttttactcctatttgttttagctaagcattacttgtgatgtagggatactgaagaaattcctttcatttataggacaattttaatgcagcctctgtaatttctgtgctatcgtacccagataactagattcagatagaatggcagatagaactaagggtgtaatttgtttttttatatctctgggacttaaaattctgcctgagctggctaaataattaatatttcattttgctacttttcatctgctaatcattcttggagaatacttgtaacctgcacaaacctatttttatacaataagtacattacgcccatttctataacacagaaaggctgttgtgagggaggggccgtgtgcattttaaactatttcactctaattgatgcatcatataacagcccaacagtgagtcaccctaattcaaaatctgttaagtctggaataaagccagtcttacttgaacatttttttagaggacactttggcttgccaaaaatgaaagcttttcataacgaacgtctggatgagtaatagtgagtcttacacggcctttgaagggaggtgtttgtcatggagattgtgacaacaaagtccccactaaggctcagatggcggcaaccccagaagcttcattgcagaaattgtgacagcccctgggccttggccccttcttctggaaaattggcttggggtattccaactttctgtggcagtgagtgaatgcagtattgtcatcttagtcatgagctgtaaactgaaaaaaaaacctaaaaaaccccaaaaaaccccaaaaccaaaacaaaccccctaatattgttttcttaaatggaaaatatgaatgaaacagcttactcttcaccacagtatggtaatctgtttagagagaatattaatacacaaccctacatagcatatatatatgcatacagctagcgagctagctagatccatctttgtttttctttcatatcaaccgatgtgtgggcctcagtccaagaaggaaataaacactttctcttctatgacattttactgttgttaagaaaactgggagcgtgcaactcccttttgtgttttctcctcatctcccttgcaaatagactttccttttatcagccactgtggtggtttgggcccatttgtgacagccagattgtgattttgctactcacttcccttcagtgatccaagtagtaattacaagccatttgatccaaaagcatctgctgtgagaacacacggagtttcaattttttctccttgctgcatactgagcataagtaatttgacatgtggtttcaggaccattgatgtaataataataataataaatacttctgtggaatgccctccaaggagagctaaagtgatttgcagacgttcactagtcagtctggagtgactgtggctgcagcccagtgatgttcccgtgtcgtgatggccagttggagctgactgcaaggtgatctgagcagcagtggccagaacagtggcccagggctttggaacaaaggatgattctcaggaagttctttatagtggccatcgctgaaatgcagtagctactcccagtacagtataatgccctgatccagcctcagcttccaaaaaaaatctttacaatttatgtctttcaaatgcaattcctcccatcagtctcctaaccaccccacgaggctggcgtttttaacctcttttgaaggtgaaggaacagaagtgcagaggcactagataacagcccctaacaaggctgagatttgacctggattgccttgctattattgtattttttctgtctccatttgcattctcaggaccaggaaaccttgaagaggctagttggaaatatatatatatatatatatatatatatatatatatatatatatattttttttttttttttttttttttttctttgatgggaggaagtagagtaggaggcgtggtaggtgcgtaacagtcctggcaaaggtagccaaccgtggaattctgggtggttaaaaaggttaatttaacatagcagcatctttgacatgggtaacctggaaaaagagttttccagatggctccatttttaatgcttatttttaggattctctcttctttttatgaaaagaatattggagaatatttcatctggcttcctgaaactaaagcatgtgtattttcaacttggatagcattgaccttccttcagagaattaatccaactttccctccaaatgggcaaagcttacaacaacctaagagatctgtaagcaccaagtagctttttctttttctagttttaataaattaattttaaattcttggtgcttcctttgaataaccaggttttacttttcttgaactgtatacatttgtgagggttgtgtgtgtgtgtgtgtgtgtgtgtgtgtgtgtctgtctgtctgtctgcctaacacacaccaaaaattacatttaacttttcattgagggactctcttgagagggtcttactctttgatggccttggctttgataggcgtcttctcttctatggttcactagatcttgggtcaacagtgtagactcagaaaaccattgctcagagcagttgtagcacagcaccttgtttaatggattttaataggattatttcttttgtccttccatccttccatctatctgcacacttttctcttgtccagaacttattctccttcaataatctgttaatttttcttctcgaagcttccagagagcattaagaacttgacactatgtcaacagatttgagtaagatactgaaaacggacagcgtttacccttctgcctgtaatatgactgtgaatttctagttgtatccagctcagcactgaagttttgggtgtgtcctgggtgtgggacgcactgtgttaatggctgagggagaatgaggatgcagaagacaaagcctctgctggtattcatcttctcctggtgcgggacttagaagtgactctcctgtgagctgggctttgccaaatgctgtaccagggacataggagagtaaactcatctaagtgagaggacttgagggcagagaaaggagagataggagagaattcataagacaggggcattttaaaccaggttggagggtatatatggtttcagcactgactctacttgtaaggacggtacagcagagagaggagatggaagtgagcaccggtgtggagcaggagcatgccactcccttctggggaatgttccctgagccattctgttcaatgggaacatggtgtgtggcttagaataatggaaagtaatcaggagatttgggttgcacccattttatataaagggagttaactgccaggcgggcattctgtgtagtatagtggtggtgtgaaccagctcatcccagacttccacccttcagatccccggagtaccataggcactagttgtgtaaacttgggcaagtttctagaatttcctgagccatatttttcttgccttttccataggaagtgatgatggtgccttcctgagagggctggctgtgagtggtgagtgaactgatggcacatcaggagcttgtttcatttggtctcacgagatgcagtctttttttttttttgagatggagcctccctctgtcgcccaggctggagtgcagtggcacgatcttggctcactgcaacctctgcctcccaggttcaagctgttctcctgcctcagcctcctgagtagctggggctacagacgcgtgccaccatgcccggataatttttatttttagtagagatagggttttaccatgttggccaggctggtcttgaactcatgaccttaggtgatccactggcctcggcctcccaaagtgctggaattacagacgtgagccatggcgcccggccaagtgatacagtctttctctgattgtcagtaacggtgagaacaagagggtgtgaaggcacagtgttaatttgtactgctcatgttcctcccacacctgtttatccataattacgttcttcctgatctccaaaagtgcagcagtaaattaattgctctgtcaccctcagtgggagcctgtgacttcctccgggccttgttctttgtgatgtttcttactccacagtgacctctgctgggttttagtttgcttctcaacaagcctggtttcagaggtggggcctgcacctttaaggcagcatctgtttgttgctaagcaccgggttgaaatcactgcccagatgaaaagtacccgagagaatgaaccagggaaaaaaatgtgcctgtgtaagacaagagcctttagcagagagtgtccgggctggttcctggcatccctggctccttgcatctggtcctgtcttttcctttggcattggcacgtgtggggatgtgcattctggctgtgatcatccttccagaaaaatgtactgaaagcgacagatccaagacaaatccagaaatgtcacttcaaaattgagcaccatgttttcaaaaagatggcacagagagacagatttttcccttgctttcttcttttaaatttctttacgatgtctcttctagtttttaaatcctgcataggaggatcttttactttgtatttaaaaatgcatggaattcaaagtaaaatcacccattaatgataactttaaagtatgatgaatgatatataataatgtgatagtattgaatctacaggtgacattttctggtatgtaaggtgtttcacataagtgacctcttttgctcacaaaaacttaagtaacaagtaattttttcaatatgaattatattaataatatcctcttttacaaaacaggagctgaatcgtacgtagcaaggtaaatcttgtcctaggccacactttgctggtagagtctgtgacttttgatttcgaagccccaaatcttttctttactgctatgtgaatataagaacctacccagagagaaacatgtctacatcgcttaagaaatgtatgctatttttgttatgaattacaaaaggacgtattagcatgaagtcagcaattgttgtgatgatgtagttggcacactacacttttttgggaaaggcttcctgaaggtggtattctttgagatgattttccaacagtgtctatgtgtgagatagctgaaggatagagaaaagatttcccaggactatgggttaattttaaggaacaaatagatttctgtcagtgatgagtcaggctaaaattaaaaagaagaaacaaagacaaaaacacagatagtcttagaagagaaagcttgtgctggattaagtgcagttcagagtcaggatggcaggcagatgtcagtgaccatggacaaggtgtgtctggaattcagtgggaggtcagagagggattatggctgagatgcaggcttcacagtggcccttctcaaccatgatcccagagcagtaagcgtggatactcagcagcccttacatggattgcggtgttctttttttattttttgagacagactcttactctgttgcccaggctggagtgcagtggcatgatcttggctcactgcaacctctgcctcccaggttcaagcgattcttctgcctcagcttcccaagtagctgggactacaggcgcacgtcagcacacctggctaatttttgtatttttagtagagacgctgtttcaccatgttggccaggctggtctcgaactcctgacctcaggtgatccacccgccttggcctcccaaagtgctgggattacaggcgtgagccaccgttcccagccggattgtggtgttctaacttggcataagcggtcaattgacacagtggaaagaacacaggacaggcagtcactaactttcactctgcttcccatggctgcagtttcatctgataaaatgagtgaggaaacgttgtcagcctcagagggctgtgagaagccagtgatgtgaagcgtgtgagcgtttactctaaatactccgtaaatgaacaggacatttggccggtggtttccttcatttgttaatcaaatttgtctgcattttcttttggcatctacaaacaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaaggtaacggattttgctgcagaaatatatttctgaatagaaataatcattaatgttgcaatcttatgccttctaaattcatgtgatattcaagggcccagtttccatgccagggaacatattagcatatttattagttaatatatttattagcatattcattaatttgcattctattccttgatctctttagaagaatgagttattaggtcatgatcccacacttccatgaagaacctgagctaatctactgaaattctatgtatactttgatatctagaataattatgaaatccgttgctatttaagttacttagagatggtgtgttataagaaggcggcataaactttgaggtaatttaatttaatcctaaatagttttatcggatttctccagattaaacacgaaacttgatatattcacagttgctttatggagattaatataagatgatgttttattcatttttcaaactgggtttcattcctgatctgagaagggagtttatggtaagtcttaaagagagccctctgagagagaatatattcagcaacatcagatcagaagcttttagaccaccaggtggtgcagtagagcttaaatagttttaagtttccagagaaaatacaatcaactatgttgaaatggtgaaaaaggcatatagagtttggcaacacttaatcatgtgcacttaataaatgtgaaaaatgtttaattttagtccccctttttcactttgacttgaaacattaggattctctacatttatatgtagtttatatccttaggaacttaatttccttttgctcccatatgtaacgtttttattcagaaaaccaacaatgttctataccaatgatatcctccattaaactgataattttctgagtaataaagggtatcagaagtagtgggtcagctgggagcagtggctcatgcctgtaatcccagcacttggggaggccgaggaggtcaggagatcgagaccatcctggctaacacggtgaaaccccgtctctactaaaaatacaaaaaattagctgggtgtggtggcgggcgcctgtagtcccagctactcgggaggcagaggcaggagaatggcgtcaacctgggaggtggagcttgccttaagccgagatggctccactgcaccccagcctgggcgacagagcaagactccgtctcaaattaaaaaaaaaaaaaaaaaaaaaaagatgtagtgggtcaatttgacccagttagagcataggcctgagataaatttctcactgttgaaaatatgcatgcgagagaaaatatgagtgtgtgtgcgtacacattttcgttttgaaagtttttggagtaggacattcttaagtctgtagatttgttaacattttacaaatttctgtactttagtaatgagaaacaaggttaggcttaacctaactaaagagatggcatttgctgagctgataagatttattttactgtcagatatgttctaccgtaatctcttaaaaatgcatctcttgcctttaatcataagcaatattgttcagcgaaaaccttcttaaaaataattgtcctcctttacttttttgcatacaagtatttatttatttatttatttatttgagttggagtcttgctgttatcacccagactggagtgcagtggtgctacctcagctcactgcaacctccacctcctgggttcaatcgattctcctgcctcagcctcccgagtagctagtattataggtgtgtgccactacacctggctaatttttgtatttttactatagtcgatgttttgctgtattggctaggctggtctccaactcctgacctcaagtgatccacccgccttggcctcccaaagtgctgggattacaggtgtgagccgctgcccctggcctgcatacaagtatttaaattcgagctcttatataggtttaaattcagcaaattatatgcagtattcttttagagatttctactttgatttttaataagcctgctaaccaatgatggatttagaaagagcatttaaaatctgaataactgtctttttctttatagatgaggcagttggaacccagccattatggcctacagcttcgaaaattagtagatgacaatgttgagtattgcatccctgcaccatatgaatatatgcaacaacaggtaagtgtgcactagctttaggaagggaaactgaaccacatctatggccctttgattttgaaaaatgtcatttttggggaaaattctgtttaaatttggcgtctagtttggaaacagtctctatataaacggtatcttaacagctttcttgttttatgaaaaatagtgtcaaagtaattttttgaggtatcataacatgagatcctctgattttgttgttttcaccttttgcaggtttatgatgaaatagaagtctttccactaaatgtttatgacgtgcagctcacgaagactgggagtgtgtgtgactttggtgagtgtaaggaatgcccctttcagggaattgtgttgttcatctttgcctactttgccccagcatctttggacttaattttttccccttacattcacattttcagaatatatgacagtagtttctgaacttcctttctcttccttcatttctatttattgatattagcaggtgacacagataggtattagtattagagggaaatgccaaagtaattaaatggaatgaatataaaattgatgggaatttgaaaatatagattaataacacaatgaatgtactgtgtgctggtgctgctctgagcagaccaactcatgattcatatgacagttgctttcatctctagtgtctttgctcttagttttctcttcccacctggaatgctccccttctttcctctttcttcccccatccctcctctctggtgacatgaatcctgctgtccttcaagaactaactcaaggtctttcttgaagaagccgtgtctgattgctttagctttacttccttctttcttccctgagtttaacagttgagggtcagctgggcgccgtggctcatgcctgtaatcccagcactttgggaggccaaggcgggcagatcacctgaggtcgggagttcgagaccagcctgaccaacatggagaaaccccctctctactaaaaatacaaaattagccaagcatggtggtacatgcctgtaatcccagctactcgggaggctgaggcaggagaatcgcttgaacctgggaggcagaggttgcagtgagccgtaagccaagattgcaccactgtactctagcctgggcgacaagagcgaaactccgtctcaaaacaaaacaaaacaaaaaaacagttaagggtcagtacttctgaagtcacttcatagcatcatttcctacatttctccttgattagataatgattggtaaatacttccatagaaacactgaatgattagataatgattggtaaatacctccatagaaacactgtttcttaccttgttaaatatatcgatacatgattttttccttaaaatgattcaaactaataataaagtttataatatgttaaaatgtcctttttaggatgccttcgttttttaaaaatttgtataatcttttctgacccccatgttatttttttattttttattttttttgagacatagtcttgctctgtcacccaggctggagtgcagtggcatgatctcggctcactgcaacctccgcctcctgggttcaagcaattctccctgcctcagcctcccaagtagctgggattacaggcaccgtgcttgccaccacacctggctaatttttgtatttttagtagagacggggtttcaccatgttggccaggctgctcttgaactcctggactcaagtgatccgcccacctcagcctcccaaagtgctgggattacaggcatgagccactgtgcccggaccccatgttatgttggtttttcctttgaagccctcttagccttttttctcctcctcttggccttcactgtgctttttgtggttgccatttgtgttcatctttgtattggaatggatgaatgaagacattgcaaagatactctctggtgagaccatattctaccagcagaagatactctctggtgagaccataatctgccaggctctgctggggtcacagcagagacctagggaacaggacattcttgctgtcctcaaagaactctccgtattaggggaccaagacatggaaacctgtgctcctcactgtggcatcacagagggggacactaagtcaggagccatgcattcagaagagggaaggtctgcctaggatttgcatgtagtcttatgtatttagggcaagcaccgtattcatccaagcattttttcaccttcttaaaatgctcaaccccaaacatagttgtttctcaacaattatttgttgtattgaactgaatttcatgtatttcagtgagagtatttttttgctgttaaatttgcctaaatttttaattgtggtaatagacatataacataaaatttatcgtcttgaccacttttaggtgtacagttttgtgatgttaagtacattcacaatgttgtgctaccatcatctatctctagaaatcttttcgtcttgtaaagctgaactctgtacccatttaacaccaattcctcatactgtccttcccccagcccctggcaaccaccagtttgttaatactttgtatctctcggaattcccctagcaaccaccattctattaatactttctacctctctgaagttgactgctctagctactcacgtaaatagtatcatactgtgttgtctatttgtgactgacatattttacttagcatattctcctcaaagttcacccaaattgtagcatatgccaagatatttttcctttttaagactgaatgatactccactgtatgcatagatcacattttgcttatccatccgtctattgacagacagttgggttatttccacctcttggctattgtgaattacgctgttatgcgtgtgggtgcatggtctcacctttggaataaaagttatgtttttatatttcttaagcctctcgtttgacatttgtctttttctgcccctgcaagatatttatactttcaaaatagctgtaatttcgactttctcaacatactgtacttatgagaaaagatgttcaaggagatactgccggtgtggttggagaaattcagtgtggtgggctgagacttgctttttccttttgttttcattcctagggtttgcagttacagcgcaggtggatgagcgtcagcatctcagccggatatttataagcgacgttcttcccgatggcctggcgtatggggaaggtccgtgtggcacaccgtgcccctgttgcctcttaatttgaaactgtgggatacagtctggctagtgaatgtttcttcttacagttttgtcagaaaaaggttgctcctggaattttaaagaaagtaaacgtaagagtttaattggaaatgcgaccaaacacagcggctcgctcgcataaacccagctgctcaggaggctgaggtgggaggatgggaggattgcttgagcccaggagcccaagaccagcctgggagacagagtgagactcctgcctccgtaaaaaaggacagagagagagaaaagaaagaaaatgcatatgcctatatatagagagagcatgtgtgtgtgtgtgtttaaaagagtaagtgtatacatatatatagacagagggaaggaggaagagagtgtgagacagacaggcggac

SEQ ID NO: 503 - DNA, 15056 bp, Homo sapiens
ctgttaaatatggccatctgagttccccttgggatactgcaacccacccccgccaacttatcaccttcactcccaagcctgcccctctcccgtgcccttgttcgactgggggcatttctactattcccagcagccaggcctgaaaggggagacacactccaaccttcaccccacctcctgcccccagccccaggagcaccagggcctgacgctcctccaaatcccctgcgctggccatcccaggccccttccatcacgtgacctgacagccaccgtcttcttgctcctctccagagcccctaaacttggctgtggcccgtcagcttcttcaggggtgccagtggctggggcaggaatcggaacccttctctcctcctggagattcaggagaacggggtccacccttcactgccgtgtgatctgagccagctgtccccgctctctgtgcctccacgaagctcagccggggttgagacagaactgttgggaggataaactgtggtttggtggatgaggcaccactaggggccccggcctcaccgcccatttgctgggtgatctcaggcaagtcacttgcagtctctgagcctctgtctccacctcatttgtgatgtcgccgcagtgaccctcccagtttcatggacccttctaaggaccagaaaggggaggggctgaaagaattggctctggggggttaaggggccctgggccaggcatccaggccatcggaggactgtgtcccatagaggggtggagggggagcccgttctgcagcccacagcagggcctgagcccagggggcccagccagaaccctgggtgcagggtcagagccctgagcagccgctaagtgcaccctggagacacccctgctggggaggagcccagagcaggccactttgtccccagggatcccaggactgtcccccaggcccaggggcactgcagaactggtgagggagctactcaggcagaccatctgcctgtgcaccatggactctcagctcagcccagcaggtccttcacgcccctcggccccaggacccacccaagttcccagcagggatctccacccaccctgagcctatttctggcacacagcgccccctgctggcctcttcgggggcagcagagactcacggggcctctgagtcctggctctcaagttgtttaaaggaaggagaaagtctcccggtcccgggatctgggtctcagccacctttgactcctgcctccctcaaggagggacagatggggccgcattgcaggctggtcccaagcaatcgtggccacttttgtttttctggaaagtcttctaaaggtcatgtgccacaaggggcctatttatacccaccctttcactctcctccctccctttcttcccttccttttctgtctgtgtgtgtgtgtgtatgtgtgtgtgtgtgtgtgtgtgtgtgcgtatgtgtgtgtgctttttttttctctctctctctttttgtagatgtggtctcgatctgtcacccaggctggagcgcagtggcacaatcataactcactgtagccttgaactcctgggctcagcctcctgagtaactgggactgcaggcgtgtgccaccacgcctggctaattttctttattttttgtagagatgggggtctcactgtgttgcccaggctggtctcaaactcctggcctcaagtgatcctccagcctcagcctcttaaagtgctgggattacaggcatgagccaccactcccagccagcacagggactttgacggtgtctgaagggcactccttgaacctgagggtccagaaagactttcctgatgtcagaaggaggagagggctgggatggagggaacctgggccacgagtgaggttctcccactaaggagcgtgacggggcacacacagcgtggacagctgcaggtctcatggggtgcacatgcatgtccctgtgtgtcacgcatgtccctatgtgtcaggcccaactgggacctgactctctatctcctttggcccaggtcctcctgctagaagcagcagaacggccctccagcccggacaacgacctgccagcccccgagagcactccgccgacctggaatgaggacttcctccccgacgccatccctcttgctcaccctgtgccacgacagagaaggcccacgggcccagccggtgagtgagggctgcagagaggacaggctggggcagccgaagggaccttgggcatggcctcccagggcctccctagagaggccacacactagacactctagttccaacatgccatgtggcattttgaaaaattaagctaacagttgaaaatgggtatttcacctaaaagccaggatttctagtttctcttaagaagtagacgatctggtcaggtgcagtggctcatgcctgtaatcccaacactttgggaggccgagaagggtggatcatttgaggtcaggagttcgagaccagcctggccaacatggtgaaaccctgtctctactaaaaatacaaaaattagccaggcgtggaggcaggtgcctgtaatcccagctactcaggaggctgaggcaggagaatcgcttgaacccggaaggcggaggttgcagtgagccgagatcacgccactgcactccagcctgggggacaagagcaaaattccgtctaaaaaaaaaaaaaaaaaagtagaccatctggccgagcatagtggctcactcatgcttgtaatcctagcactttggaaggtcaaggcaggtggatcatttgaggtcaggagttcgagaccaacctgggcaacatggtaaaacccccatttctactgaaaatacaaaaattagcccagcatgattaatcccagctactcctaaggctgaggcatgagaattgcttgagctggggaggtggaggctgtagtgagccaagatcatgccactgcaatccagcctggaagacggggtgaaaccctgtctcaaaaaaatagatgatcttgggcaggtgcagtggctcacacctataatcccagcactttggaaggctgaggtgggaggattgcatgaagccaggagctcaagaccagcctgggcaacatagtgagaccctgtctctacaaaaaattataaaaataaaaatgagaaaattggccatcagggctggcagtccctcatggaaacaaccagctactgggttgccactgtaggtccagtccaggctgtgcagtttgccgcagtccccaccattccctattgtcttacagctcagctactgtcttcagtatctgccctgctccttggcttctgcacttatggcccccagcccagccttgctgggttcaattttgcagcattctgcctggccagggagcaggaacttactgcttcccacctctttctggggtttgctctctgaactctctggctggaattggaggacatctgcccccctgccttcctgccacacttttacaattttattttattttattattttattttgagacaatgtattgctctgtcactgaggctggagcacagtagtatgatcatagttcactgcagccttcatctccgaggctcaggtgatcctcctgcctcagcctcccaagtagttgggactacgagtgcacaccaccacacttggcttttttttttttttttaatttttagtagagacgaggtctcactgcgttgccaggctggtctcaaactcctggccttaagcaatcctcatgcctcggcttcccaaagtgctgggatttacaggtgtgagccaccatgcttggccctggccacattttaaagttaaggggaagaattttccctctgcagattctacctactggtctgggctctgccacctggggctgtaattacctttgctttaatcacaattgtaataatcatagttgcaatcgatgaagccctcctggttgccagacactgaggtggggctttatcctggaggacatttagcaaacaacacctgtctataaggctgaatccaggggttgaaggctgaggtctaccatgagtggtcaggatctgcactgtgccagttattaaatattttcatatcagatatgaaaatatttcaaatacagatataatttttttttttgacatggagtctcactctatcactcaggctggagtgcagtgtcgtgatctcggctcactgcaacctctgcctcctgggctcaagggattcccctgcctcagcctccctaataactgggattacaggcacgcaccaccaagccccgctactttttgcatttttaatacagaaggggttttgtcatgttggccaggctggtcttgaactcctgacctcaaatgatctgccctccttggcctcccaaagtgctgggattacaggtgtgagccagcacacgcagcctaatttttgtatttttagtagagacggggtttcaccatgtcggccaggctggcctcaaactcctgacctcaagtgatccacccgcctcggcctccaaagtgtggaattacaggtgtgagctagcgcacccagcctacagatatcactcttaatcttcacacaaagcttggaagccttgaggttacaggggagacacctgaggctcagagaagttaagtgacacccctggggtcacccagcaagccagcaagctgggggcattttgcctccatgattctctgcccttagagccctttggagggggcgctctccctctgccctctgttctgagtgtctattctgatgctgggttggggagcaggggcagagcagggaggagagatgcatgacacaggtggcctccagtggccagtcccagggccggggaaggagagtagggtatcctgcattcttggaaagggactgaaggctgcgggaggagggccgagctcaggtctcctacgggaagggggacctctctcactctggcccccggcctacccctcgagccgctgtccctaaggtctcacccccagagcgttacctcatgcccacattcttcagatctttcttgggggatggaggaggaggggcttcccatcccaccggggacccaggcccacgaaagcgcatgcctggcaagacctttccaaccaggggaaaatgcagtttcaagaatggccaccaggtggggcacacactctacacatggtgacacctgcagccaacctggattccagagcgcaggtggggctcttccgaggccagcagcccccagccaggccctccccaccataccacagtcccatgcaggcagagtgcaaagggccctaagactcagtgcaggtcccttcatcagatcagcaaactttttttttttttctgagacggtctcgctctgtaagccaagctggaatgcagtggtgtgattatagctcactgcagcccagacctcctgggctcaagccatcctcccacctcaacgtccccagtagctggggccacaggcgtgcaccactatgcccggttaacttttgtatcttttgtagagatggggtctcactatgtggcccaggctggtctcaaactcctgggctcaagtgatcttcctgcctcagcctcctaaggtgctgagcaaacatttttcagcatcctctctgggccagagggagaaaaggctgtcccctggccacacagcaagccttacctctccatctccttgtccacccttggggtttagagatctgtagctgggaagatccatccttcaggacctcctggggcctcctcggaggccacctgttggggagcactttgccacaagcccggttcttgaccctaagcagagagacagcagggtgtgagagagggacctggagctaagcaacttcatctgcagcctggctgtgtgagcttgggcaagggaccaaccttcctgagcctcagtttccccacattgaaaatgggaacgaaagcagttcttagaatcatagatgtttgtaagtgcaaagctggtttgtaagttgtaataaccagctccaaggtgatgtgagtgcctttgcctgtttagggagtcccaggtaggcagggctcctgggggaacgtaggctgacagcccagggggccaggcctggagccactggaggctgggggtccaccatgttctgatgccctgtctccttctctccccagggcccccggggcagacaggaccaccagggcctgcaggcccccccgggtctaaaggtgaccgaggccagacaggagagaagggtccagcggggccgcctggtaagaaaaccccccacatatgtgatgttgtcaacctgcggaaggggctgggctttcttctctactggaacaggcgaggtgtcccacgcacccacagccctgatcttgctgggtaccagaaaaacggggtcttttttttttaattttttgagagggagtctcgctctgttgtccaggctggagtgcagtgatgccatctcggctcattgccacctctgcctcccgggttcaagcaattctcctgcctcagcctcctgagtagctgggattacaggcatgcgccaccacacctggctaattttgtattttcaatagagacaggatttcaccatgttggtcaggctggtctcgaactcctgacctcagatgatccacccaccttggcctcccaaagtgctgggattacaggcgtgagccaccacctcacctggcttttttttttttttttttttgagatggagtcttgtgctgtgtcgcccagactggagcacggtggcacaatctcagctcactgacacctccacctcccaggttcaagcaactgtcctgcctcagcctactgagtaactaggattacaggtgcctgccaccatgcctggctaatttttgtatttttagtagagacagggtttcaccatgttggccaggctggtcttgaactcctgacctcaggtgacctgcctgccttggcctcccaaagtgctgggattacaggggtgagccacaacacctggccaaaacagggtcttcaggggcttcgggtacaggcatgagcatcgaggctgtcaggggccaggagcagttctcagccatttaaacacctccagagaccaccctctcaactcctcctgggtcctgccggggaaggacccctggttcagcaggtacagggccagcccaggatggtggcttatacttggtgttcctgccacagggctgaagtccctgggagggaccaatgggcctctggccagagcctttgctgatttcaccgtccctgcccccctcaccctcccaagctgccactaagtgtcccctctggactgggctgggaagggaagcccatttcatttacaccccaggacacccccaaggaagactgtggatcggaggtcaccactgactgcctgtgggcccctgaccaaccctgtttctttcaaggcctcagtttccccatttgtaagttgcagccacccgccaggctccggctgccacagtgactgttcttttcctcattgcagggctcctggggcctccagggccccgtgggcttcctggagagatggggcgccccggccccccaggaccacccggcccagcaggcaacccaggcccctcaccaaacagcccccagggcgccctctactccctgcagccgcctacagacaaagacagtgagtaatgcccctggggggccaagggagggctgagctacgctgtgttctgggagggatcagccttccttaaaggatcctgggaagtggaccccaccacatgcccatcctgctgcacccaactggctcactcctgcaggcctcctccaggaagccctccatgcagtgtccagggcctgccagtgacgatgacagggaacagcttgggagcaaggcttggtcctggggctaagcatcctcaagtggacccagggctagccccaagccctgcttttggccccaaagtggcctgtctctgcctcagtgctcagctccctgcctttggggttgtgagccccaaagttcactctgctggctgacttggcccagattccctacctggctaccccaccccaccaaggttatcccttattgtacttgttcctcacccgccctcactgcaggtcattcagcaggtgtttagtgagcacctactatgtgcaaggcacaggattttagccactggggacacagcaatgtgcaaaacaaactccggccctcgggggcaccggccagtccaagagagcctctgaacacacagaaatgtccacttctaccttgggaggtggggacaaggaggtgcagagagtggacgggaccaggactctgggcctaagggaccatgaggtagtgggaggccaggcagaggagtccgtgagccctgagaggagcatcatttctggttaagtgtcccggcaactggggaagatttttactttaattttttttgacatagggtctgttgcccaggctggaatgcagtggcgccatcatagctccctgcagcctctcactcctgggctcaagggatcctcccacctcagcctcctgagtagctaggaccctaggcatgtatcgccacatctaactaatttttttttttttttttgagtggagatggggtctcacaatgttgcccaggctggtctggagatgtggtctcactatgttgggcaggctggtcttgaactcctggcctcaagtgatcctccctcctcagcctcccaaagtgctgggagtacaggtgtgagccactgtgcccagcctggggaagggttttatgaggaaggtgatggcattgccctggggccctgggtctggttcaggattggccagggtgaatcaggtgaggggctcatcctggagggccatgggagatgggttgttaaacagactccacccctgctccaggcagtgtggtcgccatgatgtaatcagactccccaggcacagctcagaggggtgggcatggagggcttcctggaggagtgagccagttgggtgcagcaggatgggcctgtgggatggagcctggaagaagatgccagcctggggcattggagaagtgagcagggcagacccagagtctgaagagcctggaatgttctagaaggtatttatgttttatatgaagctgaccgacctggctttccctgctctttgtctgggcctctccgtgctcctctgagcagtgggggcaacagtatctgcagcgggccccagggtgatgggaggagcccccctgggcttcgtgtggcctggctcagggctcagtgccccggaccagcctcccagcactgccaggtctgccccaccagacccctggccgctccgctcttcccacagatggagactcaaggctggcctctgccatcgtggacacagtgctggcaggtgtcccaggaccccggggtccccctggtccaccaggtaagtgaatggtgggctggcctgcattgaggactccatccccccagggctggcctgagccatggggccttgaggggagctggaggtcggctggcggtccatggcttctgggcaatgctggggactgggtctgtcccacccgctgtgtggcaggaaatgaagcccctcgtttcctagtggcagtgcccctgggggactggatgcatgaaacccacgtgattctgctggaataagatgcctgcatgaggctgcccttgcatgggccagagtgggacacacaccagtgggggatggggtcaggacagaggtggcaggaagtccctacctttgaggcagaaaccaaggggttcaaaggggctgggacctggctgtcagtcctggcctgaccttccatcatccacattcctcattgggggaagaatgcagggctgactgccttgtccctttctgcccgggaagggagtcattcattcattcattcatttgtttattcactgattcattcattcttttattcattcatttattcattcattcgttcattcattcattcatttgtccattcattcattcgttcattcattcattcgtttattcattcattcattcatttctctgtgcgtctcacaaacattcattgaacatctgccactacatgtgccagacagtgatctaggttcccggaactcctgaataatcaaaacaaacatcatcgagaaactctcattctggtggaggacaggaatatcatcataaattgtgacttcgacaggatctgagggagctacaagggagaagctggggcgtggcggggaggcgccgtcaaaacgtgacatttcagaagatgctctagggaggagagggagtaagctcagagggtacctgggggccttcaggtgacatgccaggtctctggagaactggacagactcctgacatttgtcccctggagtgcctgtcctcacatgccctctccaaacctgggagccaggccatgctggacagcccaacatgcggctccctgcaccacagggagggatcatgagagaccctccctgggcccgtgtggggtcatgagagaccaagaccttactcttcctagcaggctggagattagtcatgaatctccctccctgagctgggcacacacatgagacccagcccggccctctgggtactccacatcccatggggcagacagacgtgtaaacctcagtggccatgggcggtggctggtttacataagggatttgcctggagaagcagtggaaagctgggaaggcttcctggaagaggtgatgctctgtgtcagactggtaggaaaaccagtaggaaagggtttgctgggagagtggaggaatagggaggctccaggaggaaggacagctttagcagagacgccaggagggtgtctggctggggcagggagggtgggaaggggccgggctgaggacttcaggagccctgaaagggatgtaactgggcttggatttttgagagtgtactcttgggggccataggaagggtcgatgatcaggaggctgttatagtaaccccagcaagagggatgggtcccaggtcccgaggcgggaaagaccggagagacgtaccaggggaccaactggctggggcgtgggagcagtctggacggacttcctcccttgcctgccgggtctcgggattggggctgcgtcgtggacgaggccctgggaggaggaggtgtgggagctgtgggcagccggtggagaggaccctgggctccgaggatggagacctcgttgagagggggtgtgcctccctcctccccacaccattcattcccaaaccctcctttacttcccatggagacagatcaagaacaggtgctggggtgggaggctgggggcgccccctctctggccccaggtgaccatctgtgactctgcccacaggtccccctgggcctcgaggtcccccaggacccccaggaacacctggatcccaggtaaggactttgccattttaggtagggtgtgggaggcggcgggtggcgggtggccttgtctccctaggggagaagaagcacctttttaccagcaagagtcactcaggaaggagccagtcggcctggccggtgagattttattttattttgttttatttatttttaaatttatttttgagatggagtctctctctgtcacccaggctggagtgcagtggcgccatctcagctcatgcaacctccacctcctggattcaagtgattctcctgcctcagcctccggattagccgggaccacaggcgcacgccaccacgcccagctaatttttgtatttttagtaagagatgggatttcaccatgttgcccaggctggtctcgaacatccgacctcaagtaatccatccgcctcagcctcccaaagtgctgggattacaggtgtgagccactgcgcccagccgagattttaattttattagcagcagtgactctttgctgagtatatcctcctcctgttatgccagggaggtgttagcatcactcgcatttcacagatgagctaactgagtcccagagagaccagatgctgcctgaggttgtacagagggtgtaggcagagttgggccaggtcacagaatctctgcctcagcccctcaccttgccctgagaattgcccatggggaggcggcaccccaagcctgactcagcccctaaccccaggttcgccctgcctctgcagctgtcagaagtcaggaagagcaggtacaaaggccctgaggcagggaaaaggctggcaggtagtgagcaatggagtgtgtggtgtcggatgaggcacagtgggcagggccttatctacgggtcccaggtgtgggcttttgttacagtggatggaattattgagtttcagggagggtgattccatgatcttatttacatctttaaaaagctcctctgaggggccaggtgagatggctgacgcctgtaatcccagcactttgggaggctaaggtgggaggatcgcttgagcccgggagtttgagaccagcctgggcaacatagcaagaccccatctctataaaaaatttaaaaattagcctggtgtggtggcgtgcgcctgtagtcccagctacttgggaggctgagatgggaggatggcttgagcccaggagttggaggctgcagtgagctctcatggcaccactgccctccagcctgggtgacagagcaagaccctgtctcattaaaaaaaattaattaattaattaaatatgtaaaaatagaaagtagactcggcatgtctggccaatggaataagtctggtgagaagggcagggaaggctgtagtttcactccctggtgtctgtcaggagcagctgggaggaccagggaggcatttcctgagaaggggaggcttcgggatggggggcaccaggagttccctttggagagagggggagtgggcacctcatggtcagctgggtggcgatgtcaggggacagctggacacgggcctggggctcccgggagccgtctgggctgacatcagcacacgtgggaccctggccatcgctgttagtatcactagttctctccacacaccggaccacctgctccccttctctgcctgacagccgtacgtggcattggcccattttgcaggtgagaagactgagggctcagctggggtccctagtcaatagcagctccaggtggctccaggactggaggcctttgagtctgcccttcccgtgccggccgggccatcctcctctcccttcctcttctgcagactcagagcacagtgggcggggaggggggtggccagagggcactggagacttggccaggaccggcaggcctcacacgcttcctttggttttctgcagggcctggctggagagcgaggcacagtggggccgtccgtaagtgtgggctgtgcagatgggcctgggccactcccaggcagaggctctgatgcaagcccagggcactgggtggcgggggttggtgggggggttcagccctgggtggccctgctggagctcaggcaacagggagggactgagaaaggactcaaatcgcctcctgctgcggggtgaggagggaagcgacctccagagagtgcgctgacagtcctgagtgcctgcagccctggattaatgcactgtgtgaccctggcctttcattcatgcgctgtgtggcctggggccataggttaacatgccgtgtgacctgggaagtcccttcttttctctgaacctcccagaaataggcttagacagccttcctttaatcgactttcttggaaacaagaacttatgagtctcccagcctgaccaacatggtgaaaccctgtctctactaaaaatacaaaaattagctgagtgtggtggtacgcatctgcagtcccagccactctgaaggctgagacagaagaattgcttgaacccggaggcagaggttgcagcgagccaggatcacgccactgcactgcagcctgggtgacagagtgagactccatctcaaaaaaaaaaaaaaaattatgagtatagactcctgcctctagggccaaggagtcaggcgcttccttgatgcccaagcctcactgtaggggtgtggggcggggaggaggagtggagctttgctgagcacctactatgtgctggccacagtggaggtgctctcttcccccacagcgcatgtaagcttcacagcgaccccaagagaccatgctttattatccccgtttgccaaaactggccactaaggctcagagaggttaagtaacttgcccaaagccacacagcgaggcagtggtggagcctggatttgaaccagggagtgtcaagctcccaagccatgcctcctcccgtgcttgtctagtgaccaaacacaacacaggagacacaatgatggcacttctaggtgccaggctctaatctaagctcattgtccctattgattaacttaatcctcctaacaacagatgagatagatactattactgatcccattttacagttgggaaaactgaggcaccaagaagtacagtgacccactcaaggccacacagtagtagctggacatttacatgttactgtgagctgggcatggtggtggctcatacctgtaaccccagtgctttgggaggccaaggcaggaggatcattttgaggccaggagttcaaggccaccctggacaacatagtgagacccacccccatctctataaaaatattaaaaaattagctgggttgtggtggtgcgtgcccatagtcctagttactcaggaggctgaggttggaggatcacttgaacccaggaggtagaggctgcagtgagccatgatcgcgtcactatactccagcctgggcaacagagcaagaccctgtctcaaaaaattggctgggtgcggtggctcacgcctgtaatcccagcactttgggaggccaaggcaggcagatcacctgaagtcaggagttcgagatgagcctggccaacatggtgaaaccccgtctctactacaaatacaaaaattagccagacatggtggcgcatgcctgtaatctcagctactcaggaggctgaggcaggagaatcgcttgaacacaggaggcagagattgcagtgagccgagatcacaacactgcaccccagcctgggtgacaagagtgaaactccatctcaaataaataaataaataaaatacaataaaat

SEQ ID NO: 504 - DNA, 15472 bp, Homo sapiens
ttctttcatgaaccctttctcatcttttaaaaccagcctttttttttcacccaatggatacctcaaccacagccaaaggaaagaaacgaaaaataaaaattactctatcctctgatcttacataagattatctgaagttcacccatgacatattactttatacctacatgactactagaattattatagttatgtataatattgacttgtgtccttagtaactgctaatggcaggttccatgtatcattcctcttttagctagtgtacacataataggaacaagatgaatatttattaaaagccttggttaatggtggttgattaaatataccattctgtatagttagcataggttcataccaagtttggggccttaccagatatgttacagtgggcagttgcagtttgattttccccaatactttaaatattgagcataattttctcatgttaagcatcattaaacacagctttctatcacatactactgttgtgctattgaatgaaatgagtggagatgtctttagatcttgattgatcaattgatcatttccacataactataattatctttctttgatctctcattttaaaacttaaataaatttttaaaaataaattttattgtatatatttaaggtatacaacatgatattatgagatatatttagatagtaaaagttactatagtgaaggaaatgaacatatcaatcatcttatataattatacactttagttgtttctgtggcaagagcatggaaatctactcatttagcatgaatcccaaatacagtacaattgtgttaacaatgtccttatgttgtacaatagactcctagactttatcccacatagctgctactttgtatcctctaatctacatctccccatttcctctctgtccctggtaaccactgctttgttctctatctctgtatatctgaatttttcttttagatttcacatgtaagtgagatcatgcaatattatttctgtgtctagcttatttcacttagcataatgtcctccatgttcatccatgttttggcaaatggcaagtctcattattttttaggactaaataatatttcactgaatatggaatattattctttatccattcatccattaacagacacttttagtttctacgtcttggctgtcatgaaaatgggagtccacatatccttatgtggtggtaatttcatatcctctgggtatatgcccagaaaaagggattgattgatggatcacttggtagttctatttttaatttctttcaaaatctccatactattttattttttttccttttttttttatttgacagtctcactctgtcatccaggctggagtgcagtggtgccatttcggcccactgcaacctctaccttccaggttcaaatgattctcctgcctcagcctcttcagtagctaggattacagtcaagtgccaccacacctagccaatttttgtatttttagtagggacggggtttcaccatgttggccaggctggtctcaaactcctgacctcaggtgatcctcctgccccagcctcccaaagtgctgggattacaggtgtgagccactgcacccagccgaaatctccatactattttctataatggctgcaccagtatgcgtttccatcaacagtgtacaagagttcccctggctgataaaagctggaaacatcttgaatcaacaacctaacatcacaattaaaagaactagagaaccaaaagcaaacaaaccccaaagctggcagaagacaagaaataaccaagatcagagtggaactgaaggagatacagaacgaaaaaaccttcaataaatcaatgaatccaggagttggctttttgaaaaaattaataaaagagactactatctagactaataaagaagaaaggaaagaagtatcaaatagacaaaatcagaaatgataagggggatatcaccactgaccccacagaaatacaaacaaccatcagagactactataaacacctctgtgcacataagctagaagaaatgtataaattcctggactcatacaccctccaaagactgaaccaggaaaaaactgaatccctgaatagaccaaaaatgagttctgaaattgaggcagtaataaatagcctaccaagcaaaaaaaaaaaaaaaaaaaagcctgggactggatggatttacagttgaattctaccagaggtacaaagaagagctaacaccatttctactgaaactattttaaataattgaaaaggaggaactcctccctaactcattttatgaggccagcatcatcctgataccaaaacctggcagagatacaacaaaaatataaaacctcgggccaatatctctgatgaacatcaatgcaaaaatcctcaataaaatactggcaaaccgaatccagcagcacatcaaaaagcttatccaccatgatcaagttggcttcatcaccaggatgcaaggttggttcaacataagcaaatcaataaatgtaattcatcacgtaaacagaactaaagccaaaaaccacacgattgtctcaatagatgcagaaaaggccttcaataaaattcaaaatccctttatgttaaaaactctaaataaactgggtattgaaggaacatacctctaaataataagagccatatatgacaaacccacagccaatatcatactgaatgggcaaaacctggaagcattccccttgaaaaccagcacaagacaaggatcccctcttttaccactcctattcaacatagtattggaagttctggccagggcaattaggcaagagaaagaaataaagatattcaaatagaaagagaggaagtcatattatctttgtttgcagatgacatgatcctgtacctagaaaactccattgtctcagtgcaaaagcttcttaagctgataagcaacttcagcaaagcctggggatataaaatcaatgtgcaaaaatcactagcattcctatacaccaacagcatgcaagcatagagccaaatcatgaataaactcacattcataattgctacaaagagaataaaatacctaggaataaaactaacaagggaagcaaaggacctttttgaggagaaccacaaaccactgctcaaggaaatcagagaagacacaaacaaatggaaaaacattccatgctcatggataggaagaatcaatattgtgaaaatggccatactgcccaaagtaatttatagattcagtgctattcccattaaactactattgacattcttcatagaattaggaaaaaaactattttaaaattcatatggaaccaaaaagagcctgaatatccaaggcaatcctcagcaaaaaagaacaaagctggaggcatcaccctacctgacttcaaactatattacaaggctacagtaaccaaagcagcatggtactggtacaaaaacatgcacatagaccaatggaacagaatagagaactcagaaataagaccacacacctaaaaccatctgatcttcaacaaccctgacaaaaacaagcaatggggaaaggattttctatttagtaaatgatgctgggagagctggctagccatatgcagataattgaaactggaccccttccttataccttatacaaaaattaactcaagatggattaaagacataaatgtaaaactcaaaactataaaaaccctagaagaaaatctaggcaataccattcaggacacaggcacaggcaaagatttcatgatgaaaatgacaaaagcaattgcaacaaaagcaaaaattgacaattggggtctaattaaactaaagagcttctgcacagcaaaaggaactatcatcagagtgaacagacaaaatacagaataggaaaaaatttttgcaatctatccatatgataaaagtgtaatatccagaccctacaaggaacttaaacaagaaaaaaaaaacattttaagaagtgggcaaatgacaggaacagatgcttctcaaaagaagacattcatgcagtcaacaaacatgaaaaaaagctcatcattgatcattagagaaatgcaaatcaaaactacaatgagataccatctcatgccagtcagaatcacgattgttaaaaagttaagaaacaacaaatgctgatgagattgcagagaaaaaggaatgcttttacattcttggtaggagtgtaaattagttcaaccattgtggaagacagtgtagcaattcctcaaagacctagaggcagaaataccatttggcccagcaatcccattattggatatatacccaaaggaatataaaccatcctatcataaagttatatgcatgcatatgttcattgcagcactgttcacaatagcaaatatatggaatcaacccaaacgtccatcagtgatagactggataaacaaaatctggtatatatacaccatggtatactgtgtagccataaaaagtaatgagatcatgtcctttgtctggacatggatggagctggaagccattatcctcagcaaacgaatgcagaaacagaaaaccaaacactgtatgttctcacttacaagtcggagctgagccataagaacacatggacacatggggcgggggacaacacacactggggcctatcagtggtgagagaggtgtgcgggggaagagagagcattaggagtagtgaatggatgctgggcttaatatctaggtgatgggatgctctatgcagcaaaccatcacggcacacgtttatctgtgtaacaaacctgcacatctgcacatcctgcacatacactctggaacttaaaatgaaagttgggggaaaaaaagaattcccttgtcttcatacccttgccaaaatgtgttatcttttgactttttgataatatacaccctaatgggtgtgaggtagtatcacatagtagttttgatttatatttccctgatgattaatgatgttgaccacatttgcatgcacatgttggcaattttcatgtcttctttcacaaaatgtctattcagggtattttgcccattttttaatcatgctatttgtctttctacatttgcatcttaaccccttatcaggtatatggtttgcaaatatttttccccaatttgtagcatgctgttttattttgctgattatttcctttgctgtgcagaagctttttagtttgatgtagtcccatttatttatttttgattttgtggcctgagcttttggtctgatataaaaaaaaaatcatttctgaggccaatgcccagcagattttcccctatgttgtcttctaggagttttatagtttctggtcttacctttcagtctttcatccattttcagttgatttttgtgcatcgtttaagatagggtccaatttcattcttttacgtgtagaaatccagtttttgcagcaccatttagtgaaaagactatcatatacccattgtgtgctgttggtgtctttgtaaagaatttgttgacagtacacatttagatttatttccgggatctttattctgtttcactggtctatgtgtctgtttttatgccagcaccatattgttttattatagatttgtaatataattttaactcaggaaatgtgatgcctccaactttttttttattttcagaattgttttggctatttggggtcattcatgttttcatacatatttttggaatgtttttttatttctgtgaagaatgaccttgggattttaacaaggattgtgttgaatatatagaatattgctttttgacattttaacaatataaatttttctgattcataaatacagtgtatctttccatttatttctgtctccttcaaattcttttatcaatgttttctctttcagtatacaaatgtttcactttctcggttaaatttattcctaaggacagatggtcctcaactcacaagttttaactttacaatggggtttaagacataaccccattgtaagctgaggagcatctggacttgtgatggtttgactcaacaatttttcagctttaatatgagtttatcagggtattgagtgcatttttgacatacaacattttcaacgtatgatgggtttatcagaatgtaaccccatggtaagtcagaaagcatcagtaattttttatggtaccataaatgaaattgtttttttcagttagattgttatttgtgtatgaaatgctagtacttctggtaccatgttaatttttccttttgcgactttactgaattcatttattagttctaacagttttttctgtggaatcattacacataagattatttcatctgcaagtggagatttttttttctttttgattttgatgtcttttatttcttttccttgtatgattgctcgtgctagtacttctggtactatgttgaacagaagtgacaagagtgggcatccttacctagtactggatctgagtggaaaagctttaacttttccccattgattataattgtagctgtgggtttttcataaatgttttttattatattgagaaacattccttttatgcctaaactgttgagagttttttttttaatcaagaattgatgttggattttgaaaaatgctttttctgtgtcaagatcattgtgtggtttttatctttcattctgttaatgtcatatattactttgattgatttgtatatgttaaactagccttgcatatcagaaataaatcccacttggtcacaatatataattcttttggtgtgctgttgggtttagtttgttatgttgttgggtttagtttaatcctcaatattttactaaggatttttgcatctgcattcgtcagacagattggtctgcatttttcttgtcttgtaatatctttgtctgacttaggtatcaaggtgatgtggtccttataaaatgtggttggaactattcattctacctctattttgtttaaaagagtttaagaagtatcattattaattctctgaaggtttggtagaattcagcttttataaaactatctgtttctgggcttttctttgttgggaagttttttgttacttctttgatctctttatttgttattggtctgttgttcaagctttctatttcttcttgaattgatcctggtaggttttagtttttgtttttttgttttgttttgttttattctgttttttaagcaatttatctgtttagattatccagtcgttggcatatattttttcgtagtagtcttaacgatccttttaatttctgaggtgtttcatttttttcgctttaatttatgattttatttattagtcttccctttttttcatttagaccagctaaaggtttatccatttttttttattttttgaaagcaccaactcttaattttattgattcttcctatgatttttctgttctctatttatgtttttatttttattattttcttctttctgctaatttggggtttaatttattcttcttttgttagttccttgaagtgtaatgttagattacttatttgagattctttttgtttttaatgtcggcatgtattgctataaacttttctctttgaactgcttttgctacatttcataggttttggtatgttgtgctttaattattgtttgtctcaagatattttttaatttctctttttatttcttctttgactcattggttgttcaggagcacgttacttaattatcatataattgtggattttcaagattcctcttattattgatttctagtttcatagcattatagtctgaaatgatattagatattatttcaatttaaaatttagtaagtcttgttttgtggcttatcatatggcctatcccagggaatgttccatgtgaactaaagaaaaatgtggcatattatcctgctgttaaagtaaagctctgtatatgtctgttaggtctaatgggtgaaaagtgcaattcaagtctagtatttcttttttaattttctgtctggttgatctatctactctttttaaattattttttattaattttgtgttcttttttattttaatagcttttggggtacaagtggtttttttgttacatggatgaattatatagtggtgaattctgaggttttagtgcatctgtcacctgagtagtgtatattgtacctaatgtgcagtttgtattcctagcctcactcccacgttcccccttctgagcctctaaagtttattatatcattctgtatgcctttgcatactcatagcttagctcccacttgtaagtgagaatatacaatgtttggttttctcttcctgagttacttcacttaaaataatggcctccaactccatccaaatatctgcaaaagacattatttcactctttttaatggctgagaagtattctatggtgtgtgtgtatatatatatgtgatatatataaatatatatcacactttatttatgcactcattaatcaatgggtacttaggttggttccacatttttgcagttgtaaatcatgttactataaacatacatgcgcaagtgtatttttaatatgacgacttcttttcctttgggttgacatctagcagtgggattgctggatgatctatccgttgttaaaagtggggtaataccagcactttgggaggccaaggcaggcagatcatgaggtcaggagattgagaccatcctggctaacatggtgaaaccccgtcttgactaaaaatacaaaaaaaaagtagctgagcatggtggcaggcacctgtagtcccagctacttgggaagctgaggcaggagaatggtgtgaacctgtgaggcagagcttgcagtgagctgcgattgtgccactgcactccagcctgggcaacagagtgagactctgtctcaaaaaaaaaaaaagtggggtattaaagtccttcaatattataatattgctctttatttctcctttcatgtccattaatatttgctttatgtatttaggtgctccaatgttggttgtatatatatttacaattgtaatgtcctgttgatacattgacccctttatcattaaataatgacattctttgtctcttgtgacaatttttgacttgaattatatttcatcaggtgtaagtatagctactccttctctctttattatttgcatggaatatcttcttccattgctttactttcagcctatgtgtccttaaagcttaactgggtgtcttgtaggcagcatatagttggatcttgtttttattcattcaaccattctatgtcttttaactagagaaattaatttatttgtatccaaggtcattattgataggtaaggactcattgctgtcattttgttatttgttttctgattattggtagcttcgtttctttctctctcattgtctacctttgtaatttggtaattttctgtagtgttaatccttgattcttttctctttatcatttatatacctgctgtagtttcttatgttgtggttaccatgaatcttccataaaacaccttataatcaactattttaagcagataataacttaaattctgttgcatacaaaaactctatacatttacctttcccctcacaatttgcttttgatgtcacaattttcatcttttaatattgtatatttattaacaacttgttatacgtttagttatttttgaccattttgacatttaaccgtcatgctagagatacacatgatttacacaccactattacagtattagagtgttcctgattttactatgtatttacctcttcagtgagtttatactttatagatatgtcatatgtatttataatagtaattgtcattttttaagattcccatttgaagaactcctttaagcatttcttgtaaggcaggtctagtggtgatgaattccttcagcttttcttgtctgggaacaattttatttccccattttgaaggagagctttgttgaacatagtatagttggctagcaatgcttttgttctttcagctctttaaatatattattcaatctctcttgatctgcaaggtttctattgagaaatccactgataacctaatggcaattcctttacatgtgatttgatgcttttctcttgttgcttttaaatttctctttgtctttgactttgaagagtctggttataatgtgccttagagaggatctctttgggttgtatattttggagggcctttgagctttatgaatccaaatgtctatatctcttttaagatgtgggaaattttcagcaattattttattaaataagctttctgtctctttctttgtctctttttcttttgtagaatgtgcttgcttaatggtgttccataagtcttgtaggctgtcttcactattttttattctttttcctctgatggagtaatttcagaagacctatctttaacttcacagattttatcttctgattgatctcgtctgctcttgaagttctctaataaattttttatttcattgattgaattcttcagcttcaagatttctgtttggttctttttatatctgtcttttcattgaatttcctaattatataatgaattgttttcctgattttattaaattgtctatttgtattctcttgaatctccaagtttccttcagttcattatttaattttatttcatttttattatttttctgagacaaagtctcactctgtcacccaggctagagtgcagtggtgcaatcttggctcactgaaatctccacctcccagattcaagagattctcctgcctcagcctcccaagtagctggcattacaggtgtgtgccaccacacatggctaatttttgtatttttagtagagacagggttttgccatgttggccaggctggttttgaactcctgacttcaagtgatctgcccatctcagcttcccaaagtgttgggatcacaggcattagccaccacacccagcccagctcattactttaaatcacttttcagagagtttgtaatttctgcttctttgtcgctagttattggagaactatgatttccgtgtggtaccatgcttccttgctttcatgttccttgtgtccctgcattgatgtctgcacatttagtgatgtagtttcctttttcaaactctagtaggggaagactttcagttgcatatgggtctgaggctgccagttgggcagggcgcctctggttacatgtaggcacagtggggtaatcaatgtgcagcttctttagttgtgatcaatgtcagcaatgaatgtaggtgcctcagtggcctagtttgtaggttgctagggcaaaggcttaacaattctcctgttcttgtctttcccacagtggggagtcttagctgaagaaaactatttttgtgtttggtctgatatggcccacaggcaaccatagcagcactgggagccagggcataggtgatcagagtagctgtggatataggtcatgggctcagggtcttgtgagactactgtagcaccttggacttgaggcacaggttcactttccaagatacaaatgaatgcagtttccccagtaaggcagggtctgttcctctgaggtgcacctcaccatcttaggcccagagtgctgaaatatagctgaggttgtgaccctggtggacatgggacaccactggcacagcttggtagaaaaaggagttctctagaagcttgggtccagggagcagagaatagctgtaatttgggaccaggagtcaacagaggtcagcaaaaatgtagacacttagcgatgaggtactatgtagtggtgactctggaccctgggatggtgggacatatcactaccccaggctctatgaggccaggtacagcagcagcaatgatgcagaaatggcaagacactgctgtagcttggaccttggtgggaggggtgcagcacagcaccagtcccccaagaggcagcatgtcagactgcaggggtgtagtgcaattttgggtgggcaggcatgtggctgttcagcctggagggcagggtggcacagctcaagccaggccttatttctttgggatgtgttgtgccacatctgtctggccccagaaatcatgtccatatgggtcagtggagcctctggatgcctgtggggtacggtactacattagctatggcactggagtgtgcaattattcttgtgtgccaaaggctctgagcccctgtgggtagcatgctgtcttatctgtggtgccagggctgggagtttactgctctagtgtaagtctgtgatcctggatggtggtggtggggtatgctgcctcatctatggcattgaggggcatgactgctctggtgtgcagaagacctgaggtccctgagggttggagcgccatttcagttcagtcctgagaggagagtgcacagtaactggaatgtggggagtggagtagctccacggaacttggccctagagggtaggaagtagtagcagcttggctggtggatggtatgctattatatggcttgttgcagtggtaacaaaacatcagggatggaggggtgcaatgcatactcacgcttggagcaggatgcacttgttcccaagattgtacagggcagtagcagcaggagccatgagacaagaggtaggggctgagaagaggagggagggccacagcatcagctccttctctagggatagctcagtatgtagactctggggagcaccctcagctgggctcaaaccctataaggactgcagaagtctctagtgcaaagactgcatgtatctgtggagatgacggaggttgttggggtcctcttgcttacctttttcctgcagaaaggggtctcttctggttttgagttgatcccaactagggaaatgggatggcagaggcaaggtgtttcctcctgtttcctatgtggccatcctgtgtttcagtggtctacaggatttctgctgctgttctccagagctttcctttagttattttgatcaagatgtagttgcttattcattatttttagttttttgtgggaagtgggaagagcactagaagcttttagttggccatcttgctgatgtcaccaacatggatctatttttgttttataatgttaaaatactatatctatgtacaatttgtcataatttacattttatatagaatccttacttatttttaatctcccaaaaaggttctacataaaatcatcatcaatttctagacgcttaataatagtttttgaagtcgttgcaaaaatgtaacttttcaaggaaattaaaactagctgcataatgttaaagaaaatatcaaatgtgagaactgtgtgtgatatattcaaagactgaatccatatttgcttatatttatagaaaggaaacaggactagtaattctatgggctgtaattttatgtcaacttctacctaaaacagaaatatgaattatttttaataatatgcctgcctttaatcgcatggatgaatatttcacaaatttggtattttaacatctttgatgccaaatacataaaactaaagaagtctttaatctgaaaaaaaccagaagtataaagaataccctgttaataaatttgttaattcatcttttgggggatggtgtttcctgatttagtctttagctgcaattcatatttgaagtttgaatgtaaaaaaatgagactcaattttctagtggcttataggaccagtctcatttctttttaatccactacgcaaataaattgtttgttacttatttggcttaggaaaattagtttacataactcgaaaaataaaaatagcctaaatgagcttttgttccacaaaaatcaattaaacttatagctggcattttgtaaataaaatttatttaaacaaaatgaaggatccttcagtccctccttaaagagaactgacaatttggctgcttcccaattcttcaactctgacttctccttgatagtcaatctgtgaagcagagggaaaaaaatctcttcccagaactgcatcagtcttctctgactggatgcactgtttttgtcttgttttgctgtttttcctctagtgcctgccaatttttagcctatgaagatggaaataataaaaaatatggtgattaatgaattaaaaaaatggtgattagtggagtaaagggaattaataatataaaaataacttctttaataatgagatatatgatatagaagaagataattattaaaagttaaaagcataataatttgattcaaattccttgaacacaagaggtagaagttagactaaggtgattacttagaatatttgctgtgaaaatagagcacccataatttttagtgtcactcataatttttttatttttctaatttttaaaaagttttatgaacctataggtttatttcatatttttagtttatttattttcatttttaaactttaattttagtctcagggatacacatgcaggtttgctatataggtaaactcgtgtcatggggagttgttgtaccaattattttatcacccaggtattaagcctagtacccaatagttattcttaatgctcctctccctcctcctaccctccaccctcaggtagaccccagtttctgttgtttccttctttgtgctcatgaattctcatcatctagatcccacttgtaagtgagaacatgcggaatttggttttctgttcctgtttcatttagttttcatttagtttacatatatcaaagatgaccagcactgaaagcttatgagatttgtcatttgtataagtaccaggtaggatgtagaaagataaaaatccctcagataactatgatttctgaacaggaagactcaacattgccatcttcccctgcccaacgatcttcaattcctattgctccattatccaaaaaacattcagtctaaaactaagggtggcaaatacgagcactaattggaatgatagcattttaaattgttaactgtggtttctaaggtcatctttttggatactatgaccagattttgttagaaagtaagagaagacattttgtacttctgggagaggtcacactgacaacagaaacagatcaagaacagtgggtttcagggcagaggacagagggcaatttcacaggcttttatacattcgctagagctggctccactcaccttagtcacagaacacttagacatgtccttatatgttctcctggtctgcatttttttaaactcaagtttttctaaacattttatttgtgatgtaatgttttcccttgtgctatttctccctgcccccaaactgattggtgtaatttgttttattcttgagattttacccatgaaaatactaagagagagacagagaaaaaagagcttacctggtatttctgttgttttaattgaactctgagtttcagctttagaaggaaaaaaagaaaaaaaatcagtacaattaaatgttgaatatcagatctattctcacaattgtttcaggtggtaaatgagtatgaattttagctcatttctgattcactattttcaaatcata

SEQ ID NO: 505 - DNA, 15483 bp, Homo sapiens
cacaatgtctcttaaaatactatgtctcttactagattatacactccttgacagacgagaaacatgatttatttttcaaatgccttgcacaaggttagtgcgaaagtaacgattgcaggatttaattacacttttaaaagaaaaaagacattcttcatcttatgaaactctgcatggcaacactttatgcgccccacacccccactcaacacaaacacaactctggaagtactgtgttgataacagaaatgtggtgggttttatttttaaccaataaaggtcaagtttgcattatgtgattttgtgtgtgtgtgtgttgaatcttttaaatgcatatcttacagctctggttcagttgttgtggggagaggaaaaaaacctcatccctgccaacacattggtttgtatgaatcacagctcagtgaaacctttcaggcatataatttatcttttctttggcctatgtagtaaacgcttcatttgttcatgaattcttgccttgttttaattatgctttgccctgaatgtagttttataaggcacaaaaataagattgtcgttctgaaaacacagaagatttgtatgtttcccccaggatgaaatggtggcatctttctcccaattcacagctctgtgggcttgtggctggaattccaatccagcagggagcaagccataaaaatggggggaagggctgctggagggaggcagtagatgcggctgagcccaaggcataattcaccctaagaattctgaatcaatacactgacatccagccatgtacaatgtggtactcccaccaagaaagccactgattgagaagttttattcatgttactttctgagggttggattgtcccattacatttatagaacaattgcttttttccccctaaatacagaactatgcagccgggagtcagaaaagaaaccttgacaatcagaaggctgttttgttgttgttgttaaaaacctttgcaggcatatgcatctgaatatccataagttcacaggctgagggagaaatggctatttcataacttttctgtgtttctcatgtacatagtacaaagtgggcactcagtatttcaaatttcaatatcactgaaaaaaatggaaatttgtcatgtaacaaaatcagatgcagacttcactggtgaatctgagggagtgaattcacttattcagaaaggaagacagttacaattcttgggtcttctgagagatcattataacttgaaaatattacacaagggctttgctatattagatacctgccatgttcctaacacaagctcccattttctgactcaaatctcattttggaacacattccactcaaattgaggttctacccctaagagttctttttcaataaagaaagctgagttaataaatcacaactccaaaacttttcctcacttttcttagactagaaatagattgagtgtgtcgaggttttatggctgagtacattggagggctggctattctatgctgaactggtttacttgattaagatggggatttggatgagtcaccggacacctgtccaaagatgagtaaaacacattccttcattgtcttcccataaataactcaatcttctcctaactgagccaatggataggctttggatgcccaagcaaaacaaacacatgactgttaaaaaatcacaacctcaaaatggccttagaagcctatgaccaataatgagaatggtttctccactcaggcgcaagtagtaaacagtttctcccatatgcaggaatattgacgactagtttaccgcctctgggcacgtaactttcaggtcctggttcatgcatttgctggaatgttccctgggccatggagcccagttctcctggcatctggcatctcccccacactctgctcccccagcacagcacttggcatcttgcattgcaattgcaggtttatttattcacttctctcactggacagcaaactccaccagggccgagactctgtgtctcgcccttcactgtggtccctgtgcctcacctgttcctagtacagtgtcacactcagtaaagagcagatgcctggtgcatttggagacttattttaaattatacggaaagttattcaaccggcttcttgaactggtgaattttggaaagtgggtgtttgaagggaaaatgtttaaactctgaaagaaatgttggaaataagctctttgaatcaaaatgtatagaaaacacaagaatgctgacagtaagagcctaaaacacatgatgactattatcttttcccaattttaactctccagagtgttcagcggtgcccagccttcataatgtaattcttcgtagcaccctggatgcattaaaaccatagattaacgtgatacttattttcattaaggaaaataatttacgtacagtgctcagagtagagcctggcacattgaacattttcaataaatgacagcaagtgtaattattagcacttcggaagtgcaaagttgcattgtattaagacaaatatatttggagctcatccaattttttcctggctctgaagtctgctagtggcacttaactttattcccaagttttgaaaaatattgttatttaaaaagtctgttaaccaaggaaatgcatgccctaaacctataatgtatcaagttttacttccttcttcttttaaggagttcttttcctgccttgaatacaaacaggctctctcaaggttaaaagcaaatgctctttttagtgtcaaaaagagcttgcctttcttcgctcaggaaaaaaagcaactgattccaggataccttctttgaaaaccaacacaaaaaaaccccccaaaaaacaaaaaaaaaacccaaaacccctagtttttacaaaggtttattactcctacttgttggaaaagaattactacataaaagagtctgcccagagctgtaaaatctccttattcaaacacacaccttagagcaaaagatggttaaatatcaattcaggctattaacagtaagggacgaaatgtgttccaacaaaactctgcatgtcaacaaactacagagactaggtaacatcttttaggaatcatttttattccactaatgccttttcctccagaatccactgatcgtaaacgcaacctgtctacttccgcctttgaaaaatggatggacaaattcatctgcatgtaactcacctcctcttttcttttacataaaacagatgccacagctgttattgttcttcacacagaagtttctacccagagaaacatcaggatgacactctgctgcaatgtgctatttgttctagaggggtcaacagcttgccaccttgcctaggcccagggtgactgcatatgtgcagtggtcttatcccattagcgcccccgagcatgcattcagaaccaagtggatacaccttggcacacttaccttccctgcagggacatcatcggactgccctgataagccaggaacctcatccaccttgtcttgatgctctgccctcttggcttcctgttggctgtcacctggcaccttttcctgtcccttgtccagcttgaagaatttgtcaaaaaagctggagtccttgggcttggagggagcttctcctcctgctccccctgtctcaggtgggagaagcgtgggatccctggcggcagagaggaccttgtcttgggccggggcgtgccctggggttttatctgtgtcctgccccggtccagctgccaccggaagtgtccagctctcacttgggtctttgttcgctggagctttattggagctgacatcaagcttcactgatccaagggatgaatctgcggcttggtctccggtacgtcctggtacaggccgagagagcatcaagaaaaaacgagatttagcagctggtgcctcgggtttggcctctttcccaagattctttccgttggcatccgcaacagcacttatctccgttgtctcgggggaagaagtggccacattatccgtcttgacacttattcccaagtcgactgtaaacacaaacataaacagtggttattcagccaagccgggaaattcaggcactaataatggactccagacattttttatacaaaagccatactgcatactggaactgtgttgttctctggtcattctgaaaggcagaagttagctctctacatctccttggaccctgcttttcttgggagaggagaaggcaaggttggtgaggagggaaagctacttaatggaaagtcactagctgccaggtgtggaatgagtgatattcaatgttaattaatcttcttttatctgtgtaagaactccgtgagcagcatattgtcatgatgtcaactgggaggcagtacagcagttaggagcttgggttctggagctagaacaaggtttctcaacctcagcactactcacatttgaagccagattattctttgttagggaggctcatcccgtgcctcataggctgattagcagcatcctggcctctgcccactagacgccggtcacatttcccagtcatggcaaccaaaaatatctctaggcattgctaaatgtcccctggaggacaaaatctcttacgtttgagaggcactgagctgaaatgtctttttgaatccagattatctaattttctgtgcctcaactttctggtaaaaggagacagataataaatctcgtaattttgttaggaagattacatgagttaatagttttaaagcaagtacaatagcacctggaatatattaagtgcttaataaatatcacaaacattagttatcattattcatgagtgagaaaactgacagtcagagaggtcagtacaccctcccctggctgcccagtaagctagtaagcagcagagtctggcttcaggcagaaatctgacttctaagttcatgcgctctctgtcttaccagggacttgtattagcatagactgttaagaatatgggaagatttttaaaatacagtactcagaaaatttctctttgaaaggctggaagagcagatatccacacaagaaggcaaattagacctcaggccagtgtggaattaaaggtgtagggttatctggtcaagactgtgtgtgtggatacaggctccaacccctccaggcaagggcactgtttccaacatccaccctttctcctttgacctctaccttgacctaaattaactataaaaggtccttcttttctaggaccctactataaatcagtgaaatattcaggaaaaaaagaacaccaagaatgttgggatcccagttaaagatcaagattctctactgataagctgtgtgatatggagtaaatcactaaagatctttgaatctcttcatttgtaaaatgggaatattggtagtcctactgcagggttgttgtaatgcttaaagaagaaaagtcatgcaaaggatctggcacaacgccttttccataataagtgcttagtaattgacagatactgtgataacttttcaggtttctctcatgcctttgacaacattgcattttgcttgctctatctgtagtcagacacttcttaatatctgtttgcaggaagacagaaaaataaagggaagaattgagatttctttgatctattcatactgctcattaatatgtagtgagaaatacatacacacacacatacacacacatgcatccattagcaattgtttttgcccaactctagtgtctcgcagtgtctagactaaacaacaaacaaaaaaggggggagagtgagctggattaagcattgaggcacagtgaagaaatggtctggggcaagcccagggatgaatgttaggggtttctcataaacctgaacctgaagaaaatcaccctgccagcatattgatcttctagctcttcttaacctttttttctgtgattcaggaattcataatgatagaaaatattatactaaagaagaaaaaaagagggagaataagtaagtgatagatggatgcatcagggtgtaaagttagcaagtaaggctgttgaagtgtcagagtgaatataaatgaattgtgggaatggtccatgccaggagaagagggtatggttgacaaaaagggaaatgctaagattcaaaacagggaagggcttttcaaaatgccaagagcaccaacttatatctttcagtttaattcctctcttccttacccactggctggaaagcaaaggagctagtggtaagtaagagtgttatagccagagaaaaagtcttcaaaaaacacaaagtactttccatggacaaccttttttattttaaagtgccaatatgttgctttgaaaaagaataaattccttacatccaggtatctggactagacttcagtgcatttagtgattatagcaaatccaaacagtagcttttgatatcagagaatgggtaaagtgtttttgacaatttctaagaacttagagttcttcggtgatacgttccatgcaactgaagctctgctctccaaatttaggtgggtacatacccaagtccatcacctggggcttctatttcctttgctcagatgctcacctcctaggtgggcacctgacataagatagactaataaaaataagtcctgtaacttttgatactcctattaaaaaagagttgcaaaccaataggaggtacacttgagaatcagcacaaatgaaagtagaacctggaaatccaggaagcagatacccaatcatgtcatttaaacatttagatccagctgtgcctgaagctgaactttagcattacataagccaataaatcactcttccccaacttacgccagttgaaattgaatacatactcagtgactttgagagaattccagggaattggtcagtccctgtttcacttgtaaatacacagcaatcaagcctaccaaatctatgattgattggggtgtctgaaagagatggagggaatggaatcaacctgaaaaacatatttcaggagttcatccctgaaaacttccccaacctagctagaggggccaacattcaaattcaggaaatgcagagaaccccagtaagatactccacaaaaagatcttccccaagacatcatcatcagattctccaaagttgaaatgtaagaaaaaatgctaaaggcaactagagtgaaaggcccggtcacctaaaaagggaagcacagacttacagtggacctctcactggtaaccctacaagccagaagagattgaggaccaatattcaacattcttaaacaaaaagaattccaacccagaattttatatctgactaaactaagcttcataagcaaaagagaaataagatcattttcagacaagcaaatgctaagggaatttgtgaccattagaccttccttgcaacagttcctaaaggaagcactaaatatggaaagaccattaccagacactacaaaacacactgaagtacacagaccagtgacattgtaaagcaactacataacaagtctgcaaaataaccagccaacatcatgatgacggtatcaaatcgacacatagcaacactaaccttaaatgtaaatggactaaatgatcccattaaaagacataaagtggcaggctggataaagaaccaagaaccattggtatactgtcttcaagagacccatctcctatgcagtgacacacataggttcaagataaagggatggggaaaaatctaccaagcaaatagaaaacagaataaaacaggggttgcaatcctagttgccgtcaaaacagactttaaaccaacaaaggttaaaagaaaaaaatatgggcattgcataaggataaagtgttaaattaaacaagaagatctaactatcctaagtatatatgcaccaaacacaggaacacccagattcataaagcaagtttatggagaccttcaaacagacttagactcccacacaatagtagtgggagactttaataccccatgacaatattagacagatcattgagacaggaaattaacaaagatattcaagatctaactcagcactaaatcaaatggccctgatagatatctacaggactgtcctacttgaaaccatacaattacatggtaattgaatgacctgctcctgaatgacttttgggtaaataataaaattaaggcagaaatcaagaagttttttgaactaatgagaacaaagatacaacataccagaatctttgggacacagctaaggcagtgttaagagggaaatttatagcactaaatcccacatcaaaaagttagaaagagctcacgttaacaatctaacctcacaactacaggaactagagaactgagagcagaaaaacctgaaagctagcagaagacaagaaataaccaaaattagagctgaactgaaggagattgagacatgaaaaaccattcaaaagatcagtgaattcaggagctgttttttttttgaacaaattaataaaatagaccattagctagagtaataaacaagaaaatagaaaagattcaaataaacacaatcagaaacgacaagggggatattaccactgaccccacagaagtacaaacaaccatcagagaatattatgaacatctctatgcacataaactagaaaatctagaagaagtggataaacttctggacatatacacccttctaagactgtaccaggaagaaattgaatccctgaacagaccaataatgagccctaaaattgaggaagtaatacatagactaccaaccataaaaaaacccagtactagatggattcacaggtaagttctaccagttgtacaaagaagagctggtacagttcctactgaaattattccaaaaagttgagtaggagggagtccttcctaactcatttgatgaggccagcatcatcctgatatcaaaacctggcagatatacaacaagaaaagcttcaggccaatatccttgatgaacttcaatgcaaaaatcctcaataaaatactggcaaactgaatccagcagcacaccaaaaagcttatccaccatgatcaagtagaatgcaagttggttcaacatatacaaatcaataaatgtgactcatcacataaacagaactaaagacaaaaactacatgattatctcaacagatgcagaaaaggctttcaataaaattagacatccatttatgttaaaaactctcaataaactaggtattgaaggaacatacctcaaaataataagagccatgtatgacaaacccacagctaagatcatactgaatgggcaaaagctggaagcattttctttgaagactggcataagacaaggatgatctctctcaccactcctattcaacatagtattggaagtcttggccagggcaatcgggcaagagaaataaataaagcgcatccaaataggaagagaggaagtcaaactatccttgtttgcagattacatgacattatatctagaaaaccccatagtctcagccccaaagcttcttaagctgataaacaacttcagcaaagtctcaggatacaaaataaatgtgcaaaaattactggcatttccatgcaccaacaacagtcaagccaggagccaaaccaggaatgcactcccactcacaatcgccacaaaaagagtaaaatacctaggaaaacagctaattagggaggtgaaagatctctacaaggagaataatgaaccagcgctcaaagaaattagagatgacacaaacaaatggaaaaacattccatgttcattgataggaagaatcaatatcattaaaatggccatattgcccagagcaatttatagattcaatgctatacctattaaactactgttgagattcttcacagaaccagagaaaactattttaaaattcatatagaacccagaaaagagcctgaattgctaaggcaatcctaagcaaaaagcataaagctgaaggcatcatgctacctgacttcaaactatactacaaggctacagtaaccaaaacagcatactactggtacaaaaacagacacatagaccaatggaacagaatagagaacccggaaataagaccacacacctacaactatctaatctttgacaaacctgacaaaaacatgcaatggggaaaagatttcctattcaataaaaagtgctgggataaccggctagctgtacacagaagattaaagctggaccccttccttacaacatatacaaaaatcggccgggcttggtggctcacgcttgtaatcccagcactttggaaggccgaggagggcggatcatgaggtcaggagatcgagaacacggtgaaaccccgtctctactaaaaatacaaaaaattagccgggtgtggtggcaggcgcctgtagtcccagctacttggagaggctgaggcaggagaatggtgtgaacccgggagacagagcttgcactgagccgagaccacatcactgcactccagcctgggcgacagagtgagactccgtctcaaaaaaaaaaaaaaaaaaaagaagacatacaggtagtcaacaagcatatgaaaaaaagctcaatattactaatcatcagagaaatgcaaatcaaaaaccacaatgagataccatctaataccagtcagaatgatattattaaaaagtcaaaaaataagatgctggtgaggtagtggagagaaaggaatgcttatacactgttggtgggagtgtaaattagttcaaccattgtggaagacagtgtggcaattcctcaaagacctaaagatagaaataccattccacccagcaattccattactgggtacatacccgaaaaatagaaatcattcttttataaagatacatgcatgtgtatgttcattgcagcactattcacaatagcaaaaacatggaatcaacctaaatacccaccaatgatagcctggataaagaaaatgtggtacatatacaccatggaatactatgcagccataaaaagaacgagatcatgtcctttgcaggaacatgaatggagctgaaggccattatccttagcaaagtattgccgaaaaagaaaatcaaatactacatgttctcacttataaatgggagctaaatgatgagaacacatggccacacagggggaacaacacacactggggcctattggagggtggaaggtgggaggagggagaggatcaggaaaaataattaatagatattatttcatcacccaggtattaataatacctatttcatcacccaggcttgatacctgggtgacaacaaacccccatgacacaaatttacctatataacaaacctgcccgtgtacccctgaacttaaaataaaagttaaaaaaatgcaaaaagatgacataccaaagagatgttacttttcatttttaaaaaagtcaaagaatttaaggaaaattaaaaagaaatcaagaatgacagtagcagctccaaaatatttagaaggtagagttgaaaattttgattttcttagtgcagaaaaatattttgtgctgcatgtttttttaaagaaagtcattttatctgtatatgtgattaaaaccttatttccagtgccatcttcgtgtaattgttaagaacttggattgtggatcacaggaacctggctttgactcttaactgctcactctttaaatggataacccgggtaagttatttcctgtctctgtgcctcagttttcttacaaattggcatgaaaataacagtgcctccttcagagggtaattctgaggattaaatgaaatattgcccatacagtgcttaccacaggctggtagatgattggtattcggtaaacagtagttatttttgttatactaatatgttattaatataattaccattttgtatttttaaatgtaagccataaggaaaggaattattccaatagtttaatttacaaacttgagttttctagaaagacttttaaaaacagtagtgatataaatcaatttatcttaagaaacataagtatctgggccaggcaagtttcagaaatgtttatcattttcaaagtaccaaatattctcgtcaaaacaagctgcttcatcagagttctaattatatatttaaacatacatgcacacacacacgtttgtattacaatattcaaaacttctgaggaagaattatcttttttttttcatgtgccaaagctaaaactttcacttgctacagctgtgtattagtctatttccatactgctataaagagctgcccaagactgggtgatttataaaggaaagaggtttaattgactcacagttcagcatggcagggaaggcctcaggaaacttacaatcatggtggaagtcaaagggggagcaaggacctttcttcacaaggcagcagaaagaagtgccaaatgaacagggaagagctccttatgaaaccatcaggtcttgtgagaactcacttacttttatgagaacagcatggaggaaactgtccccatgatccaatcacctccacctggtctctcccttgacacgtggggattatggggattaaattccagatgagatttgggtggggacaaaaagcctaacgacatcaagctgtaaaaacaatagctaacattcattgactgtttcccagcattaggataaatgtgtgtaacaagaggcattttatttatgtatgacatttgtttatttattatttatttatttggataaatgtctataacaagaaacattttatttaagtataacagcaaatctacaagttaggtactatcatcactcccattttacaggtcgtgaaactgaggctctgaaaagtcaagtcagttttctaatgttgtccagctaatgactggtagatttagtatttgaacccacatttgcctgattccaaagttcaaactcccaacaacatgtggtaaccaaagcaggaacagaagagaaagaagaaatagaagggagggaagatgaacaaagtagacaaagtttagttaatagaattagtggatacccaagaaaaaactatgtacaagagggggaaaaaaaccctgttttctcacatctgggaaacattgatatctatatatttttggttttaaataaaaattaggttatgtcattcatttgcataaaaccatccaaagaagggcctcacaaaattaaaacaaaatccaaactctctactatgggccacaccctccagaacttcagctcgtactatgtttttcctcacacctctcaacataccaacatgtttccacctgcagccctcaccactagttattctttcaatctggaaatattttcgctaagatcttcctatggttaccttcttatcattcaagacttaggttatgtcaggccttccctgactcctccatctgaagtaacccctcctgcttactcctgtttattctctagactccacagaggattcatcactctctgaaatgatcccattaatttcttcttcacttgtttcctctccacgacctgtaagccccaagtggacccggacttggtctgctctgcttacagctggattccagttcccatagtgctagacactaggattaagccaggaaacatgggtgaagcagcaagcacagagcttggggcacagcctagcaaacactccacaaaggaccatgattgtaactgtagtagggcacaccaatgaacaggttgggaaactgagtctctgagaagagactaatgttgtgctggatgaaatttctttttctgacaatacattatccaaatcctccaagctttcagtttaaaggggaaagcaggaactatcattataattttatttacaaagtgtccatgtatgaacattattcaccgccgaatcatctcttcctatgcaagcaacaccgtcctatgcatcaatatcctgatctgtcaggattcaggataaagtggacatatacacactaattgcaaagggaaattgtacatcttgcaaaagatgcaggggtttatagagtcttgtaacattggtgagctgctcagatcacacacatgaccgtggttggacaaggatctggcaaagttaacacagatcaccgaagaaggaaaagtggacaacacaacacagtaagttcttcaaaagagttatattagaatatcaaaagattatgttaggcctttgggaaaactcaaaactttatgaagacctcaaaaaattatgcaaaaatgacccttcaatggtcatgctgcaagagtcaaatgacacttcaaacaactgcggctttctatgttgtgcaaatgcatttgttgttttaaaggtcgtaaagtcagggtacacgtggcagatacttatgacttggaggaagacgttagattagatttgaaactttcactgaatgatcgcatttcatgcttttcatctgtacattaaaaagccagaatgtctttgccaagaaattctagcataaataaaagaaaaggatgggattttggaacatcatggtagaattcttgactatcagctttatacaacatgtctggacatttagtgatggaaatgctggattccaaaggaatgtaggcaaaggtactactacccccatgctcttcagaaaacatcctctaaaagcaacagtgatgatcagatactgtggggcaagactgacagtgacactcaagatttccactcttctctttaatcatatatttcctgtcattcatgtgctacaaaactctggaatatgcaaagctcattcaaatgcaaaaccagcctttgctccaacatgagcatatattttcatttaaagacaaatcagatgtttcatttgattttttttataaatctgataataatgtacatttaacccgtgtttacaaccaaaataattaatctctctgaaccctttgtttttcctgtctctatcctccaccctcattgccagataaataacatctgcaacctgatgtggcatattgaactttgtttatactcacacaaacacgtataagcatcccagatacacatatacagggactgtatctgtccttgttgtttttatagaaattggatcacattagacatattttctgatgacttttgtacattatagttggtcttcacagtcaatagctccaaagctatcttatcttctaaaatagctgcataatattcctcagtatggatataccaaaagatatttaaaccattgcctaatcaatgaatatcctggtagtttccacattgttttttccatttccactatagtggaataaactttcgtgttcaaaaatcctaaactggtgctatatttctatagaatagaggcacagatgtagaagtgttaccctcaaatcaatatgcatttagttttgaaaaacagacactgccatattattttcttaaaaaggctctacagattcacatttccagcagcaatgagtgtctcaagcaccttttaagtggtaagcagcttaccaggggaggtggcctattattctatcagtggcttcagttgttaggacaccacgggtcagctgtggagatacggttgtggggcaggttgagttcaggacacatagaagattgcca

SEQ ID NO: 506 - DNA, 15851 bp, Homo sapiens
aaatcacttctagccctcaattacattaaattagttcaacttacatctttattgcaacctattaatagctttgtgaccctggctacaccatctcaaccatctggacctcagtgctctataaagtagggataataacttgcttcagatctaacaagataatgcctgtaaaggtcttgtgtaattggttaaccaagtaaaataattgttaataataaaggttagggttttttgtttgtttgtttgttttttgagacggagtcttactgtgtcacccaggctggagcgcaatctcagctcactgcaagctccacctcccgggttaatgccattctcctgcctcagcctcccaagcagctgggactacaggcgcctgccatcgcgcccagctaattttttgtatttttagtagagacagggtttcaccatgttagccaggatggtcttgatctcctgacctcatgatccgcccacctcggcctcccaaagtgctgggattacaggcatgagccacagcgcctgaccaaggttaggtattactattctgtgaacttgtcttagccagccatcatttatttgcaagtaacagaatctcacttaaaccagaggaaaaagggggaatttatttagtcagatacaggcgtgtttctttctttctttcttttttttttttttgagacagagtgttgctgtgttcccagactggagtacagtggcacaatcttggcttgctgcaacctccgcttggtttaccaagtaaaataaccctgggttcaagcgagtcccctacctcagcctcccgagtagctgggactacaggcacgtgccactatgcttggctaattttttgtattttagtagagatgaggtttcaccatgttggccaggatggattcgatctcctgacctcgtgatccgcccacctgggcctcccaaagtgctcggattacaggcgtgagccactgcacctggccaatacaggcgtgtttcaaagaattcaaggacaggaagtagagcccaggatcatgagaaagtggaagcacttgatctggttggctcattctggtttcattggctaccttcaacccaatcagctaaagctacaaagtcaaagcatagtacaaacatgtcatctgggatctatccttgtggttgacaaagtggggacagtttccatagaacggggtctatggactaggcagacagccccctaagtatctattatagaattttctggaggttgacaacatgccctttaagtgattcagtggttttcatttatgtttatggccctcttctcatgaccctcctcaagtgtgccaaccaatataataattggcagccccaatctaggaactgggtgaaatgttttccaggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctggtaagtagccaaaggttattttatttacgtacatacaaataaactttcatgcacacacacacacatatatataaatccaattataattccagtacatttggattatactaattaccatttaactttgctgacatagaaaataggaattttaacttgtagcataatctgaaaacaacagaataaaaacaattgttggtaacacatacaatttttaacttgttaaatgtcaaagctggaagggacttcagagaacagctatatcaagtgggctactcaggtttatcaagggcaaagtgactttcctaaagtcacaagaggccgggcatggtggcccatgcctgtaatcccagtactttgggaggctgaagaaggcagatcacttgaggtcaggagtttgagattggcctggccagcatggtaaaacccccatctctattaaaaatagaaaaattagctgggtgtagtggtgggcgcctataatcccagctactcaagaggctgaggcaggagaatcgcttgaacccgggaggcggagattgcagtgagctgggatcatgccactgcactccagcctgggcgacagagtgagactctgtctcaaaaaaaaaagaaaaagaaaaaaaaatttttttaaaaataaagtcacaagagagtcagtgactgagccaggcttagaacccaagtcacctagattagtagtcctccagtaaaggcgattgtgcccccgggggacatttggccatatctggaaacattttgggttatcacaactgggggtagcgtgggctactggcttctagggggtagaggccagatatgctgtatatatatcctgtcgtgcctaagacagccatcacagggaagaattgtctggtctaaaatgtcagtagtgccaaagttaagaaacactgacctggatcctcctagtatgtttcttttagccaaaagtacaaagttcctaacttgtctcactggcaagacattttgtttgttcgttttgtttgtttgtttttgtttttcatatcttgctgtttccatcactggcagttttattatagaggaagcagtttgggaacgtcgctactgagaggaggttgctaaaccacctgtggggaagtggacttgtctttttgccttttgtttgtttgtttttgtttttctctttacaaatattatttatgttcattgtaaaatatttgaaaagtacaaataagtggaaaaagtcatccacaatccattattatattaaggctattaccaattttctgtctttttttttttttttgtgacggagtttcactcttgttgcacaggctggagtgcagtggtgtgatctcggctcaccacaacctctgcctcccgggttcaagtgattctcctgcctcagcctcccaagtagctgggattacaggcatgcgccaccatgcctggctaattttgtatttttagcagagatggggtttctccatgttagccaggctggtctcaaattcttgatctcaggtgatccgcccacctcagcctcccaaaatgctgggattacaggcatcagccaatgtgaccggcccagctttctgtctttttcctgtcttttctctgtttttacaagcctgagatcatactatatttacacattcataactttttccttttaatttcataatcccaggagaaataggtgggttttttttttttggctttagcaaaaataattgatttgttattaataacaatgctttgttaatataatatcatttgtttgttttttttgggtttttttattgttggtaacttttttttttttcgaggcagggtctcactctgttgcccaggctgggatgcagtggtatgatcacagctcactgcagcctcgaccacccaggctcaggtgaacctcctacctcagcctcccaggtagctgggactacaggcgcttgccaccatgcctagctaatttttttgtattttttgtagagacagagttttgccatgttgcccaaggtggtctcaaactcctgggctcaagcaattttcctgcctcggcctcctgaagtgttgggattacagacatgagccactgcacctggccaacatcatttttaatggctgtatcatactccattatatataaaatactccataatatcataacttctccatttatgaacatttagttcttttcaggtttttaccattataattaacaaagcagtgaacatcttcattcagaagtcatagactgtatttcaaattattttcttagggttcctgccaagaaataaaaaggctaggtaaaatactgtgaaccttttcaaggttttgatacatactaccaaattgctctccagaaagatttttccggtttatcctctctccaactgtgtttaacagtgtttctttcattactgaccagcactgaatttatcagttttaaacattgctaatttgataggcaaaaaaacttgtacatagtttaaatatgcattttgggccggtgcggtggctcacacctgtaatcccagcactttgggaggctgaggtgtacagatcacctgaggtcaggagttccagagcagcctggccaacatggtgaaaccctgtcactactaaaaatacaaaaattagccaggcatggtggtgcatgcctgtagtcccagctgctgaggagggcgaggcaggaggatcgcttgaaccctggaggcagaggttgcaatgtgccgagatcatgccacagcctgagcaatgagtgagactctctctcaaaaaagcattttttgacctggacatttttcacatgtcagccaactcttgctcagttccctctatcaacaatatatttggggtgttgcccacctactacatttgttgagtattgcccgataaaaaaattaaaattaaaaaaaaaaactattgtacaatagttggtcagagttcaggaactaggaccaaattttcttatatgtcaagtatttaaattccttcagcacatttagacagtatgttatcttttaatttgatttatttgtttgggtatttatttcctgtcttccctcctcttccatgccctccctctgtggaacataagcgctttgaagggaagagtttgtttattgttgaatactcagggtacagaacactgtccgaaataaagtagacacggccgggcatggtggctcatgcctataatcccaacactttgggaggacgaggagggcggatcaaaaggtcaggagttccagaccagcctggccaacatactgaaagcccgtctctactaaaaatacaaaagaaaaaattagctgggcttggtggcaggtgcctgtggtcccagctacttgggaggctgaggcaggagaatcgcttgaacctgggaggtggaggttgcagtgagccgagatcgcgccactgcactccagcctgggtgacagagtgagacaccgtctcaaaaaaaaaaaaaaaagaagaaagtgatagagtagacacttggcagaccatttggctaattgtgaagccaatttgcttggaggactagcagtataatatggtgcttaagggcacagatgagggtctctgttttgctatgcactaactatgaccttggactagtgatttaacctctctctgcctctgttttctgtcacattggatagtaatagtttctaccttgttaatttgtcaaggatttaaataaactcagtatctggcacataattaatgctcagtaattgttgtggtagttgatgtagttaaggtttggcaaagggaaatcagttctggaaccctggccttttgattttcaacaatggtatccattgaaataaaataaagtgagaatttggaaagctgtcaaagagggtgattttattttatttatttatttatttatttttatttttgagacagtgtctcactgtgttgccaaggctggagtgcagtggcgcaatctcagctcactgcatcctccacctcttgggttcaaatgattctccagcctcagcctctcgagtagctgggattacaggcacatgccaccatgcccagctaatttttatattaaagagggtgattttctatcatatcccttttctctcctagaaaatataatttgacatcatgcccaagaaatatgaaatatgtacttagttgcatttgttaccaaggcaagtccctcaaatgctcaggactcctttgtgattctttgtgctggtgtttgagttggcaggaatacagccctagggtcttctgggcctggaggtgacatgtatacctttctagctccctctaagatccaaaagctctccaacatctgtaactatagagacagctacattttgctttggatataggctgagactttttcagtctccaggtccccatttgagtcccacacatattacagatgtttcctgtagcattttatatattggatgtagaccttttacaaaagacagaatttcttggtgtgttatggtagagcaagtgtgggactctgatagaactgagttcaggcccggcgcggtagctcacgcctgtaatctcagcactttgggaggccgaggcgggcagatcaggaggtcaggagctcgagaccatcctggctaacacggtgaaactccgtctctactaaaaaaaaaaaaaatacaaaaaattagccgggcatggtggcggatgcctgtagtcccagctgctcgggaggctgaagcaggagaatggcgtgaacccgggaggcggagcttgcaaagtgagccgagatcgcgccactgcactctgggctgggagccacagcgagactccgtctcaaaaaaaaaaaaaaaaaaaaaaaaaaagaactgagttcaaactcctgctctgctacgcacatatgctataacctgcaggaaaggatttaaatgtgcagagcttcagtttcctcatctaaaagtagagatacttccgctcacttcccaagcttgagtgaagacaccagggatggcagtgcccagggcaatgatgctgcccattgagggtgctcaattaatgcatctgcttctataaaacccaggttcatccttaaaagaaataagcttctatacatctatctaggtggtgaaattttattctccagtcagaggagtgggaattagaaagatcttggtgttactgaaagagtttaaattccaactcagccatttcttaggcatgtcactttatctgtctctctctctctctctttctctctctctttctttgccttattctgtaacccaggctggagttgcagtggtgtgatcttgactcactgcaacctcaaccgctgcaggctcagtatatcctcccacctaagcttctcaggtagctgggactataggcatacgccaccacacccgactaatttttttttgtatttttttgtagagacagggttttgccatgttgcccaggctggtctcaaactcctgggctcaagcaatccacctgccccagcctgctaaagtgttgggattacaggcatgagccaccgagcctggctagccatgtctcttttaaaaagttacttaatccatccctacttcaattctcttacctgtaaaatgcggaaattaatatttgtttagcatttactgtttagtagggactgttattactgctactgaaatgtaatagtattgtctttttttttttttcatttctttctttcttttttttttttttcaagatatggtcttactcttttacccaggctagagtgcaatggcacgatcatagttcattgcagcctcaaactcctgggctcaagcaatcctcctgccttggcttcccaaagtgctagggttacaggccttacagccactgtgctcagcctaattttttttaatttttaatttattttattttattattattattttttaagatgaagtctcgctttgtcaaccaggctggagtgcagtggcatgatctcagctcactgcatcctccgcctcctggttcaagtgattctcctgtctcagcctcctgagtagctgggattataggtccccaccacgacacctggctttatttatttatttatttatttttagtagagatgggatttcaccatgttggccaggctggtctagaactcctaccctcaagtgatccacccaccttggtctcccaaagtgctgggattacaagcgtgagccactgcacccctggctgattttttgtagagacaggatattgctttgtttcccagtctggtcacaaactcctgggctcaagcaatcctcctacctcgatttcccaaactgctgaggttacaggtgttagctgctgcacatggcctgcctactttcttttattggccacattttctgggaaatctggcacacctggactctggcatctagtgggaatgaatgttagcagatgttagggggagcgatagtgagcaaagtagaagagggttcagagaggatatttgaaggcctccaaaacaaattgacctcttttttttcttctttttttttaatatggagccttgctctgtcacccaggctggagtgcagtggtgcaatctcagctcactgcaaccttcacctcctgggttcaagcgattctcctgcctcaacctcctgaggagctgggattacaggtccccaccaccatacccggctaatttttcagatttttagtagagatggggttttaccccatgttggccaggctggtttcgaactcctgacctcaagtgatccgcccgccttggcctcccaaagtgctgggattacaggcatgagccacactgcacccagcctgactccattcttgtgcttacagcttttaaatcttggggattttggactgtcttggcaaatcctaagtatcatcttcattcttccttgatgtttgtgagtatgagatccctgcccaaaactatgctggcccccctggggattggagtttggaaactgacttcactcagccccagagtcaaggtcagaagcccctctacctggatattttaagtgcctgcattctctctggcccagaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaagtatggactggtgggcaccttggggctggtcagggccatcccagtttacacattacctaatataggaagcagaagttagaaaaggaaagcctgactaagtgtctcacttctagacttctttgttatatctcttagctgatatctttttcccacagcaaaattggcatttaaaaagggatagtgaggcctggcatggtggctcacacctgtaatcccagagctttggaaggctgaggcaggtggaccgcttaaggtcaggagttcgagaacagcctggccaacataccttttctctactaaaaacacaaaaattatccgggcatgatggtatgcacctgtaatcccagttactcaggaggctgaggcaggagaatcgcttaaacccaggaggaggaagtttcagtgagccaagattgggccactgcactcagcctgggcaacagagcaatactccatctcaaataaataaataaataaataaataaataaataaataaataaaactaaaaaggtaggccgggaacggtggctcacgtctgtgatcccagcactttgtgacgcccaggtgggaggatcacctgaggtcaggagtttgaaaccagcctggccatcatggcaaaaccccatctctactaaaaatacaaaaattggccgggtgcagcggtgggtgcctgtaatcccagctactcgggaggctgaggcaggagaatcacttgaacccgggaggcggaggtggcaatgaaccaagatcgtgccattgcactccagccttggcaacagagcgagactctctcaaaaactaaataaaaaaataaaaaggtataatgatcaagttaaaaagtttaaaccatacaatttataaagtaaaaaagtaaaagaaagaataagaaagacaaaaaacaaacagaagtaaaagattccccttcagcctttcctttccccgcctcaggtacatgcctgggtgattttttttctttttctttttttttttttgagatggagtctcgctctgttgcccaggctggagtgcagttgcccgatctcggctcactgcaacctccgcctcccgggttcaagcgattctcctgcctcggcctcccaactagctgggattaccagcatgcaccaacatgtccatctaattttttgcgtttttagtagagacagggtttcaccatgttggccaggctggtcttgaagcctgacctcaggtaatctgcccacttcagcctcccaaagtgctgggattacaggcttgagccactgcacccggccagatttttgtatttttattgtagagatgcagttttgccatgttgcccaggctggtctcaaactcatgagctcaagcaatctgcctgcctctgcctgcccacctctgccaccacactcagccaaaatttttaccttgcaaagtaaaattgggaaaattaagagatagcacattcccaagccagagtatttgggaaaaaaaaaaaaaaagacacatcacagtgtgacttttctctttccagaaagaatgggctttgtgattcttttaaagcagttttaaaagtttaaataatattggttttgaatatataaaactataaggaacaagaaaaaaaacatatgtatgtgtatatgtgtgtgtgtgtgtacatgtgtatgtactatcaccccaaaattaaattactgttaacatctcagtgtattatcaatcttttttttttaagaacagagataattcaaaccagatgtggtggctcacgcctgtaatgccaggactttgggaggctgaggagggcagattacttgaggtcaggagttcaagagcagcctgaccaacatagtgaaacctcgttgctactaaaaatacaaaaaattaactgggcgtggtgacgcacacctgtaatcccagctacttgggaggctgaggcatgagaatcacttgaaccccggaggcggaggttgcaatgagccgagatcttgccactgcactccagcctgggtgagggagcaagactctgtatcaaaaaaaaaaaaaaaaaaaaaaaaggacagagataattctatatgttacatttgcatcctatatttttcacttaagcattgttccatgcaatcagaaagtcttcaccagcattttgaaatgatgattattatataaatattagagtcagggtctcactgcattgccaaggctggtctcaaactcctagcctcaagtgatccttcagctttggtccctcaaagtgctgggattacaggcattgagccacaccacccggccttcaccatcatttttaataagtgcttaggccaggcgcggtggctcacgcctgtaatcccagcactttgggaggcagaggcgggtggatcatgaggtcaggagttcgagaccagcctggccaagatggtgaaaccctgtctctactaaaaatacaaaaatcagccaggaatggtggcgggcgcctataatcccagctactcaggaggctgaggcagcagaattgcttgaacccaggaggcagaggtgggtggattacctgaggtcaggtaatcctgggcaacatggtgaaaccctgtctctactaaaaatacaaaaaattagctggacgtggtggcaggtgcctgcctgccaccctctgctgcaatcccagctactagggaggctgaggcaggagaatcccttgaacctgggaggtggaggtagcagtgagctaagatcacgccactgcactctagcctgggtgacagagcaaggctctgtctcaaaaaaataaataaattttttaaaaagtgtgtaatatttcctcatggctatactaataattaaacctgctcatggacacttaggctatttccaatttttgtctattataaacaatactgtaatgaacaagccaggtatgctgactcatgcctataatcccatcggctcaggaggctggaggaccgcttgggcccaggagtttgaggatgtagtgagccataattgcaccactgcactccagcctttgcagtagagcgagaccctgactctaaaaaaaaaaaaaaaaaaaaaatgctataaggaacatatttatgcagaaaccatttcaggtaattttaaattaaattccttgggacactggggactccttgaacaaccagcaggcataccataaacagtaattcaaagacaaattgtttggcagacctttgtttcaaagagtttttgcaggctgggcgcagtggctcatgcccgtaatcctttgggaggccactttgggacaccaaagcaggtggatcccttgaggtcaggagttcaaaactagccttgacaacatgatgaaaccctgtttcaactgaaaatacaaaaaattatccaggcatggcggcaggtgcctataatcccagctactcgggaggctgaggcaggagaatcgcttctcctggaggaggcagaggttgcagtgagccaagatcgcaccactgcactccagcctgggcaacagagcaacactctatctcaaaaaacaaaaacaaaacaaaaaaaaaaaacaacagagtttttgcagtactcctttaagacttttctggtatatagaaatgattaattttccagaattctatatatgtacagctttgaagataagaagggttgcctgtagtaaaacgtaataatcatcatattcataactctcatgtattgggtacttttttttccttcatgctttatgtatattatctcatttaattcatacctcagctcttaaaagtaggtattgtcttttttttttttttttgagatgaagtcacgctctgttgcccaggctggagtgcaatgacacaatcttggctcactgcaacctccacctcccgggttcaagcaattctcctgcctcagcctcccgagtagcttggactgcaggcacatgccaccacgcctggctaatttttaaaatattcttagtagagatggggttttactgtgttagtcaggatggtctcgatctcctgacctcgtgatccgcccatcttggcctcccaaagtgctgggattacagtcataagccactgcgcccggccagtattgtctgtatccttattttacagccatagaaactgcagcttagagaagtaattggtgaaaggccacatagttatatagtgagataacctggtttcagctccaaatcccatattctaaccattatcctatactgccacatcaggagtccctgctaacttttatttaagactagtctgtttttttccccaaccccttcagcaaatcaattaagtctagcaggatgcagtggtgtgtgcctatagtcccagctacttgggaggctgaggtgggaggaccacttgagcctaggagttccagtccagcctggacaacatagcaagaccccatctctaaaaataataataagactgggtgtggtggctgacacctgcaatcccagcactttgggaggctgaggtgggtggatcacttgagcccaggagttcaagaccagcctgggcaacatggtcaatccctatctctactaaaaatacaaaaattagccaggcatgatggtgtgcacctataatcccagctatttgaaaggctgaggcaggagaattgcttgaacctgcgaggcagaggttgcagtgagagccaagatcgtgccattgcactccagcctaggcaacaagagcacaactccatctcaaaaaaaaaaaaatggctggatgcagtggctcatgcctgtaatcccagcactttgggaggcccaggggggtggatctcttatggtcaggagtttgagactagcctagccaacatggcaaaacctcagctttactacaaatatgaaaaaatttaggatgggcgcagtggctcatgcctataatcccaacactttgggaggctgagacaggtggatcattttaggtcaagagtttgagaccaggttggccaacatggtgaaaccccgtctctactaaaaatacaaaaattaagggccaggagtggtggctaacgcctgtaatcccagcactttgggaggccgaggcgggcagatcacgaggtcaggagatcgagaccatcctggctaacacggtgaaaccccgtatctactaaaaaacatacaaaaaattagccgggcttggtggtaggcacctgtaatcccagctacttgggaggctgaggcagttgactcacttgaacctgggaggcggaggttgcagtgagctgagattgcaccattacactccagcctgggtgacagaggaagactctgtttcaaaaaaaaaaaagaaaaagaaaaagaaaaaaaaaaaatttagctgggcgtggtggtgcacacttgtaatcccagctactcaggaggctgaggcaggagaatcgcttgaacctggaaggcagaggttgcagcaagccaagatcgcaccactgcactccagcctgggtaagagagtaagactttgtctcaaaaaaaaaaaaaaaaaattagctgggtgtggttttgggtgcctgtaatcccacctactcaggaggctgaggcaggagaatcacttgaacctgggaggtggaggttgcagtgggcgaagatcgcacttgtgcatcctagcctgagcaacagagcaaaactctgtcccccgaccccctgcaaaaaaaaaaaaaaagttgagtgccactgacatagacaagtaacttgtccaaatattagtcattaagggatgaaattgttattgaaacattacttataaaataaataaataacaaggctgggcacagtggctcacacctatatcctagcactttgggatgccgaggtgggcagattgcctgagctcaggagtttgagaccagtctgggcaacatggtgaaaccccgtctctatgaaaatacaaaatattagatggggccgggcacggtggctcacgtctgtaatcccagcactttgggaggccaaggtgggcgaatcacgaggtcaagagatcaagaccagtctggccaacatggtgataccgcgtctcaattaaaaatagaaaaattagctgggggtggtggcatgtggctgtagtcccagctactcgggaggctgaggcaggagaattgcttgaaccggggaggcggaggttacagtaagccgagattgtgccactgcactccagcctgggcgacagagcgagactctgtctgcaaaaaataataataataaatagaagccaggcgtggtgactcacgcctgtaatcccagcactttgggaggccaaggtgggcagatcacctaaagtcaggagttcgagaccagcctgaccaacatggagaaaccctgtctctactaaaaatacaaaaattagctgcatgtggtgttgcatgcctgtaatcccagctactctggaggctgaggcaggagaatcgcttgaacctgggaggcagaggttgcagtaagctgagatcatgccattgcactccagcctgggcgacaagaccgaaactttgtctcaaataataataataataatgataataataatacattaaataaatgaataacaagaagatgactctgaagggctgtcacagaaacagactcattcattttgactttgtggcagttttagtttgaagctaaagaggagatcgtttttatttcatagcgagaaatggcttccgggtgctgagtagaaggggcaggcatgtttggtagtgggctctccagccctagaagcatgcacgcagagcctctgtaggacttttttttttcttttttttaagacagagtcttgctctgtcgcccaggctggaatgcaatggcgcaatctcggctcacttcaacctccacctctcgggttcaagcaattctcctgcctcagcctcccaagtagctgggattactaggcacctgccaccacacctggctaatttttttttttttgtatttttagtagagacagtgtttcaccatgttggccaggctggcctcgaactcctgacctcaggtgatccacctgtctcggcctcccaaagtgctgggattacaactgtgagccaccgcagcagcctataggatgtaaaaggagggatgcctggattggctgggggagttggagtgaatgaccccagggttgcttcctgcatgggacagctccgcttgctaggaggtgctacagaggcttgggc

SEQ ID NO: 507 - DNA, 17569 bp, Homo sapiens
gaaacacaggtcttactggcctgctcaaaaataaaaattagccctaaaatttatcagcactttccgtgtttaagacaacctgaaagctgagtgtgaaacctggaaacccgctgggaggaagaacagcacagacaaccacaaagaggggtgcgcccgccaagagtgatgacggcagagctgggcctcagcctaagtcccaggaatagagaccccaggaccactgaagtcatcaacagtcatgccagggcctggagcatcctggcgacgtctcacatcaggcctgacggctcaagcgcgtgatacaaggggtgaaggggctaacgcatatttgatgtcactgccttaagttaactttctgtcaaatgatactcacgcaacatgggaagaaaagaaaaaaatatatactttactttttggccgttgaaatattcacctccaaaaaggattaactcatctttctcaggatgaaccgagagggaggcatttaacctacaagacacacaagcggcaggtcagcaagatcacccccgatacccacctgagcgctgtccccttcctcacagaatcctctgtcaccacaaactggctgcctctacacttcctgaaaggagagcctggcatcgagaaaggaagcaaaggtgccacttgaacaccaacccctctaccagtgcccagggccacactccaaggacaaccatggagctggactgacacagtgtctggttgtattaacaaaaaaaaaaaaaaaaaaaaaattccccaggcaggaataagtccagatgcccctactgatgtatcaaatgttccagaactgtttttttgatttgttttttttcatttttgagatggagtttccctcttgtcacccaggctggagtgcaatggcacaatctcagctcaccacaacctccaactcctgggttcaagcaattctcctgcctcagccctccgagtggctgggattgcaggtgcccaccaccacacccagctagtttttgtattttttagtagagatggggtttcactgcattggccaggctggtctcaaactccggacctcaagtgatctgcccacctcggcctcccacagtgctgggattacaggtgtgagccaccgtgcctggacctcagaactgtcctcttttaagagcctatcctgtcaaatcacctcaaaaccattctaaaaagtccagtaactaggccaggagcagtggctcctgcctgtaatcccagcactttgggaggccgaggcaggcagatcacgaggtgaagagatcgagaccatcctagccaacatggcgaaaccccgtctcaactaaaaatagaaaaattagctgggcatggtggtgcgtgcctatggtcccagctactcgggaggctgaggcaggagaaccacttgaacctgggagttgggggttgcagtgagctgagatcatgccattgcactccagcctggcgacagagcaagattccatctgaaaaaaaaaaaaaaaagtccatatgtaagtacttcaatatacatgccagatatcttccatctagaaaatacaaacaactttctatttatttcacatgagaacaaaagaagagctacaaggaaattacataataatattatgggccaggcccggtggctcacacttgtaatcccagcactttgggaggctgaggcgggcagatcacctgaggtgaggagttcaagaccagcctggcaaacacggtgaaaccccccgtctctactaaaaatacaaaaagtagccaggcatggtggtgggcacctgtaatcccagctactcaggaggctgaggcaggaggatcacttgaacccgggaggcagaggctgcagtgagccaggattgcatcattgcactccatcctgggagacagagcaagactgtcttaaaaaaacaaaaaataaataaataaatacatagggccacttcagttgaaagtaatgaaagacacagtgactatctggcgaatcactgggaaagatcctcccttcagagtcctctaagacggcgttccccaaggcgtgctccataatgccaactccaaaagatgtttctcaaaggaaaaacaggtttcaaggtcaagtgagtttgggaaatctgagaactctattttctattggggatttatttgcatagaaacatgtcataggctgggaatttctgcaggaaagaaaccagtattaaaagctaaacacagaatcaccacataatccagcagttcgttcccaggcattagctcaaacagatacctgtatgcaatgctcgttacggcctcacaaaagccaaacagtagaaataacctaagtgttggtctgcagatgagtggacaaacacaatgtggcatacccacagacggaacaggatttagccataagaagaaataaagttctcacacatgccacagaactgatgaacttggacataccaggtgaaggaagtcagtcacaaaaagacacttctatgactccacttacgcaaaatacctagaataggccaattcacagtgacagaaagttgaccagaagtcaccagggggctgggggaggggaaacagggagcaaccattgaagggtctagacacttctcccatcttttggcttccctgggctacaatggaagaagaattgtctcgggccacgcataaaatacactaacactaacaatagctgatgagctttaaaaaaaaatctcatcatgttttaagaaagtttacaaatacgtgtcacgctgcattcgaagctgtcctgggccaccagttagacaaggttggtctagagtttctatttggggtgataaaacaatgttgcaactggttagtgctaatggttgcacagcgacatgaagtaattccactgaactgcacagttttaatgattaaaatggcaaattttggccaggcgcattggctcatgcctgtaatcccagcactttcggaggccgaggcgggcggatcacctgaggtggggagttcgagaccagtctggccagcatgaggaaaccccatctctactaaaaatacaaaattagccaggcatggtggcgcatgcctgtaatcccagctacttgggaggctgaggaagaattgcttgaacctgggaggtggaggttgcggtgagccgatatcataccattgcactccagcctgggcaacaagagcaaaactctgtctcaaaaaaaccaaaaccaaacaaaaataaaataaaatggcaaattttgttaaacattttaccacaataaaaaaaactttttaggtcgggtgcagtggctcacacctgtaatcacagcattttgggaggccaaggcagttggatcatctgaggtcaggaatttgaggccagcctgactccagaggttgcagtgagctgagatcgcgccatagcactccagcctgggcaacaaaagcaaaactccgtctcagaaaagaaaaaaagaaaaaaaaaaactttttaaaaataataaataggccgggtacagtggctcacgcctgtaatcccagcactttgggaggccgaggtgggtggatcacctaaggtcgggagttcaagaccagcctgaccaacacggagaaactccgtctctactaaaaatacaaaattagccgggcgtggtggtgcatgcctattgtcccagctactccggaggctgaggcaggagaatcacttgaacctaggaggctacagtgagccgagatcgtgccattgcactccagcctgggcaacaagagctacactccgtctcagaaaaaaaaataaagagtgtttcccaaattcctctgaccctgaatcttttctcactgaatacctattgattttctgcagaaaagcaccaaacacaacttcagaaacgatctacacggggcccaaactgaggtccccacccagccaccagcggcaccagcccaggtgttgccgccgcacaggcaggtgaggtactgaggcagctggtgtcatgcccccattttccaggtaggtcacatcagagccaatcctgacgatatgctcatttagaaactggtcattctcacaaggttttaaagtaatatgattaagaaataggaagttggaagatattaaggttaccaagcaaaagatcttaatctcaggataactgctccctcctattaggaagcatttccagctgacccagggaactgccaacaccttaaattatatcctgacatgaaatctgactttcaggcaacattacttatggaaaaattctaaaatatcattaaaaaaaaaaaaaaagaaaaaggccaggtacggtgacttgagcccaggaactcgagaccagcctggacaacataaaaaaaagtctctacagggccgggcacggtggctcacgcctgtaatcctagcactctgggaggctgaggcgggcggatcacgaggtcagaagatcaagaccatcctggccaacatggtgaaaccccgtctctactaaaaacacaaaaaattagccaggcttggtggcgggtgcctgtagtcccagctacttggcaggctgaggcaggagaatggcgtgaacccgggaggcagagcttgcagtgaaccaagatggcgccactgtactccagcctgggtgacagagtgagactccgtcccaaaaaaaaaaaaaaaaaaaagtctctacaaaaaaaataaaactaatccccattcaaagtggctttcctcaggagtgctatatatcagaagcctaagatcaaggatttatttgctccaataactcaaatgaaaatgtacatttacagccaggcacagcgactcacgcctgtaatcccagcactttgggaggccaaggcaggtggattacctaaggtcaggagttcacgaccagccaggccaacatggcaaaaccccatctctactaaaaatacaaaaattagctgggtatggtggctggcgcctgtaatcccagctacttggaaggctgaggcaggagaatcacttgaacctgggaggcagaggttgtagtgagccaagatcatgccactgtactccagcctggatgacagagtgagactccatctcaaaaagaaaaaaaaaagtacatttaccacatgtaacttacatttggccctgagggcaacatgcaaactaaagggaaaaagaaaactaaaatcctaatggacatgaagtgaaaaccaggaaggacactggcctttgggagtggctccaacaccactcactctgctcaggggctgatcaccgtgctcctcccacctctgggcaggtgatgataaccctgcctctgaggccggtgggtgggactcgggcaccagagccatcacatgcgcctcattaatgcaaacgcagcacaatcgtgaccctccactcccgatgggctgaaccccggcttccactagggcctgcagcagctttattaaaagggtaaatcctgcaaggttaatctcctactgagggaaataaaccatttctcattccagctcatcccacacgtgtatgaaatcctacagactcggaacgtttttacgtaattttcaaatccatttaaaatggcttatactcaatttatgtttaacaaacttttcacatgagaatttgaaagcattacaaacacatcaaaaggccacagtgattttcagctttctgcctacagtacgcacttttaaaataccttaagaaccaaagaaaagctcactggggcaaaactttcatccccacgtcacgaccagtggaggagctttcaaagttggcaccggagcccagaggcagcagctgtgctgtaggccctgctcccaggttccatgacagtaaagcttacagcctcattccagttcttcagcagaaagtgaccaagaacaggttttaataatgaaaatgtcccaagtgcctggtcatttacgaaacctggtgctatttaaagcagtttttcaatgtatagaagaaaaggaaacatacaatatgaaaaatgctacttgctcaccttggtgagggtggggggcacggaagttccacagtctgagtcctcttggcatcgagtgtctggaaatgggctatgagcgcttccaggtcttcctagggcaagcaagcaggcacacgtgagacttattcccaggacccgccgcggagccacagcccgctcagctttcctccaatcagtgtgattcgactgggctcagtcacatctgtgaattgcaacatactgtgcctgtttgaaatgcagagtttgacacattcgaaagtaaccagagcttgacctcaaaggcagtctgcttaaagggtagatgtgtgcaccaagtattatctccacacccttaacgctccctctgcaagaccttccacttagacaagcccgttgtgacttcactgcagacactctcagcacctctcataacccagactcgagccgtcgcacctgccagccttcctgtctgcagagcagtgtctgacaagaacttccacttagacaagcccatcgtgacttcactgcagacaccctcagcacctctcagagcccaggcctgggccgtcacgcctgcctgccttcctgtctgctgagcagtgtctgatatatttctcttgcttatttgtttcctccaccccaacaaaataataaaatatgagctccaccagagcaagacttgtgtctagttaaaacactgcctgcacagcaagagctcagcaaataccagctgcagtctatccaagtaagaaggtctcaacttttactaccatcgagagtgactcaaggtactgatgtgccagcacagagggcagcactggaacccagtgttcccgcctcagtcccagtgcccatttcccaacatttacgagacactcccatgcacacccgagcctggcatttcaagttccttctagccttcagtgtcctgcttgcaactacacacacctgcagaccatcttccctcccccacacccacctctccaacctcacctcccacctggcctcactctccaagatacaccagcgtcctctccgttccttcaatgaaaacgccaggttccctcagcctgccacgccccacctcgtgcttccttcagtctacctctcatctcagggtgaatgtcagcagggtacactgcttagtattctaaacgatgcaatatttaaaacacacaagttaacagaactttatccaagacattcctgtatacggttcccagggtaaggaataaagtgtcacccacatgtacccacccacacattccctcaagtaaccactatctggaactcgatgcttattagtctcacgcttttcttcaatcttttattacacatgtgtatccctaagcaacatatagtattgttttacatttttaaatgtcattaaatggactgggcacagtggctcacgcctgtaatccccgaactttgggaggccgaggcaggtggataatttgaggtcaggagttcgagaccagcctgaccaacacggtgaaaccccgtctctactaaaaaatacaaaaattagccggccacagtggcgcacacctgtagtcccaaactactcgggaggctgaggcaggagaattgcttgagcctgggaggcagaggttgcaatgagctgagatcatgccactgcgacacttgctctgggtgacagagcaggactccatctcaaaaaaaataaaaaataaaatgtcattaaatggtatcatactgtatattctttcaacttgctttttttgctcaacgaggttaaacaaacagttcaaatactaacgtctatgtaccgcgaaagctttgctgctgctacttagagcggtctttgaccttggctgaacctcatcatcattgggtgactgaaggagagcaaggtggtagggtctgggtgacgccagtggcctagccagtgacagcctctccaaagtgacaataagctgaatgctgaaaagacgactcagacggagtatggttggggtataggtaagaccacagacacaacttgccatgtttgagacactaaaagacactgtggctggagtgagcccagggagacagctggaaagacaggcagaggccaggactaagtgaaggtgcgaaccaggtgacctgatacatgagttctgtgggagcagaattccaaactgtccccaatccttcccccaataattgccaggactgtgaaagaatgggataccactcttgtgattaggttgtattacagacacagctgaatttaagaaagagatgatcctctgtgggtctagcctaatcagacgcccacttattttaaaagtttgttttgagggttcattcagataacatacaaaccccaggcctgacaggctctctctcttaagggaagctactgttacaatcaccttagtattgggtactggagggagacatggagatgagtaaaaatgacaggtaactggcggggcaaggtggcttacggcttgtaatcccagcactttgggaggccgaggcgagcgcatcacctgaggtcaggagtcccagaccagcctgaccaaaacggtgaaacccggtctctattaaaaatacaaaattagctgggtgtggtggtgcatgcctgtaatctcagctacttgggaggctgaggcaggagaaccacttgaacctgggaggcggaggtgcagtgagctgagatcgcaccattgcactccaccctgggcaacaagagtgaaactccttcaaaaaaaaaaaaaaaaaaaaaaaaaaaaagcagaaagcagctaacagctggttactgagtgcttactttctgccaagcaccattctgaagataccacacagatgaactgacttcctgtgccacaaccctagccagcaggtcatgccactgcagcccagcctaggtgacagagcaagactctgtcaaaaaaaaaaaaaaaaaaaagaaagagcctaagaggagtgtgagggaaaagtccaactccattatttaagagatgaggacatggagagatcaatgacttaggaagaaaagggacaaaggactgtggtcaagagctcctgattcaggacatctggtcacatcccagttccataccacttcatggttcacctgttggtcttcctgtcaaatgggaataccagtgctacggaactgacctgctcgtgaggagtaaagcccagggagctgtgcctggcgcacggcaggccataaaactggccccggttagggaatccatgagcagcagccgcagaacactcaaccccaaggtcaggacggatcctcctgcagaccccgggctgaggaccagagggaaggagacaaccgtgatggccgccatcagctgctacgggataccccgtggctccagtgccttcttcacttaaccatctgctgctcactgctcagggctgctgtgatgattatttgccctcttttgaaagaaaagtaaggttcagaaaagttaagagtcttactcccagaccacacatcatgcagaggcagcccccggctcaacctcaggtcttcctgtgccaaacccctccctcttctcaccacccagcctcccttcagagggagggtggagggagaagggaggagggggaggaaacgcagaaaaacgcccgtgacaccacactaagaaaagcaagcacgttaaagggggcagctccgagaagcggacagacacacgtggagactcaggagggggcgggccccgtctgggctgcccggacgcggcgccggggcagttcctacggcctccagctctcccgcagggccggcgcggctcccacggccgacccgtaaccccggggggcgcagggagtcggccgaggctgcacggccgcgacgtcgggccgctaagcccggtctgacccgctcacctcctccttccgcgagcgcttagacaccttcttctccatcttggcggccgtcttctccgcgccgcggcccttcttctccttcttgcccttcttgcccatcttgccgggtcccaagccgcgacgggacaccaggaaagaaaacggcccgcgctctccgctcggaaacaggtgctcgtggggcggagctcggcgcacagaaatggagtcacttccggccccgagttcgagccgcttccgggtagaggtgcggctgggccctttacgaggttcggtcttggagctccgtcttcggcagcgggctcgggggcctcggactctgcataaggccccggaaaagatgaccggccccgggctgggcgcggtggctcatgcctgtaaccctggagctttgggaggccttggcgggcggatcgcttgagtccaggagttcgagatcagcctgggcaacaaagcgagacaccaccccccacccccagtcgctacagaagaaaaaaaaaaaaattaaccgggcgtggtgtctcgcgcccagtggtcctagctcctcgggaaggtgaggcgggaagatcgcttgagtcaaggagttccaggcagcaatgcgcccctgcaccccaacctgggcgacagagcgagatcctgtttcaaaaaacaaaaaagatggcagccccggcctgacataccccggccatgctcgccaattctcacgccctgtgcccccacctagcctgtccccgtgtcctaggagacgtgccctctgagttttattttttatttctatttttttgaggcagggtcttgctctgtcgcccaggctggagtgcggtagcgcgatctcggctcgctgtaacctccgcctctggagtagctgggaccacaggagcccaccacgcccggctcattttctcttgagttttccggggtgcacgtgccccccgttaaggcacattgcttcgccctgggtagaactaagtgggcgactcttgggctagccccattttttcccctcagaccaaacaaatgagtgcttttttcccagaaaaaaaatttcacacagttataagattttgcagatcctgagtaagacagtccctgccgggcgcggtggctcacgcctgtaatcccagcactttgggaggccgaggtgagtggatcacgaggtcaggagttcgagaccagcctagccaacatggtgaaacccccgtctctactaaaactacaaaaattagccaggcgtggtggtgggcacctgtaatcccagctacttgggaggctgaggcaggagaattgcttgaacccagggggcagaggttgcaatgagctgagatcaagccacttcactccagcttgggcaaaagagcaaaattccatcttaaaaaaaaaaaaaaatgggggggcccttccaccttcccatttaaaatgtgccagacactgttaggtactaagggcatgtcctcaaatgtcctaacatggaggacttttgtttcttcataggtaggctagagctaatgatagcaccctgaaagggtactcaatttgtggagcctgagaaataaagataggtaatatccaaatgcctgctaggaaattgtactctaggatttgcctcaaattacgtaagaaatggcaaaatcatctgcagtgcatggaatgttatgatttgaaagagcagagtaaaaatgcttatcactacttagaagatgtcatctttggatgggtaatcaaggaataaggcaaattaaggacaaggacaagccaaaatttggcaaagggaaagcataaatcaggaaataatctagtttattactttgtgtgtgagtcagcctttaaaagttctcttaggccaggcgtggtggttcattcctgtaatcccagcactttgggaggctgaagcgggctgatcacgaggtcaggagttcaagaccagcctggccaatatggtgaaaccctgtctccactaaaaatacaaaaaaaaaaaaaaaaattagccaggtgtggtggcacccacctgtagtcccaactattcaggaggctgaggcaaaagaatcatttgaacctaggcggcagaggttgcagtgagcggagattgcaccactgcactccagcctgggcgacaaagcaagactccatctcaaaaaaaaaaaaaaaaaaagatgttatcttagatccagccaggtgtgatggctcacgcctgtaatcctagcactttgagaggcagaggcaggcagatcacctgaggtcaggagtttgagaccagcctgatcaacatggtgaaaccccatctccactaaaaatacaaaattagacaggcatggtggtgcgcacctgtaatcccagctactcgggaggctgagtcaggagaatggcttgagcctgggagacagaggttgcagtgagccgagactgaaccactgcactccagcctgggcaacagagctagactccgtctcaaaaaaaaaaaaaaaaagaagaagttaactcggccaggcgtagtggctcacatctgtaatcccagcactttgggaggccaaggtgggcagatcacgaggtcaggagttcaaaaccagcctggccaacatggtgaaaccccgtctctacaaaaatacaaaaaaattagccaggtgtggtggtgtgcacctttaatcccagctactcaggaggctgaggtaggagaattgcttgaaccgggaggaaaggttgcggtgagcccagatcacgccattgcactccagcctgggcagcaaaagcgaaactctgtctcaaaaacaaaaaaagttaccttagatccaatcaatgactagtcactgagcagctgaggaggaatgattttccaacccactccaagccttatccataaacctagctctttaagaagaaaaatgaaatttggggaaataatgagaagaaaagatagcactggttgaagaccaccatggtctccagcactgcttgtaggaaacctatgtggtggtagaaaaaaaaaaccggttaggagctgagcagaaaggagctggagaatttcacagaaacccagcctgggcatccaggcatgtttatcttccatgacgaactacaaaaggctaaatcctcactattgccctcgggaaatagttctgtcccctctagtgtactatgactttaagaacatacgtaatcctttaatatttttctaaaaatcctgggtaaacctgaggcaatgcacttgaagccaaaaggctcttcattcacagcacatctggctgcagtacattacagtggtgcccacttcaggccggagacagggagagcgtatgacctattgaagatttaggaggatctggtggatgcggggtttaatacttttattatctgaaagaagcttgaagctaaattagaaggctcttggattataggtgtcatggtgatttacgtgagactgaaattctcatactgagaaagacggaatagaacatctaaaatgagatcagatcctaaaatagtcaaaagattaagtacaaggctctattttagtaaaattcacattgttgaaactttcatggattatctttaatctgtcgctgacttttagagtgtatcttttgtgtgatcaggcgccctctgctgccttcaagttgaagtgcagaagagaaaaaaaatctattaataatagattaaattttaggaaaatatgctaacttctaattatcctcaccacaagtaatcaatgtgattggaaggttctgccaagtgtggtatggattacgtggctctttgcacgtttcccagcaggaaagtgggaataatgaactagttcacctattacacaggattcttgggaaaatcaagtgaaacaataataaagcttaggaaagaggccaggcgcggtggctcacgcctgtaatcccagcactttgggaggctgaggcgggtggatcacgaggtcaggagatcaagaccatcctggctaacacggtgaaaccccgtctctactaaaaatacaaaaaattagccgggcgcggtggcgggcgcctgtagtcccagtactcgggaagctgaggcaggagaatggcgtgaacccgggaggcggagcttgcagtgagccaagatcgcaccattgcactccagcctgggcgacagagtgagactccgtctcaaaaaataaaaattaaaaataaataaaataaagcttagggaagtaaaaaagcaaaacacaaaggctttttttttttttttttgagacagagtctcactctgtcacccaggctggagtgcagtggcactatctcagctcactgcaacctccggctcccaagttcttacctcagcctcccaggtagctgggattacaggcatctgccaccacacccagctaatttttgtatgttttatagagacaaggtttcaccatgtaggccaagctggtctcaaactcctgacctcacgtgatccacccgactgggcatcttaaagtgctgggattacaggcgtgagccaccatgctggccttactgaatttttcccacttctttgaatccattccagagagaggaataataagatttccaactataatcagggatttatctatgtgttgcttatatacaataaactgtatatatttcaagtgtgcacaggtggctggggtgaggcaggtggctgctgaggagcaagagggatctacagttgtcccctgccctatgagaagggccacccactcaggaggggcctcaagggatgatgagaaatgagtatggaatttgtcagccttgaagttccaaattggaaacctggaaacatgtgtcccgtcttcttcatcaagattgtccaattttttttctttttttttttttttttttttgagacggagtctcactctgtctcccaggctggagggcagtggcgctatctcggctcactgcaagctccgccttccgggttcacgccattctcctgcctcagccttccaagtagttgggaaaacaggcgcccgccaccatgcccggctaatttttttttgtatttttagtagagacggggtttcaccatgttagccaggatggtctcgatctcctgacctcgtgatccgcccgcctcagcctcccaaagtgctgggattacagatatgagccaccgcgcccggccgattttccagtgtcatagcataaagcaataagtgatgttcttctaattaaaacaataaattaaagtgtagaatttaatatgtattaatactatcaaggtctggccaggcacagtggctcacgcctgtaatctcagcactttgggaggccgaggcaggcagatcacaagatcgggagatcgagaccatcctcgctaacacagtgaaaccccgtctctactaaaaatagaaaaattagccaggcgtggcggcatgtgcctgtagtcccagctgctggagaggctgaggcaggagaatggcgtgaacccgggaggcagagcttgcagtgagctgagatcgcgccactgcaccccagcctgggcgacagagtgagattccatctcaaaaaaaaaaaaaatactatcaaggtcaaataaaaatatagagatggatctctaaacaaaacaccttgtatgggaatcatagaattatattttgaggcatatccacaggctggggtgaacttcaatatgtccaaagaacaaagagaaggttgggggttttattaaaaagagaaatgtggccaggcgcggtggctcatgcctgtaattccaacactttgggaggtcaaggtgggtggatcatttgagatcaggagttcaagaccagcctggccaacatggtgaaaccccatctctactaaaaatacaaaagttagctggacgtggtgacatatgcctgtaatcccagctactcgggaggctgaggcaggagaactgcttgaacctgggaggcagaggttgtagtgagccaagactgtgccactgcactccaacctgggcaacagagtgagactccgtctcaaaaaaaaaaaaaaaaaaaaaaaaaagaaatgtggctgggcatgatggctcacacctgtaatcctagcaccttgggaggccaaggtgggcagatcatttgaggtcaggagttcaagacaagccttgccaatatggtgaaacccgtctctactacaaacacaaaaattagctgggcgtggtggcacacacctgtaatcccagctactcgggaggctgaggcaggagaatcacttgaacccgcgagatggaagttgcagtgagctgagatcgcaccgagatcacctgggtgacagagcgagactcaggctcaaataaataaataaataaataaataaataaataaaataaaaagaaactcttgattagtttccatttttctagggttttacaaaatggaatcctacagccagggacagtggctcccacctgtaatcccagcactttggaagtctgaagtgagtagatcacctgaggtcaggagttcaagaccagcctggccaacatggcaaaaccccatcactactaaaaatataaaaattggccaggctgtgagatcgtctcccatagcattgagctgatttctgtggttccttaggtcatgggggtagggtgaggcctgcttcaatcttacccttttggggcagaactcttgaaatcttggcttaatctggggagttctctcttagatcccaccttggacacccttggatttgattatgtttttcttgcccttggaggctgtcaaaaccaaaggtaagtatggcaagatcggctcatgcgtgaaactaaaagctgtctcagagcccagtggcctgtttttgttgctactttccattaaggtctgacttggtaattccttattagctttcggatgcctttctgatgttatttgtgtctaccatattccttaaaaggcagcattgcttcgtttttaaatggtgggtttttgggaggtttttctgagacggagtcttgctctgtagccccggctggagtgccagcagcatgatcttggctcactgcaacctctgcctcctgggttcaagcaatcctcctgcctcagccttccaagtagctgggattacagatctgcaccaccacgctcaactaatttttgtttttttagtagagacagggtttcaccatgttggccagactggtcttgaattcctgacctcaagtgatctgtctgcctcggcctcccaaagcactgggattacaggcgtgaagcatcacacccaggtaaatgaagtctgttattgttgttgttattgttgttttgagatgaagtctcaccctatcaccaggctggagtgcagtggtgtgatctcggctcactgcaacctccacctccctggttcaagcaattctcatgcctcagcctcctgagtagctgggactacaggcgcccaccaccacgcctggctatttttttgtattttcagtaaagacaaggttttaccatgttggccaggctggtctcgaactcctgacctcaagtgatccgcccgcccaccttggcctcccaaagtgctgggattacagatgtaaatgatgttttttagtgtgtaattaatatatactcattttcaaaatttggaaaatgcagatgagtataatgaaggaaacctcacagtcacttacagccttctctgctgcatgccagcactctcggcacttggggggtatttcctgctgacggatcttgagcaaaggtccgtgctgtggcgtcactcatcttagtgtcgtgcacagggcctccttccttcttgctgtatccgtgtcttctttatcactgatctcagaagaag

SEQ ID NO: 508 - DNA, 17575 bp, Homo sapiens
gttgtggtgagaggaaaccgcacacatcattattcagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggg

SEQ ID NO: 509 - DNA, 17930 bp, Homo sapiens
gagatcacacctgcattattacaaaagttatgaaataccgagattgcatttttcgcttcctttagtcaggcaaaatgttcctgcctccagctttgacttgagatctcagcacaataagagtattctcaattcatgaagttggaattagtcactgtcttcagcaaaggttctgcatgctaggctgtttatcgacatgccctgagtgccctcctcttcccagtctgactttcttccagccttgctgttggagatcacaggcactgtattgtgaattccttaacagaaatattacaatttccccataattgtttcaccttttaggtgcaattttaaacaggtagagaagcagaacactgcaatgggcctgtatatacctgtcacctgcttccatgatgatcatctcatggccagcctgatttctttcatacttcaaccctatttcctcttccattctagattgtttgaaaggaaattccagaagtcatattatgtcttcaatcaataattcaatattaatatctaaataataggtcctttaaaaaatcaaaacactatttttatatcttaaaaatttacatactaattaaaatgaacaagtgtctatttagtcttcaagcagtcctatttttgatatatatttcttatattttggtgtcccaatcagagtcaaaataagctctataaacgttgtatttgagtgatatatcctttaaatcattgaaatttaaaaatctcccttcatttcttacttttatttgttaaataaaacaggttaactgttcattgtactttttcattcttgggatttttctaattgcatacccctattgtttcctttaatatgagactctaaccttcatatttcatattaaaattagaagcttattaagattctgtctatatttaaacattctagaagtaaatgtagtagattgcccatttaaattttgaatagtactatttgcacaattatttacatgtttacaaattgaatacatgatacatgttttaaaaaattttttgtaaaacatgctaaacaacaaaataatatagctcaaggccattccccagttacccaattcctatctatggaggaagtaatgttagcagttccttgtgtatccttgtatctttacttggatattttcctgtgcttttcctgggccatgggtgacatgtctgtgcatatgtgtttgtgtcaacgtgtgtttgtatgggtgaggaagaggtggagggagttggcatatatagagagggagcctgcattgtagaaaggtatataaataaatacatgaatgttttgtgtgtatgtgtttgagtgtgttttatgtatataaaatatttcatgtattcatatgtacaaaacataaaaatattgtctttttcaattgtgattgtgttgtgtctgctttgtctcccacatctatgttttctgattctctttttaacagtctctagtctctttttcatagctgtttgcttttcccagttattcgaggacatttctcccaaatgtccattactgtctgtttaccaatgtctttcctccttatgccgctttcaatttgggcttcatttcttttttcttttcttttttttttttacacagagtcttgctctgtcacccaggctggagtgcaatggcatgatctcggctcactgcaacctccgcctcccaggttcaagtgattctcatgcctcagcctcccaagtagctgggactacaggtacctgccaccatgcccggctaatttttgtatttttaggagagatggggttttagcatgttggccgggctgatcttgaactcctgacctcgtgatccacccgcgttggcctcccaaagtgctgggattacaggcgtgagccaccgcacctggccaatttgaccttcatttctaagcaggactttgttgttatctctaccccttttctgtgctccacaaatgaatattttatcttttacctgtctcactatattttgtcttctttttcccactttatagtgtttattttttagtattttattgtgcctttttctgttgagagtttttatgagtcttttttttttttttgcctatttttttcaattttgaatgcacagaccttttctgagtcctggcatggttcctttctgactagtgcttatttttaatgagatgagccccctctggacctgcggtttgtagaaagtattatgggtggatgagccagggccatatccaggctaacaggagttctgattgtgacacagggctgtgtgaatagttcttttattctttcattcagccaaaccaataaagatcactgcagagtggctcacaatttacagcctctttgttttctttgcctcacaataaaatgctactagttgaccttgtctctcttcttattcaaatttgccttcatagtttcttgaaacttcatgacaagcagggtcctggctcgtgctcacacacccagttgtgatagttgcaaataagggattcttggattttcacaggaggacatgccctttacattgatttagttgaggaaaatgagtcaactgtgcctggcatgtagtaaaacctcactgttaggctgtgtttggttttcctttgtggttactgtgttgtttgattttgatctgtttatttgtgagtgttctccactggctttgtctgagattggcagccgtggcatctgctctctgagttttcctaacaaccttgtttgtatttctctatttatgtgaggacattctattattattattattatcatcatcatcatcatcatcatcatcatcatttggtttagggattttaagatcttttacttctggtttttgagggtagagtctgcctttatgttttttgttctctttgttgtttttaggcaatttctgagaagaggaaagggcttccctttcttccactagattaagttcagaagccactcatttatatttaaaatatcatattatgtaaaatgttaatccaataacctaagtttgaaatattatttttttcctctcttgcactttgttaatatagatgtttcattgttctgtagggcctctatcttcccttgagctgtttttgagtaacttgaatgctttccataaaacatcatttttactatcactagaaatttaatctcaagctatatttgtgtttttctcagtgtaataagccacttcattgctaaaacaaactttgtattattgaaaatttccaacaggtaaagagaacagtatataaacctccatgaatgaattatgcagattaaacagttatcaacatttttctcattattgttccatttaactcccctagtctttttatatctaactcccctacttcttttcttaaagtatcttaaaggaaatctagacatcaagacatttcacttgtcaatatttgtatatatagctgagtagtagtgaatttataatctagttgtgtaacagtattaaatctatccaatacctccttcatattttcatttctctgattatctcaaaaatttctctttgtagctggcttattccaagcaacaacctaattaggttcatatattacattcggctgccatgtcttttaaggttatttattctgtaatgaaccctgtctttttcttttatttgccattgatttgtggaatttttgtttgtttgtttctatagaatgttcatattctggatttgactcattgcttcctgttggtatcacataacgccttctctcacctagtttttcctatgtgttggtagttgtagtgaagacttgattagatttgttcccattgtggcaggcaagattatgcaatagctggtgctatgtacatcctcttgcaccatatcataagatatgtaatagtaattgcctactttttgtgctgttaagactgattaggggatttcagtgggttcaacccaatccctccattataaaccactgcacacaatacaattttcatctgatatattaatattcattgattccatcaatttccagattcactgcttcattagaggttgcaaaatggcatcttgctgattttatcatgccttctgtgtttattagttgggattcctctacaaagaaggactcttcatcatttaccttttaggtaacctaacatttaattcatacaagaaacttagaataagtgtttgactctttccctttatttatcagttttcagataatagattggttctctagcaatcttcaaaggtaaccaagaaggtatttttgttgtgatataattataaattcacagtttaacaaaaaatatatttgatatgtttcagtccactgcagtccattcattcttttggcacttaaatggtcctatttgaagcaatggaagttctttagattggcttctgtgtcctttgacaggacctcatttggtttcgataggtttcttgttttctaggaccagatgtctcaggcctactttgtactcatgcaatggacatgaaatcacctatttctccttgtagatctagttgcttttattgggaaatgatatacatcaactagaattcggctgctaggagccctttttattactgagttgcctttgctgtgaagtcttttcaatggtcggagctaggaaaatgtacaaatatgtttaaaaagatagcaaatcagaagcttatactgatatttcaattcaaatagaagattatattaggttggtgcaaaagttatggcaaaaacagtaattacttttgccccaacctaatagaataatgcatacctgtatttaaattttctcacactgataagtttggctctaaatgacattaacatatggtttatctgctttatcctacaacatacttatactagtatcaagataataatttatattccttagggtatatacccagtaatgagaatgctgggtcaaatagtatttctgtttttaggcctttgaggaatccacatatcttccacaatggttgaactaatttacactcccaccaacagtgcataaccattcctttttctctgcaactgttattttttgactctttaattctgactggtgtgtgatggtatctcattatggttttgagttgcatttctctaattatcagtaatgttaagctgtttttcatatgactgttagtcacatgtatgtcttcttttgaaaagtgtctgttcacgtgctttgtcattctttaatggggttgttattttcttataaatttgtttaagttccttatagatgctggatattagccctttgtcggatgcatagtttgcaaaactttttctcattctgtgggttatttgttcactctgttgatagtttcctttgctgtgcagaagctctttagtttaattagaccccacttgtcaatttttgcttttgttgcatttgcttttggtgtctttgtcatgatatctttgcctgttcctgtgtccataatagcattgcctaggttgtcttccagggtttttatagttttgagttttacatttgtctttaattcatcttgagttgatttttgtatatggggtaaagaaagggtccagtttcggccttctgcatatggctaaccagttatcccagcaccacttatagaatagggaatcctttccccattgcttgtttttgtcaggtttgtcaaagatcagatggttgtaggtgtgcagacttatttctggattctctattctgttccatgtgtctgtttttgtaccagtaccatgttttggttcctgtagccttgtagtatagtttgaaattgggtagtgtgatgccttcagctttgctctttttgcttaggattgccttggctattcaggctcttttttagttccatatgatttttaaaataatttttttctagttctgtgaagaatgttgttggtagtttgataggaatcacactgaatataatccaatgtgattgaatctgctcaaattgctttgggcagtatggcctttttaatgatattgattccccctatccatgagcatggaatgttctttccatttgtttgtgtcatctcttatttctttgagcagtgttttgtcattctcattgtagagatttttcacctccctggttagttgtattcccaggtattttattctttttgtggcaattgtgaatgggattgctttcctgatttggctctcggcttggctgttgttggtgtacaggaatgctaatgatttttgtatgtggattttgtatcctgaaacttttctgaagttgtgtatcaactgagggagcttttgggccaagactatggggttttctagatatagaatcatgtcatctgcaaacagggatggtttgacttcctctcttcctgtttggatgccctttatttctttctcttgcctaattgcccttgacaggacttccaatactatgttgaataggagtgataagagagggaatccttgtcttgtacaggttttcaaagagaatgctttcagcttctgcccattcagtatgatgttagttgtgggtttgccacagaaggctctttttattttgaggtatgttccttcaatacctagtttattgagaatttttaatatgaagcggtgttgaattttattgaaagccttttctgcatcaattgagataatcatgtggtttttgtctttagttccgttattgtgatgaatcacatttatagatttgtgtatgttgaaccaactttgaatcccggggataaagcctactttatcatggtggataagctttttgatgtgccgctagatttgccggtattttgttgaggatctttgcttcaatgttcatcacagataatgtcctgaacttttctttttttgtggtgtctctgccaagttttggtatcaagatgatgctggcctcctagaaagagttagggaggagttcttccacaattttttggaatagtttcagtaggaacggtaccagctcttcttgtacatctagtagaattcagctgtgaatcttctctcttttcttttttattactccagctagtggcatacctatttcattaatttttaaaaaaacagctcctggatttattgatttttttttttgagacagagtctcattctgtcacccaggctggagtgcagtggcatgatcttggctcactgcaacctctgcctcccaggttcaagtgattctcatgcctcaacttctccagtagctgggattacaggcatgcgccacctcacccggctaatttatttattgattgatttttattttttaagtagagatgggagttgcaccatgttggctaggctggtctagaactcccaacctcaggtgatctgcccaccttggcctcccaaagtgctgggattgtaggtgtgagccaccacacctggccctaatcttttgaatggtttttcgtgtctcaatctccttcagttcagctctgatttgggttatttcttgtcttctgctagctttgggatttgtatgctctcagttctctagcacttttagttgtgatgttaggttgttaacttgagatctttctaactttttgatgtgggcatttagtcctataactttccttcttaatactgcctttgctgcatcccagaaattctgtatctttgttctgattagtttcaaagaacttcttgatttttgcataattttattatttacccaaaagtcattcaggagcaggttattcaaatcccatgtaattgtctggttttgagttaatttcttagtcttgattcataatttgtgctgtggtccgtgagactgtttgcagctggcttgattttcagatcaactgtcagggtatcacagtacttgtgttcaggaacccctattttacttaaaatactaataataacttaattattggttattgttggtttctctctgtgcctaatttataaattaagctttatcgtaggtatgtttgtataggagataacccagtatatgtatggtttgatactatctgaggtttggggcatccactgggggtcttagaactatccccatggataaggggggactactgaacctccttttcatgctctactctttggaaagaagtcattaatcacagcccacacttaagcggggagcagttacactctacctcattctgggggagcacttatataaattgtttggaattcttccatgtgacagttgtctatcctctctcactgatttactcaatcatttatttatagcactataggtttatgggtatttattttgtgctttgtactatattccaatacatacatttagttatttacttcattgctcaactttttccaatctggccattggcagcacttttaattgacaccttgtgttttttcatttttgtttgcttctctgttatttaaaaaacttccttactttctgacatggcaagatgctccaggatcatcttttatgtctcctgccctagtcctaaaatcaacaatttctccaagagccacttgctcctagtcagggttcttcagataaactgaaccaataggagataaatatataaagagatttattttaaggaattcactcatataactacggaaaatggcaaatccaaaatctgcaaagctgatgtgtcagtttgactttgaaggctggaagctgctgtagaaccagagggagctaatgtcccagtttgaaggccataaggcaggagagttctctcctaccagagggagggtcagtcaggcttttgttctattcaggccttcagctgattgaataagacctacccacaatagggagggcaatctgctttactcagtctatggattcaaatcttaatctcatccaaaacatcctcacagaaatacttagaatagtgttcaccaaatatatgggcacctgtagcccagttaagttgacacataaaattaaccatcatggtaacagtgggtaagagtgggtaatagcattagcaaccaagatctaggtacaagatgtgctcactgctgctggtgtgtcactgcttctgggccctgttaggtgacaataaatacatttatatgtattattatatgtaacaatttgtatctatctattcaagtctccaacttgaattcattaccacatggatcattctagcatcttctcttgcttatctacaacctcacataacaacagcaaaaaccctggctgcgactatctgctatccatttacttaattgttttgttcctcagtatgtattgtgatgggaccatataacatgaatggaacacataacatccatggaagttgccacataaaattaatcatcagaacatatgttgtggaatagaattaaaattagagggaagatggattggagacagggctgacttgcagctcccactttgaagaacagaacatcatatggagactcacactgtgaacttttgctccaggaaccactgcagaagcataccatgaaaacagaaagaaatcacagattttttgaaaagagaagaaggccattgcaaattccacaagacagatgaagaactccagtcacaaaagacataaaccgttgagagctttatgaccccagccatcacctgagaaacctgaatacttatcctggccaacttagggcaagcttatattccccttctactatcgcagctggtgctctctcaaaagtgccacctcctggctggaggccaaccaactcaggacagtacagcaactcaggacagaacaaccctgctccaaagaaggagaaaaaaacggctcattccactgcctgcaacattctggtctgtcgatgtgacaacttcactgctagcataaccagaatttgagaaaaccagcacactaaacatatcaacaacgaaagactctcacagagtctacttcacacccctgccacctccaccagtcataaaaagaaatcaaataatggcattcatagcagcctggctaaagttggagaccattatcctaagtgaagtaactcaggaatggaaaaccagacattgcgtgttctcacttgtaagcgggagctaagctatgaggactcaaaggcatacaaatgatataatgaagtctggggacttggggagaagggtagaagtggggtgagggataaaagactacacactgggtacattgtacactgcttgggtgatgagtgcaccagagtctcagaaatcaccactaaagaacatttccatgcaaccaaacaccacctgttcccccaaaactattgaattttttaaaaacacatcttgcagaatagaaaaaaaaatttaaattatggtggaatatttttgtgggagttcccagatatctggtaaaacatttttcagggtgagggtgtgtctgtgagtatgtttctggatgagattaatatttgagtatatatactgagtaaagcaaattgccttacttatgtgagtgggcctcattaaattagttaaagggaagaatagaacaaacaggttagtaagagagaattccttttgcctaatagcatttgagctgggttttttctgcctttagactcaaactagaacatttgctttcttgggtctcctgctggtccactgcagatcttgggacttgtcagccacctaaaccacatcaaccaattctttataatctctctctctctctaaatacataggtaagtagattgatagatgcagatagatagataggtacagatatatatatatatttgtgtgtgtgtgtatatatatatgagtgtgtatatatgtgtgtgtgtgtatatatatgtgtgtgtgtatatatatatgtgtgtgtgtatatatatatatatatataccctatagtttccattactctggagaacactgactaaagcacaggcatagtggtttcagaattgttagtcatgccaccatgggaagcagccttatcaactcaagtacaatactgacatacagttctcacaagtttctttgcctttagtctcatagactccactcacttgcagagttcctgatgtcagccttttttcttcccatccacttcagggaggtgatttcacacatttgtaatatagttagatccttttgccacattgtacattccattctaagatctttcaatctcataaatcattttctttaatttcaaacattaaggtttactccacagtataaaattctatgagctttccctaataaaaattccacagtataaagttctatgagttttccaccataaaaaaatcccagcaaagtactttgtggatatcaacaaactgattctaaagtttttatggcgaggcaaaagacccagaatagctaacacaatattgaaggagaacaaagtcagaggactgcaagcatcctactttaagacttactatgaaactacagtaacaaagacacggtggtattggtgaaagaatagacaaatagatcaaggaacaaaacagagagcccagaatttgatctacataaatataatcaactgatctttgtcaaggaagcaaaggcaatacaaagtcagcgttttcaacaattggtgctggaataactaggtatctacatgtagaaaaacaaatttagatacgggtcttatattcaccacaaaaattaacttagaatggatcataactctaaatgtaaaatgcaaaactgtaaagctcctagaagataacataggagaaagccttgataaccttaggtatgacaatgacattttagatacaatgccaaagtcaggaaccatgaaagatataattgataacatggacttcattaaaattattaataaaacttctgctctgcaaaacacactaccaagagagtgagaattcaagccacagactggaagaaaatattggtaaaagacatattcaataaggactattatccaaactgcacaaagaactcttaaaattaacagtaagtaataacttgattataaaatgggccaaagtctttaacagacacatcaccagtgcagatataaaaaatagatgagcatagatcagagcaatgcaaattagcacaataagatatcactacatgcctattagaatggctaaatccagaacactgaccataccaaatgctggcaaggatgtggagcaacaggaactctcattctttgtaatgcaaaatggtatggctactttggaatagtgtctggcagtttcttacaaaactaaacatactcttaccatacaattcagcaactgcatgccttggtgtttacccaaatgagttaaaaacttatgtccatccaaaatcctgcacacagatatttatagcagctttattcctgatttcccaaactaggaagcaaccaacaaatctttccgtagttgaatggtaagtcaactgtggcccatcaaggcaatgaaatattattcaacactaaaatgaaatgagctatcaagccatgaaaatacatggaggaaacttaaatgcatattactaggtgaaagaagccaacctgaaaaggctacatactgtagccaactatatgacatgctggaaaagggaaaaaactatgaagacagtaaaaagatcattggctgccaaggcttagttgggaaagataaataggtggagcacagaagatttttagggcagtgaaatgaatctgtatgatactatagtggtagatacatgttatccatttttcataaccatagaatgtacaactgcaagagttacccttactgtaagcttggactttgggtaataatgacacatcaatgtagatttgattgtaacaaatgtaccactctggtgggggctgttgatagtgagtgaggctatgaatttgtgtgggcagtgggtatatggtaagtttttgtacctctggacaattttactgtgaacctaaaacagctctaaaaaataaagacgatatagataaacttggcagacattatgctaagtgaaataagccagacacaggaagacaaatactgcacagtctcacttattcgtgttatgtagaagagaggaacttatggaagtttagagtagaatgatggttatcagagactgggagagggggtggagatgggacagaatgggaaatgctggtcaaagagcacaatttcagttagatgagaggaataagttttgagatctactgtgcagcagggtgacaatcatcaataataatatattgcatatttcaaaatagctaagaaagtaaatttcaaatgtctcaccacagaaaatgataaagcagggtgatagatatattaagtagcttgatttaatcatttcatattttgtacatatataaaaacatcatattgtacctcataaatttatgcagttttgtttttgtcaatttaaaatattaatttttaaaatccccccaaaattctatggattttgacaaatgcataatgtgacctcaccactgcaattgtttcacttatcaccttgcaaagatcctttgccttttcatatcaactttatccagtttattgatatttaaacaatatcttgctgggattttaattgcaattgtgttgaatctatgtatcaatttagagaaaattgacagcttaataattttgagtctgccaatctacaaatctggaatatctcttcatttatttacatctttgatttatttcatcattatttagtagttttccacctatggagtctctttatattttgttagatttatgcctaagcatttaatccttttggtgttattgtgaatggtattgatttttaatttcaaatttcagttcctcattgctggtatataagaaagtacttacttttgtctagtaacctcgtgccggcaactttgctctctctgcttgttgctgccaggaaagttttggtagagtctttgaaattttctacattgactaaatgtcatatgaggataaagagagtttttttatttctaatatatattacttttattgcttattctcatcttactgctgcagttaaacttctagtacaatgcgagtaacagtggagagaggggacatatctgccttgctctcgaactatgtgaaaacggcctagtctctcactgttaagtatgatgttaactatgggattttttatttttcagatgttctttaccaagttgaggaagttgccgtccatttcttgtttgctgacaagcttgttttctttgaaacatgaattggtgttgggttatataataaactttttctgcatcaactgatataattatatgatttttcttttttagtcttctgatatggtagattttattgatggcttttgaatgttacactagccttgcatatataggataaatcctgcttagttatggtgtataactttgaagtacttggtaggattaaatttggtaatatttggttgagcgattttgcatctatgtttataagaggtattggtctatagttttcttttctcaaaatgtctttgtctggtttcggtgttagagtaatatcgacctccatagaatgagttataagcgttctctctgcatctgtttcccagaagacattgtagacaattggtatcatttcatttctaaatgttaatagaattaaccaataaaaatatctgggcttggtgctttcttttagagaggctataaattattgattcaatttatttaataggtgtgttactattccaattatctgtttctccctgtgtgtattttttggtaacctgtgtctttcaaggatttggtgcatttcattgaagtttcaagtttgttcatttgtagttttcctttattatactttgaatgtccatatactataagatttttattttttatatagatacacatacatgcacattgtttttaacctccttttggtatgtttctacatcctagataatttaccttgtcagttattttccttttcattatgcctcatgagtatataactgtatgcatggtcagtgggcttaggtctgttatcacatgcgtgctgttggggaggtctggagtgcagtgaggagatgtcaatgtcagaagctgcccgtgttgctgaggaaaagcctaggggtgaacacagtgggaatctgacacagcaggatcgtgaaacaccctctgtgaatttgccagccaaataataaaatgtctctagtgatgtgggagccagaatgttagggggataattgtcactcctgaggaaaacaggaactgaggtggcccaaaggcaacactatttcactgaccatccacttatatcctgagactttccttagccattcagagatgccagcccagttcacagacaggccagttcactcctgagggaggaatataactgtctcttccggtaaacagactcggttttgtgggatctctgagaggcttagagtgtgaaagggagggaatttccatgcttgttttgcttttgcatttcaaggaataagcatgagagttttgtgcctggctgtttggatttttattttttatttttcgagatggagtcttgctctgttgcccaggctggagtgcagtagtgtgatctcagctcactgcaacctccctcctgctcctgggttcaagtgattctcctgcctcagccttccgagtagccgggattggcgcccaccgcatgttcaactaatttttatatttttagtagagatggggtttcgccatgttggccaggctggtctcgaactcctgacctcaggtgatctacccacctcagcctcccaaagtgccgggattacagatgtgagccaccacccccagctgtttggatatttaattgtatcagctttaatgtcccatttccccgttgtgaagattactgtggtgcatatccatgtgtgtacagctttctgcatttgcacggtctcctcaggatacatttccagaggtgtaagtccaattctaagtaggcacatattgattgctgttgatacaccttgtcaaataattttcttagtcatgaggcaattctaagtataaataaagtatcttattttcttcccaaatgacttttactctatttggccaaaaatgtttctccactgggcatttaggccaagcaccggtgtataaggaggagtagtcttagagaccaagtctgagggactgggctgccagttcctgcatacagtaaaaccagagtggacaatcatggtggaccaggtgcctcccgctccacttgccaaacatttaggaggaatctaatctgagaagagacctgaatatcaggatgccatagtgctgttaatcgaacctctctaaaggagaaggtttaagcacatggggatatggattatcagttaaaaataaaaaggcgtttgtcaactgaaaaagctgaagaaatattggtaccatgcattattctaaaacctgctttatttagaaattacaaagagcaaagagcagagaaatcatcacagggagaaagactgtgtacatcatacgactagtcacttgtgcttccatgcatactgcggggcgggggttcacaatacttttaacttagggagtttgggggccaatggaaaataagtggaagttgttctgaaataagccccaggcgattttcagtaatgaaaaggaacagagatcattttcttataatgctcagcctcagagagaacaattttggaggcaagaaattaataatttagtaacaaagtgaagctccattggtgaatacattatgatgtaaaatcaaaggttgatctgatggtgagcaatgggtgctcagatggggcaggtatagacagagagaagtgagggcactaagcatccatacccagctctacctcggagagcagggaagactagaggccaggagaggataggcaacctgaggagacggctctgcagccagagaagggcctgaggactgtgggaccgagagctggaggcagcactttagtgcttgtagctcttcctgctggaggaggaggtggtggtgtacttgatggtggaactgccgcctccaacagagctgaggccacccccaatggctctgccactgctggaactgaagccacctccaatgccaagaccactgccataggagtagctgcttcctccacccaggcctaagccactgccgacaccgctggcaccgccatagccactggagatggtggactgtactacagctgtggtggggaggggacaaggacacaagaagccacggtgagctcatcctgccggcctgagcccagtcagaagagtgcgagggcaggggaggaaggcaagcaaaggtacttacagacgttgacttgtccaacgccttcgccattcagcctgtggagaggaacacagggagggtgagacctcagagagctcttccttccctggaccagtgtgggcagcctcggtgggtggaagagtccatgggaaactgctcttttagttttctctcaagaagagcaattacggccatgagcagtgcaccctagaattgtgctcagtgccaggaaccttgaagatggactcagctgttggaggaagtcgcgtcagttacctacctgcactcctcgccctccagcagcttgcggtaggtggcgatctccacatccagggccagcttgacattcatcagctcctggtactccttcagcagccgggccaggtcctgcttggccttctgcagggcatcctccagcccttccagcttgttcttagcatccttgagtgccatctccccacgctgctcagcatcagcaatggcagcctgcaggctggcacactaggaggggaaaggaagagaaggaacttcttgtctgctcctccggaggaggctggcccttgtttagtgaaccagggtcctgtaacccaaaattgacagagaatgagctttgactcttcctgtccagtatttctccatttggcaatatttgtctagtctgggagtcaagtgacaaagtcctatgccccttgtattaagcacccgcatgagaatgtgcgttgcatcttatgggagacactacaatggacccaaaaacaagccatatggaagatgaatgctcggtttgtact

SEQ ID NO: 510 - DNA, 17991 bp, Homo sapiens
cttagccatctcctatcttagttacttttctccttcaactgtattttgccattgtcgttgccattgcctctgcctaactgcaagccatcatcatctctcacatggactatgacgacctcctcatctccctgtatcttctctaatgcttctctcatatacatgctctcagcagccacctggtttaaaacaaaaacaaaaaaaacactaatcatgtcattccctgcttgtcttcccgttctttccaactgtcattccctgcttgtcttccaattctttccaactgcagttaagatcaaaccaccaagacctcaccaggctcccatctacttttcagcctcaactcagtccacctgctctgccaatcacacctgtttctttttgttgttctttccctaggatatagatcctggcatacctgcattctgattcttcttggaacaagccaaattctttcccctgtcagtacgtttgcatgtgtagtacatgttgcatcccaggcctgtctgccttcttaccctattttattttcatcatagcacttactaccatctgaaatgatctcatttatggtttgtctcctcagtgattaacacagttcctgcacacagtaaatcagtagttctcaacaggaagtgaagaggtcatcctgaggggaacatttagcaatacctagagacatttctggttgtcataaccaggggaatgctcctagtggatagaagtcagggaggctgttaaacccattccacaatgcacaggactggaacaaagaatgatctctcactcagaatgtcagtgttgccaaggtggagacatcctgcagtagatgcttgtggcagagggtactggttgtaccccagtatccattctttcattcacctgtgttaatacatgctccagttttgtatttttttttataaacagctgtcaagcataaagataacattttccatctccttgtatgtaagtggaaataggactgtcatgtggggccagtttcttttttttcttcctctgtcctgctgcttgaaacatatgctgctatcttagatcatgaggtcgaggccatgcaaagtggagcaacaaggagctgtgtccctgacgccataagcaccacacctgtcctgaattgctgtgaatgacaccagctaactacaatgcattgtctcaacatcctagacataataaaaagccataaatatgtttgtcctatgcagcacaaaacctttgtatctttgccttttatgttgggatcttaattaaaaattacatcctctactgtctctgcatgctcaactttttatattcgacttaaccattattaatcagcatcatgcatcgcacccccacaatagctgtgcatttcacattataaaagtttacaaatctcttctgcctctttgtctttagtatggtgtacaccacaacaagaacaaacacctcaagaacattcaggcacattatatatacaaagatagcacataagagcttgatgtgtaaacaaggtgtgtaaacaagttaggaagaagtttccaactttttcttggcgatcaactcctttcctaaatttgagcgaagaatgtgtttgaagtgttggctttgccccctaaactaggtgtcttcctggttagccaggcttctctgaagtctttccttcagaaattgttgttctccctgaagcaccacccatggtaaagaattttggtctctcccaagggctgtcaatttcccggagcacaaaagacccttacagcaccacttctcagccaagggcttcctggaataatcctccatagaggtttacttgctgaaactttctctttttaagtttgttggttttttttcctcttgaaacaaaattgatacatagtaaatgtagaaatgaaagaaaaaatagctgtttgtctaatttttatatatatatatatatatacacacaaatatttacaaaaataagatcacacctatttttatgcatactgttttgtgacctgcttttgttccccctacatcaatattcttctgcaacagaattctacaaacaacttctcataggtcatatacacatcacctggggggttcggtttgtttaaagcacagggactcatatgccctgtttaccactaccaccggtgagaattcctgccccaggtaacagtgttagtaatgagactgccataaccatccagtatgtgagagcaaaaaaggtggatgagacccatcgtcctatgacaaggtatttaccttatcccctgttggtgacatttcatgagaatctttattggcagaaaatgctctggaatcagtagaacatagtggttacatgcgtagattacctgtgtccaaatctcatctgctttatttattacccattcagcatctcagtttcttcatctttaaggtgatttagactctaaagtcttgctgatgagactaaacgagttgatacatgttaagaacgtttaacagtttctcatggtaaactattctgaacattatacaaagactgatgcccagtcataaatttccccatctaaaaacaataatctaatggaattttaaaatgtcttaaaaataaaaagtgtactggagatggatggtggtgatggttacacaacaatatgaatgtagttaataccactgaacgatacatttaaaagtggttggttagtacaacctctttggtattaactactagtattaaccacttttaagtgtatagttagatggtattaactacattcatattgtagtattaaccatattaaccacttgtaagtgcattttacatcattgaaaacattgggaaacaaaaggtggaccccctagttttctggaatgaaaatgcacagtgttgaaactggtagatagttaaggatgcctttttttttttttttttttttgagacagagttttgctcttgctgcccaggctggagtacaatggcacgatctcagctcactgcaacctccatctcccaggttcaagtgattcttctgcctcagcctcccaagtagctgggattacaggcacccgccaccacgcctggctaatttttgtatttttggtagacaccaagttttgctatgttggccaggctggtcttgaactcctgacctcaggtgacccacccgccttggcctcccaaggtgctgggattacaggcgtgagccaccgtgcctggcctgaggatgcctgttcttaactgtgatcagtcattcccctgccacccctcttcttccacctcagagaaagcacagagccccatttgctcaggtatgcaactaatgtttgcttatctggattgaattcagttcaattctagtgtgtcagattcttttcaggtgactcttcccattccccatcttcagagtgtgtcctgttgtcttaagattatgataggatcagatgcaattttgaccaacattcttaaaatacatccagacatggatgtatttcacttcaaatcccattggcagatttgatattatgaaagggcctgggtctgaggtgttttgttagtcacttgaaccttaactgcaacttttttttcctttctcaatgattaaaataattacatatatatgtatatatgcacatatattatgatgtttttacatcttttttttttttttttttgaaatggggtctcgttctgttgcctagactggaatgcagtggtacgatcacagctcattgcagtcttggcctcccaggctcaagtgatcctcccacatcagcctcctgagtagctgagactacaggcatgcgacaccaagcctctttaaattttctcattttttgtagagatgggggggttctcactttgttgcccaggctagcctcgaactcctgggctcaagtgatcctcccacctcagcctcccaaagtgctggagttacagtgtgagccaccaggcctggcctatgtctatttaaaaaagaaaaatgcagctaggcgcagtggctcatgcctgtaatcccagcactttgggaggccaaggcaggtggatcacttaagctcaggagttcgaaaccagcctgggcaacatggtgaagccccatttccaccaaaaattagccagatgcggtggtgcatgcctgtagtcccagctacttaggaggctgaggtgggaggattgcttgagcttgggaggcagaggctgcagtgagccatgattgcaccactgcactccagcctgggtaaaggggtgagacccccatctcaataaaaaaaataaataattaaaaaagaaaaaggcaagggcagagtggatctcaatatttggggcctagagcagatacaacttggggagttctctataaggaaaacaatacaaaattaccaaaacaaaattaggtatgaatttattcagaataggaacagaaatcgcaacaaataactggaggtttggagattcagatacctttctcctaagatctcttgggacaattcatcagggatgcttcccagctgcaacctagcttctcctttctacctaggacactctacaactccagtattcttgatacctgtgtaccaaaagccctgaagcttcactatcattatttccatataaatcttcctctagataaggaatgggagggcagagttaatataatcaatctgttgaaaacctcaaaaattttttggagttttttttaatttttttttttttagtttttaattttttgtgggtacatagtgggtatagatatttatggggatacatgtgatgttttgaaacaggcatacaatgtgtaataatcataccatgtaaaataggatatccattccctcaagcatttatcctttgtacaaataattcaattatactcttagttattttagaatatacaattaaattatttttactatagtcaccttgttgtgctatcaaatactaggttctattcattatccctatttttttgtactcattaatcttctccacctcccctctaccaacccctactacccttcccagcctctagtaaccatccttctactctctttccttatgtgcttgttttggtttttacatctcacaaataagcgagaacatgtaacgtttgtttttctgtgcctggcttattttcacttaacataatgacctccagtttcatccatgttgttgcaaatggcaggatctaattcttttttatggctacgtagtactccattatgtatatgtaccacattttctttatccattcatcttccaacggacacttaggttgcttccaaatcttggctattgtgaacagtgctgcaacaaacatgggagtgtagatatctctttgatacactgatttcccttttggggggttatatacccagcagtatgattgctggatcatatggtagctctatttttagttttttgaggaacctctaaactgttctccatagtggttgtactaatttgcattccctccaacagtgtccaaagggtttgcttttctctacaccctctccagagttattgcctgtcttttggatatgagtcattttaattgggttgagatgatatctcattgtagctttgatttgcatttcttttatgatcagtgatgttgaacaccttttcatacgcctgtttgccatttgtatgtcttcttttgagacatgtcaattcaaatctttttcctatattataattggattattagatttttttcctatagagttgtttggacaccttatatatactattaatcacttgtcaggtggatagtttgcaaatactttctcccattctgtgggttgtctcttcacttactgattgtttcttttgctgtgcagaagctttttaacttgacgtaatctcatttgtccatttttgctttggtagcctatgcttttggggtattactcaagaaatctttgcccagtccaatgtcctggagaatttctccaattttttcttgtagtagttacatagtttgaagccttagatttaagtatttaagccatttttatttcatttttgtatatggcaagagatagggaactagtttcattcttctgcatatggtacccagttctcccagcaccatttattgaagagactgcccgttctccaatgtatgttcttggaacgtttgtagaaaatgaattcactgtaggtgcgtggatttgcttctgggttctcagattttaaggtaatatgaatcatactttttctttaatttatagtgagtgtattcatttcctattggtgctttcacatattaccacaaacttaatgactcgaaacaacacaaatttattatcttacaattctagcagtcagaagtccaaaattagtcttactgtgctaaagtcaaattgtcggcagaaaaaagcaggaacaaggaagaagagggtagaggaggagagggaggagggaggtggcagtgctgtggcagagggacaggagcaggagggggatggagaggagaaggttcctaggtggcacagtgctcctgctcctcccggcgctgcccagccccctgtcagtgagggctgaacccccacaggataaggaagcctgagtgcataccaataatcaaagctacatctgtgacacaggacactgctgtggacagtctcagtgctgcaactactgctaggaactctggtagctctggctggtgtggaccatcatcatcatccttagctgctgctacattggccaccaccgccaagccaagcaccgccttcaggcccagcatcggcaacatgaaatcaacctgatcccctgccaagaagccttcaatcactcagtgctgcctttttatttcaggtttttgctaaactacttaactacctccttatgaggaagtggtgagccagcctccaactcctcccccagcatacagtgacttccagctacgcagcagcagcagctcctgcctccacagtgaggcctggcagatggcagtcccccagcgccaatcccaccaggggatccaagggaatcccttgtctgagcccagcagaagcatcacaagacccccaagcatcgctgatcctgagccctctgacctaccaggtgaccgagtagccaccaaagccctggggatgcagcccagtggctctgtagccagcctgggagagctggacccaggggccttcctggacaaggaggcagaatgtaaggaggagctgctgaaagatgacagttctgaacatggcagcgcaccgcccaacagcaaagagaagatgctcaggagacattgccacttcactggtgacgcgggcattgaagtgcgtatgtcagggccaccatgatcatagccttaaagagttcaacatgctcatcgctgatgcactggatgggcccctggacttctgcgacagctgccatgtgcagcctcctggtgatgaggaggaaggcctcttccagccctccaaggagcaggcttgacagcctgggcacctgcacctgccacagctacctgcatgcctgctgctaaacatcatcaatgagcagtactctcccaactcccagagcagcagctcccgcagctagatcaggctctgccagcacccaagaacttggcaaagcaaccagggtaggggagaaccacgagagaagcattaaatgactttcagagaaagtggtacagccacttgattcctttttttttttttctttctcctctcctgcattttcctccatctccaggtacagtttggggtgtggatgcctctcgccctacaaaggcacaatgttgtggagggctgagaagttggttctgtttctcgttcctcataccccatccctatcccctttattctccctttaaagtcctatctcacctacctgtttgggtcagagagatgtgttttaaaggcccccaaggaaggaggctgggactgtgccctgagatgattcttggtgacgaagtggatttgtgctctgagtttagtttaagagaacgtcactgtgtctcagtcccggagaggcaacccatcttagacctgggtgaagaaggaagcctgcagaggcctaggctttgtcgcctgtggctcccagtgtctgcagagccagcattgagctaatcctgtgggaggatgagagctgatcggcagttgtatgataggttggtagggggcttgtgatctgtgaaattccaggtgatggatgcatccagtgtgcatcactaagaggccctttcccagtggcctctggctggctgcaggctggttccagtgtgaaagattatactgccttttcttttttttattttccttttgaaaacagacaacaaaagacaactgaaaataacttccccagtgagcaggcaagaattctcttctgaaaaatgacgtttgtagttctttcccaagttggccttcaaagagcctggctgcagttgagccagaaggagatgtcttgtgtgaaggctaaagtggaggctgtctctgaaatctccgtgagcaggtggccctaagccatggtggtggatagatgtgcagctttctgcatctctgccccttggtctgtgcccacaggtggccggcgtcagcctccatcccgagcacatgctccgcgggtctttatgtctcactgttcttcacacataggaggaaagagataggagactgaggaagggatggaccctgagaaagggcccctccagcctggctctcacacagtattttgtctttgattctgaataaatttttttttgtggtttgtcttttggtttttttgcggggatggatggctggtcgttgtctgttttaaactgacctcttcgaagaaacaccttggttatctgtggttttcatgttctgtccctgcccctgtccccactccttttgagtggggcaactcattttttgtgtaaagagtctctcagataggaggtgaacacagccatctggaagacccgcaggatccttgtgcctgttgcttagcttcgggtcaccagctgagctgtgataggaataatctgaatggaggcggcaaacagctgaaatgaacattcctcgtgcagccctgttcacatgaagagtctgatttcccctacccttgaacaatgatgatattcagacaaggcattgacgttgtggtaagaatatatatatatagaaaaaatacatgtccccaaacagacaaatccaaggctgtgaggtaaattagtgcatttggattccacaaaaccaaaatccatgttgaacagagtgaagtccgtacactgtaactttttgggtgaaccctgcgtgcctgtccattgtgtgtgaccccgagccctgtttccctaggaagatactttgagtgacagccattctcctcaggcaaaccacatgtctggagcacaaacggccctctctaagtaactgatgttacgcatttactgtttatggggcaaatgtctgactatgtactcaggtgtatttcacagcattgtggactgactgcaggcccctgtgtttgccagagataactgtgctcaacatagaggttttactctactcaccactgcaacttgcacactgctccggggacacatgggagcctgtgttctgttccctgtaaatggaaatgtgctctgagcctgtctgcctccctcggctgtgcctggtcctctgtaccagcccctaggggtgtccacaaccacctgggacagaagaaggtggaatttcagacagaagcttgattgagtcttcaaagacagtcttggactagctgtggcccagacctcggccctgcccagaattgccaggaggaggctttgagggcactgggggtactgcagggcctgcctccctctgccgagtccagtgggcacaagcaagctggcatgtggccaaaggtggctggattgtgtcatagccctcagacgcctttccttccacctttttaaagaatcccaaataactcactgaagtgtctcaaaggcaaacaagttctaccaaaatgaatcctttttcagtgaacagatcaaatggatgaattctgactctctcaagttcctttccccagttagagtggggaagtggtggagtgctaactgtgtgattcattgcagtgtcctaccctaaaggcacaagaagatggaaatgcaacctgtggagctggccttgattctcaagtcgcagtctggcccccgctacaggaggctaccccgctcagggagagatttaataaggaattggttccggggccgggagatgtgattgagactggttttccagctgaatgagatggaaggggttagtggagggtttgatgctacagccagttgagagatttgcaaatgcgaacacattcctgtgtgaggcacattatcctttgtcagttattgtgaatatgtgtattttaagcagtaaggtgctactggtcagacttttctaggcagtcttggtgatgcatttcctgtgctgagattgttcggaagagtgactataaccactgtgaggagcccaaataaaaattgatcccccctccgccccaaaaaaagctgttagcagagctggttcccttcaggagcttctaggggagaatctgtgtcctttcctgctccagtgtctagaggctaaccgcattctttggctcatgttctccttccatctttaaagccaggaagagatggtcaagtctttctgacatcatataactttgacaataactcttctgtctccctcgtccacaattaaggatccttgtgactacattaggccaagcagatgacccaggataatctccctattttaaagtcagctgattagctaccttaattccatctgctactttgattcccctttgacatgtaatttgacctacagattctggggattagaatgtgaacatccttgggagaccattgttctgtctatctcagtgggtaagttatttgaatgctaaatgcttttgaaaatgctttctgcaatcagagtcccataactgttcttgattcttgatttggagagtttttatttttaattggactgtctgtgagggaagcagaggcatagttctaaatttaagaattgaaatggagcaagtagccccagttcagcatgcccagagtctgctgcctttggtttttccaaaagaaggcagctgcaaaaaaatctctaaacactataaaatataccataaaaaaagcagaattgcaaaaagatggctaattgaacacacactttcactctctcctaaactgcactgaaactatggtatggtaaagggttttttgttttgttttgttttgtttttgtttttgtttcttaagcataaacctataaggatacagtgaacatgagaagaaatagcaccaactttttgaaagctacaaaacagataacaggtggtatggacttggtaaaactgatgaaaaattgaactctttttcctccttggttccaagaaccaagtcaatttaaaccaccaaataatcaaggctcaggcattgaaggcacaactactcctagaaaagaggggcagggctgtgaaagatgaaagaaggttggttgaaagctgttggagaagcagttatatccctagatgcccctctcttcctccaaatgctgggtgatttccttccctcaccccagcagaagacagtcttcctctttgaagagggtaaaacagagggtgtgttttaacaaacaaaaaacaggagggttaagtaaatgatgtatgcctactaaatgcaaaacttcctcctcatctcagaatgacggcagcagttatttacttccaggcagaacaccaaataagtcttttgtaggtgggaatctatcagacccaagaagaaagatccaaatacactcacatggatgttgacatcagggcttccccaaccaaaggcccaggcagctcaccctacaggaaatctcaccatgatcaagcctcacctacttactcagtttccaggcagctcttgaagcctccacttttaaatatgagcaggtaatcaagcatgagagattcgagaaacacctgaacaggaaaaaaaaatatatagtgaaaacagaaagcgtgcgggaagaacaacaaaactctcaatgtcttcagaaacgtcatgaatttttattacaatgcactcatgaaatcagaattgaaaagtataaaaaaaaaatttcaggttgctcacacctataatcccagaattttgggagactgaggcaggaggatcatctgagtccatgagtttgagaccagcctgggcaacagagtgagcccccatctctacaaaaaaaagaacaataataaattagcaagatgtagtggcacatgcctgtggtcccagctacccaggaggctgaggcacttgagcccagaaggtcgagaccacagtgagccaagatcacaccactatactacatcccaggcaacagagcaagaccttgtctcataataaaaatggaaaaaaaaaaatcagaaagtaaaaaagagccctcaggaaaaaataggtctcactaaatcctcagcccaatgcccaaaaataaactgtcttattttgtttgtgctgctataacaacattcctgagactgggtaatttataaagaacagaaatttattttctcttagtactagaggctgaggcatccaagatcaaggcactggcaggtttggtatctggtgagggctgcaaaaaaggacagacttcctccatcaagcccctttttcagtgcatctaatcccattcacaaggggaggagccctcatcacctaagcatctcttaagggccccatctcttaacaccatcaccttggccattaagtttcaacacctgaatgttggaggggaggggacatattcaaaccatagcataaaacccatactgatgaataacgcacaaagagaaaattctacacatttccagaaaacacaacacgcaaaggttgaggtgaggcatctgaacaagttcagatttcccaaaaggaactctggaagatagaagacagtaaaacaatgtgatatggtttggctgtgtccccacccaaatctaatgttgaattgtagctcccataattcccacgtgttgtgggaggaacctgatgggagataatagaatcatgggggctctcccccccatactgttctcatggtagtgaataagtctcacgagatctgatggttttataaggcgtttcccctttcatgtggctctcattctctcttgccagctgtcatgtaatacatgcttttcgccttctgccatgattgtgaggcctccccagccatgtggaactgtgagtccattaaacctttttttctttgtaaattatccagtctcaggttatgtctttatgagcaatgtgagaacagactaatacacaatgctttcaaaattatctccaacctagtattctatgggccagtcaagttgcaaatcaagtatgagtgaagaatcatacttcaggcttgcaagttctcaaaagctttacctcccacatacccttttcttgggaagctagtggatagaggatgtactccaccaaaaggatgggaaaatatttgagaaaggagatctacacagagagaggcagaggtctacaggatgttggtaaagggagactgttagctgtgaaacagctcagacaactttgggtggggtttttttctagaacatgaagtttatcagatacctgatgtgaatcaacatactgaaagacgtagggataagctggagaattggggttgaatagtgatagatattactggtctcagaaaagaaagcaagtaatgcaagatgaaaaaacaaacaaaaaaacaagacaaaactcaaaagaacaacccctcaccccaaaaaatgtctagcaaataaaaagtaatagtggtttaccacacaccttcattcttttttttttttttttttacctttttctttaagcagtagagacaatgtctcactgtgttgccagggctggtttttatttatttatttatttatttttgccccattgcaatcagtgtgcacaggcttctttctttctttatttttttgagatggagtcttgctccgtcacccaggctggagtgcagtggtgcaatcttggctcattgcaacctctggctccatggttcaagtgcttctcttgcctcagcctcctgagtagctgggattacaggcacacagctccatgcctggctaatttttgtaattttagtagagatggggttttaccatgttggccaggctggtctcgaactcctgacctcaagtggtcctcctgcctccgcctcccaaagtgctgagattacaggcaggatacactgccctggcctacaggcttctttatataggtcatcagcctgtattcacatttccatccatttctaatgtaattacattaacattactttagcatatgactttgccttttccagaactctaattaagattttaaataagatgtatgccactgggaatctctcattcacgcttgttaaacacctttcctgtttgattataatttcacttgctaattatttctgactttggttttccaaacttttcctttttatgacttaaacacagtttgaactggtgcagcaaatcacttacaatccaggtgtaagatagattggcaaactaaatagaaaagaagacagtcattgggtggaaaacagtgaccaagtttacctcagtcaatctgtttattaaaagaactcataggccaggcaaggtagctcacttctgtaatcccagcactttgggaggccgaggcggcggatcacaaggtcgggagatcgagactatcctggttaacacggtgaaaccctgtctctactaaaaatacaaaaaaattagccaggtgtggtggtagacgcctgtagtcccagctacttgggaggctgaggcaggagaatggcgtaaacccgggaggcagagtttgcagtgagctgagatccagccagtgcaccccagcctgggtgactgagcgacactccgtctcaaaaaaaaaaaaaaaaaaaacagaactcatactgctgagcatggttgcatatgcctgtaatcccagctacacaagaggctgaagtagaaggatcacttgaacccaggagattagcctgggcaacatagcaagaccccatctcaaaaatataaatatgtaaaaataaataaaaggacttgtactttttaataagcactcaccatgtgctaggttctgattgctttatctacttctatgccataaacttttttcaaatttattttgcatatttttagatgcctgctatacactgatccttgtgataagagcagccaaggttccttgagcactcaccatgtgctagggtctaattgcattatgaactgtttgtcatttaaatattgcagcaagcccatgaagcaagtagtaatattacccccaattttcagataagaaaaatgaggcatagagaatgtgaaaataaataaaatttaaaagctcttggaaccccagagaacacattaagtcttgagagatgtgactgtgatctcagccatggagcatggagttgtaatttctgctccttagattatagattaactctcttcttcagtgttcttcttctgtaaattatgaggagagacaagagaccagacctccttctaatcactgatctttgtgatagattaactgcctccttttttgtacctgtattagtctgttttcacccattataaagaattgcccaagactgggtaatttataaagaaaagaggtttaattgactcacagttccacatggctggggaggcctcaggaaacttataatcatggtagaagagaagcaggcacatcttacatggtggcagacgagagagagagagagagagagagtgtatgaaagggaaagagccccttataaaaccatcagatctcatgagaactcactcactatcacaagaacatcattggggaaactgcccccatgatccaatcacttcccactagtttcctcccttgatacatggggattatggggattataattcactatgagatttgggtggggacacagaaccaaaccctatcagtacctaactcagttaaggtagcactaattacctcccaaattttatatcttcagtgtggaatgttaaatagacctttcctgaaaagaaaaatattaccttgtctaattggattactgtaactatacattcagccatatacagaaaaatattgaaattctgttaagctttctaaaccttatctatgttaagtgacctcaaacttctacacttcaaagtgctgacttccattctttggaatctgtctcccaggccatcttcaaactttgtacttgaataaactctcttcaaaattcaaaataaactctcttcaagtcaaactagattctgacgcttatttcaagttgacattttggcaaccatgaaaggacctaaagcaagcctctgttgattccccactgcattgcccacagttaggatcctggtaccagcatgaacagttttcattcacttggcttcactggagccagcagagggtctccggtgaagaccctctcaggttttgaatctccctgatttgggttgagaatcagactttactcaagtgacccaattccacacttgatggagctggaattgaagctctactttaaggtaagagtttttgtctgttctctagatattcttctgttcacagatttgtggttttcacttttctctaaggttaagtgttatttgtaactgctcattaacatttgtacagctttttctctcatttgaattttggtcagggaaagaaagtttctctctctgaaaagaggaagtgaatgtggcttaagcaaaatttgcataaaagaaaaaaacctggctaaactctgaagcttggttcatttgacatatctaaagttgttttgtttgtttctgagtgaccaaaaagaaaaactttctatgaggatggccaggtgcggtggctcatgcctgtaaacccagctcttttggagccctaggcaggcagatcacttgaggccaggcattcaagaacagcctggtcaacatgatgaaactctgtctttaccaaaaaatacaaaatattagccgggtgtggtgacatgtgcctgtaatcccagctactcaagaggctgaggcaggagaatcacttgaatttgggaaacagaggttgcagtgagccaagatcataccattgcactccagcctgggtgacaaagtgagactccgccaaaaaaaaaaaaaaaaaaaagaaagaaagaaagaaagaaggaaggaaggaaaaaaaagaaaagaaaagaaagaaagagagaaagaaagaaagaaggaaagaaagaaagaaagaaagagaaagaaagaaaaagaaagaaagagagaaaagctttctatgaggatgaagataagtaccaaagataagggacactgtttctcctggccaaaaggcatcttaggctaataaggtcttgcgggagtgtctgaactcattactcttaacatgcaatagtactgtagggagttctcaaagaagaacacacaggaaatcttgcttaacctggtgggcacatatgaagggctgatcttctagtgccttaagtgcccaggattcctggctttcaccaagacagggaagaagagagaagtgattcactggtgtcacctcaaggaataatccccattaagcaacataccagatcaaaaacatctttcccatttcatctttgatcacttaaaaagagaatccaaattatgggcaatcatccatctaaaactgagtcttcctttttaaggagagatccacctttagaaattccagctggattcctgtataatattgtggtgcaacctccagtcaatatctagaaaagttgtctttcttaacccatgaagaccccaaacaacaatgaccaaagtgggctatctttgaaatacctaaattagcttatttatgtgcacaattagaaaaagctatttctaaaattaaagaaaataattgggagagttacttctaacagtacttagaagcatctgaaaagcgctctgacaaagttcttcctctacaggaagaaaattaaaag

SEQ ID NO: 511 - DNA, 18146 bp, Homo sapiens
atatgcctggaagttccttcttacaaggtctatacatgtgaagcacacagaatgactccccttctcaggagacaaaagtcaagatggaggagttcatccttctgttggctcaggccccaaaccttgaggtcatgcttgactcctctctttctcccacagcccacatccagtctctcagcaaatcctgttggcttcactttcaaaagagatccagaatctgaccactcctggacaccttctttgccacccacccccggcccaggtggctagcaacgccaatctagatttccccaacagcctctcccgtggtgtctctcttgccctctccatcctgccagagggatcctttcaaaatccaagtcagatctgatcacttctccattcagaaccctctgagccccccatctcgcttagaggaagggccacagtccttgccatggcctcctggtctatgtcatctgcctccaaactctggcctcattgctgttccttaaatgctccagacactctgcctcacagccttggtcttggctgttcctgctgcctggaatgctcttcctccaatataaaaatgctctgcttctttaccttctccagggctcagctcaagtaccagagtccttgaccatctcaccccaccccacaccgccccctggggctccttgaccactggatcttcctgcattttctcgctctgcacttatcactatctgacattaaatatatttacttgtgaaattagttggacgtggtggtgcacctgtaatcccagctactcgggaggctgaggcaggagaatcatttgaacctgggaggtggaggttgcagtgagccaagattgcgccactgcacactccagcctgggcgacagagcaagactgtggaaaagaaaagaggagaggagaggaggggaggggaggggagaggcgagcgggagagaaaaagaaaagaaggaaagatgttgggaacaagccccccaaaatttggccataaactggccccaaaactggccataaacaaaatctctgcagcactgtgacatgttcatgatggccataacgcccacactggaaggctgtgggtttaccagaatgagagcaaggaacacctggccccgcccagggcggaaaaccgcttaaaggcattcttaagccacaaacaatagcatgagtgatctgtgccttaaggacatgctcctgctgcagttaactagcccaacctattcctttaattcagcccatcccttcgtttcccataagggatacttttagttaatttaatatctatagaaacaatgctaatgactggcttgctgttaataaatacgtgggtaaatctctgttcggggctctcagctctgaaggctgtgagacccctggtttctcacttcacacctctatatttctgtgtgtgtgtctttaattcctctagcaccgctgggttagggtctccccgaccgagctggtctcggcagaaagagagaacgaacgaaagaaagaaagagaaaagacttacatgttagacctaaaaccataaaaactctagaagaaaacctaggcaataccattcaggacataggcatgggcaaggacttgatgtctaaaacaccaaaagcaatggcaacaagagccaaaattgacaaatgggatctaattaaactaaagagcttctgtacagcaaaagaaaccaccatcaaagtgaacaggcaacctacagaatgggagaaagtttttgcaacctactcatctgacaaagggctaatatccagaatctacaatgaactcaaacaaatttacaagaaaaagcaaacaaccctatcaaaaagtgggcgaaggatatgaacagacagttctcaaaagaagacaattatgcagccaaaaaaaacacatgaaaaaatgctcatcatcactggccatcagagaaatgcaaatcaaaaccacaatgagataccatctcacaccagttagaatggcgatcattaaaaagtcaagaaacaacaggtgctggagaggatgtggagaagtaagaacacttttacactgttggtgggactgtaaactagttcaaccattgtggaagtcagtgtggtgattcctcagggatctagaactagaaataccatttggcccagccatcccattactggatatatacccaaaggattataaatcatgctgctataaagacacatgcacacgtatgtttattgcggcactattcacaatagcaaaggcttggaaccaacccaaatgtccaacaatgatagactgtattaagaaaatgtggcacatatacaccatggaatactacgcagccataaaaaatgatgagttcatgtcctttgtagggacatagatgaagctggaagccatcattctcagcaaactatcgcaaggacaaaaaaaaccaaacaccgcatgttctcactcataggtgagaattgaacaatgagaacacgtggacacaggaaggggaacatcacacaccggtgactgttgtagggtgggggatgggggagggatagcattaggagatatacctaatgctaaatgacaagttaatgggtgcagcacaccaacatggcaaatgtatacatatgtaacaaacctgcacgttgtgcatgtgtatcttaaaacttaaagtataataataataaaaaaaattttttaaaaagaaagagagaaagagagaaggaaggaaggaaaggagaagaaagaaggggaaggaagaaggaaaggagaggaagggaggggtggggatgggagggaaaggaagggaaaggaagaagggagggagggaggaaggaaggaaggaaggaaaggaaagagagagaggaaggaaggaaggaaggaaggaagaaagaaaaagaaatttacttgtggatttgcttattgcttatggcccaaatctcccctagccagtgtttctcaaccttggagttactggtattcaggcctcggtaattacttgttgtagggactgcgtggtgcattgcaaggtgtttagcagtgttcctggctcctatgtagatgccagtggcatccctccagttggaccatccaaaatgtctccagacattgccaaatgtcatgttccctggaagcagcatcacccccaggggagaacttctgcccttggagactgtgagctccatgagagcagggttgttatttggttccctgctctatccccaagcctagaaagctcctgactcattcacgatgcctcgtgaatgagcttcaaagaagtgatgaacctggctcagggagatgcagtggggagctgggattcttcctgcagccaaagctcacttgtccccaacactcactggccttccacatgaagtcagaccacctctggcaatcggcaggcctttttgcagatggggaaactgaggtacaaggagtttcaaagagtgtcggtggcaggaatgggactagagccaaggtctccttattcttattccagttctctttttgctgtagcaccctcaggcatcatttgagcaaagttctgagagttaggcctcaagtcaaaaaccaaagacagggcagggcacagtggctcacgcctgtaatcccagcactttgggaggccaaggtgggccgatcacatgaggcccggagttcgagaccagcctggccaatatggtggaacctcgtctctattaaaaatacaaaaattagcccggcgtgttggcgggtacctgtggtcccagctactcgggagactgaagcacaagaatcgcttgaacctggaggcggaggctgcagtgagccgagatcaccccctgcagtccagcctgggtaacagagactccatctcgaaaaaacaaaaacaagatgggaggaaggcataccaggaagaaggcacagcctgggcaagactactgaggtggcagagctcaagatgggtttggagaatacaaaggactccaccaggctgaagtgagggacattgttagggacagtaaggagtggagaaaaggagtaggggcctgtcttgaaaggtgttgaagttgtccctaaaagtccggggctcccttctggaggccatggggaagagaggcatgatgagagatctctgtggcttgtgtgtggtgggtggagggggcttggaggccagggaccagttaggaggctgttgcaatagtctgggaaaggggagggagctggctggagagcccggcggcagggcgggccgggctgggggaggcagcctccagaggctccttaggggcagtcctgagcctggtccaagggtgtggtgagcccagtcatgagtcgggcaatggccagtactagggcgtctaaggggacggatggctgcaggccgtctgacaagtgggtggatgggatcagaggtcaggagtccagcctctgtgggggtgaggggttggggggcaagcaggcaaagcaggagaagaaaggtcaaaggccaaattccagatgtcttggctgggcctacttgcaagtggaaggaggcctgagccagcatgagggatggagaaggcaggaaggggcacctctggcctctgtgaggctaagcgtctggtggattgggaatgagacttggagaggtatctggttgctcagttcgggagggtgcccagcactcagcagcctccccaaggttgtgtgaggtaaggttgaggctgcccaagaactgttttatctagtgaggctggaggatgtagcgggcatagcatcagggatctgggtttaaggggctggagaggggttggttggggtcttgttcttcctgctagtctttcagcctagcagagagaagatgctaattgatacaataaatgcttggaggatgggtgggtggatatatggatggatggatgcatggatggatggaggcatgcatgagtggatggactgatggacggatggatgaatgcatgcatggataatgaatgagtggggtggctggctgggtggatacatggatgttgatctggggtgggtgtgtgggtggatggatgcatggatgggtgaatgcatgggtgtgtgggtgggtggatacatgagtagatgggtagatggatgaatgcatgtatgcacagatgtatgagtgggtagaaggatgcttgggcagaagatggatggatgggtggatggatggatggatagatgtatgcatgcatagggctgtatgtggctggacagatgcatgggtgggtggctggacagatgcatgggtgggtggatgagtgggcagaggcatgcatagatgatgcatgggtgcgtggtgggtagatgcatgagtagatgggcaaatggatggatgcatgggtgggtgggtggatggatgcatgcatgcatgtatgaaggcatgggtgggtggatgcatgggtggatagatggatggatgcatgggtgggagagtgaatagatggatggatgcatggatgcatgggtgggtgggaggatgtttacgtggagaataggtggatgggtggttgggtggacgggaggctaaatggaaggatgtagaaatgagtaagtggatggatggatagatgggtaggtgggcaggtgtgtggatgagaagattttgagatgcatgtttggatatagggccacaggcagaagtgggaggtcctgagtcataactagcagccaccatgatgaatgacatgctcagaacagaactccgcggctctgcagaagtgcagcccaggacaggacaacttagactaccactggcagggatcaggtgtgatgcttctcgtggtaccaaacagcctgttttctgctgggttctgaggccaacatgtctccctggctgagggtagggacgatgtaccttccaagctcaggaggccaggctcagctcacatcaggggtcaggaggctggggttccctgctctgatcatggcccatatgaggggagctcatctgaagaacagcatgaacacagaggcccatggcctgagaaggagccttgtcttgcagctactgggacaggcaagaagcagatggtggttttggatgccatgtgtgggcctgtgggggtgagggtgagggcggcctgaagaagggctggcccagagagggcccagtggaacagccagggtggggtatcgagtgtgattaggggacgccccccaggcaggcgtcctggacggccttggcacgccaggccgctgagccagcacattgctttgtgtacaaatcacctccttttctccttttcttctgttcccatcccccacctccctccacgcctaaattcttcccaaaccaccccagccttcggactgtcaggaggaagctttgatgtgtggtgggtgggaggccactggtcttgggtgggcgctggggggtccctgccacccaagtccaggcatctaccccaggcaggagttggggagggaagggagcgactgcagcctcctgctcctcccccccaacctgtgtgcttctggatgggagatccctgccggaaggggaggcagtggtgctggggagtgggccgggtgggaggaataggcttggggaagggggacccaggaaaagtgtggtccagaccaggcctagcccctgagggtaaaggatcttgccgaccgaagggggctgagggttgggggtgtatttaccatggtgagaggccatgttcgtgttcctggatgcttgcatgtgtgcatgtgtgtgtgcacgtgcatgtgtgtgtgcatgtgtgtgtgcgtgtgcatgtgtgtgcttgcaaaggcctgggactgctgtgagtgtacagctgggtgatgtgcgtgtgtccccgcgagtccacacctgtgcccacagctgtgagggagcagcatatggctgcccccagattgtccaacctgggcccagctgggaccccacttccctctcgtggcagaagcctgacctgaacatctggccccatctgcccacaagaaagggagtcccagagcacgtgtcagagctagaagggcccaggcctcctgccccagtgtaggagcagcccttctcagggtcacaggttcctcacctgtgcaaggggtgcctgtggagtggacactgtggtccccgtggtgtctgccagaggcctaccacccagggcaaccaactcgtccaggtttgctgaccactttcttggtttcagcactgaaagtcccatgtcctgggacaccctcaacacccctgccaatcccaggaaatcgagatggctggtcccacttgccagggacacttctctttccaccacatccttccccctgctacccctgtccctgcctccccccaccccatctctggaaccttctctgaaggttcttactttcccctttgcttcctgtcttgtgccctcttcctcctgccccttactgtccccagggtctcactccgtctctctctggctgcaggggtctctttctctctgctcccctctcttccctctctgtctctggagtctctgtctctctcctctcctgccctcaggatcgtcccctgcttggtttctggggtctgtctctccattctctgctcactttggtctccccctccaccaccggtgtctccctgtctctgtctcagggtctctggctcgccaccttccctgggtggtccagacctccctcttgtctgctggcaccacactcccacggggctggctggggtggaagccaggtctgggggctgtgaccaggccgggaaggggaacccaagcagacatggtatttatgttaggacttcaaagtggggcagaggccgcagtgggggtggaggggtggagggcggagggtggagggagggagggaggtgctagcagaagccagactaaggtcagcaccggcccctcccagctgagggtctccttggtgacacacacctccctgtgggaccctgagactcggcgtagggacagaatggactatttttgtgcagagttccaagaaaggcacttcctgcacccccgccctgcccccagccccatcctttcttcctgtcaccctgcagctgggtctgggcgctgcaggccccacctcctctgagcatcagcctggcctgggagacaggggttctgagggtggcagaagcacagggctcgatctcagcaggaaaacatccctggcatggggacagcccgtgcgttcccggctctctggcagaggcctcgcctggcagggctgtgcggggctgtaacccagttggccccaacccagccaggcggacccagccctttggggcctctgagctgtcagcctgagggcctgaggggccaaaatgggccaagagggtcaccacacccctgcccccacccttggcctaacccctgctaaagacacccagctgctaggacctggaaggcgtggggtcaggggccctggccctgggtggggtgggtgggaagggccgattgtctcatcctgcggctcagctgagccccgagcccctcccaggggctgcgtccagcaggcacccttcaggctgggccaccccctcaggaagtcctctgcccccagactcaaggctcgctctggacccaggaccctctggtccaaagcccattcaggccccaaatgccccagcccctgggccagtgtctcctccagggtcctccccaggctcttcctgtgaatcactcaggctggaatctgatgagctcaggcctccccacccagcgttgcctgcctctgcctcctgcctggctagtggggtcaccacacccctcatgggggtcttttccagcaacccacatctcccaccagggtctagcatgggctggggtgggtgagtggtggtgggacaggacagggctggagtgaggagactcgggagagggcttggaccgcttctgtgtgctccaaagtataaaagtctgtgtgtgtctgtgtgtgtgtgtctgtgtgtctatgtgtgtgtgtgtctgtctttgtgtgtctgtgtgtctgtgtgtgtgtctctgtgtgtctatgtgtgtctgtgtgtgtgtgtctctgtgtgtctgtgtgtgtatgtctctgtgagtttctgtgtgtgtctttgtgagtgtgtctctgtgtgtgtttgcacttcaaatgcttggagagtgggaaggggcagccgtgtgctgtgtctcgggagagtgtgcgccgttgcgtctgagtgggggatggagtgtgccggtggcagttctgcacaggtaggtctagtgcatcatgggatcccagtgtaggtggtcaccatgtgtctctgtgtcagcctgtccccatgtgtgtgtccaggagtcacactctgaacccaagaacaagggtgctgaaatatttcagtgtttgcagatccagggatgtctgagtgggtggctggtctgtgtcagggtgtgtctgggaggaggggcgccagtgtgtccctgcaccccatcccgcaggagtgaatggctgacagtgtcagggtgtgcctgttaaccctgggggtgccccagggttgttgcacgtgcccgtggctggcaggatgtgcaccctgtgtgggaatgtgggtcagacagtgtcactgtgtgttaattgtgggtgtgaacatgggttgcaaggccatggcagggtgctagatgctctgtgttgaaggtgtggcagggtagggtgggtctcaatgactgccttctgctgcaaccctttcaggccaccagtaggcccctggttcctagagcacactggcccacagaaccagggatatgcagcccttccctcaccccccattcgcagggtcccagggacccaccactgggtgctttcctcctagcagcaggctgggagcactgagtcccctgggtcctccgcctcagcagaggggaccctgcacgtggccaggaatgaggtgcgctctgccccctggtggcagcaatgaaggatgcgccaccctgcaacccaggaaagcggagggacagtttaggctgcgtctttccgaatcagtcattccacatagattcacaagtgccagttccggcccggccattgttcaaggcccttgagatttaactgcgaacaaggtgggggtggctctggcattctagtgagggaaacagacaataaacttgcatacagaaccaccgtgactttaggagtgataaggtcaatgcttccaagtaaggaaatgacccgactgctctttcatagatccaaacgtcagagttccagtcttgccctgcagcagcggacgctgggccaggcatgtcacctcttggagccttggcttctttttccataaggacaaaggctggggaaggggtggcatggaatccctaggacacagtgagctttcagttaccacccagatcacgccatgcaaatggagagatgtgacctatttccctttggctggagctgggggcgcttggtgcttggtctataacagacacttctgttgttgttgttgttgtttgatttttttttttggagtcttgctctgtcgcccaggctggaatgcagtggtgtgatctcagctcactgcaacctccacctcccaggttcaagcaattctccagtctcagcctcccaagtagctggaactacaggcgtgagccaccttgcccagctaacttctatatttttagtagagatggggtttcaccatgttggctaggctggtcttgaactcctgacctcaggtgatctgcctacctcggcctcccagagtgctaggattacaggcctgagccaccttgcccggcctataacagatgtttgatagatgtgctgagtggacatataaatcagcccctctgctttgaaggactacagaacctggtgtctgagccctttgtcctgtaacaaggcactttccctgagcaagtctgagttttctcatctgtaaaatggggctagtgagactggtcttacactggcctatcattgtctgccttgcctggaggctctgccccaggatcataatcttgttgatgctgatttggcctggacccctgaccaatcagtttcttttttgttttcttttcatttcttttttttttttgagatggagtcttgctctgttgcccagggtggagtgcagtggtgtgatctcgggtcactgcaacctctgcctcccgggttcaagtgattctcttgcctcagcctccccagtagctgggactacaggtgtgtgccacgacgcctggctaatttttgtatttttagtagagacggggtttcaccatgctggccaggctggtcttgaactcctgacctcaggtgatccaccggcctcggcctcccaaagtgttgggattacaggcgtgagccaccaggcccagcccagagtttcttgagaagaaaaaccacaagacccaggcagcagctccctgtggtgccccatcactggggagggcagggagggggtcaggtcatgctgagcctggcaagggtgggaagggcttgtagaggccccagagcctcattcccatgaggccagttgtacatccggcccctgggatcctccgagcaccctctacaaacattccaggtccttcctctgggactgagcttgacacatcccgtgtttgattcccagaaccgagtcctcccttatactccccaggtttctgcctcactgtccctcactcctggttatcaaactccaatcagtgaacaacatttattgaacacctatggcatttgtgctcagcattggactgtgtgaggcactaggggtgagtggtgaaacagggaggggaatagaagagccaacgggacacttcctatcagcgagaaccttgggagggcgtggaagtggggagggaagagctgctggtggcctagtgacaaaaaaaatgggagccgtgcaactgggctgtatctggactgctcatctgaaagtcaatgtctggctgggtgtggtagctcacgcctgtaatcccagtactttgggaggccaaggcgggcggatcacctgaggtcgggagtttgagaccagcctggccaacatggggaaaccccgtctctactagtaacacaaaaattagccaggtgtggtggtgcacacctgtagtcccagctactcgggaggctgaggcaggagaatcacttgaactgggaggcgaaggttgctgtgagccgagatggcaccactgcactttagccagagcgacagagcaaaactccatctcaaacaaacaaacaaacaaaaaaacccaaaaagccaatgtccacgatttctacctcccagttgtcatgtctgacatttgggctgacgtcccctctgtgctcagtgcccgaggagagagcctctggggtcatcctccataaggggacaattccttccttcctggggatggcccccaagaggctggccttacccagaccccagaatctaagggacctgggggccagtggccttggcccctgcgctgtccccaggttgcctgatgctgctggactgcaaggcccgggaccccctctgctgctgcagccttggaggcgccctcacccctgggtggtcaccctctcggcagattcccgggccgtgcacaccccctcgtggttggtggtcggcacttttccttgtttggatttgctgcctgctctgggcttccttgggggctgccccggcctttgtgggtggcttagaatggagggtggagttggaacctgatgccctggtttgggcgggggaacccttaaggacttgctatatgacatcctgggagtcactttcctgaccctcagtgggcccaacaagtcatggccaagtaaagcttttgtgagggccaagagtttagtgcagagagcatggtttctgagccccctctccattctggaagcttatctgccagctggtggatctccccagagatgctggagggcctgggaggactccaaatcttggggagagactgtaacttgggtactttctccccagggcctgatttccaggggaataacctccctgaactgggcatcagcaggtgggagccctgtctggcagagagcggactccgggagagagttagcagcccagctctctccctccctttctgccatgagctctgcttgtagcaaaatcacccattttgatcactgggacacttctgggagccgagcagggcagcaatagtgtccccactttacagatgagagtactgaggcttgcaggtgcaggtccttctggtgtccaggacaggggtgggccccaagcctttgctgctgttctgtggcctctctaaatcctcctgacacctaagagccattggaaccttttagggtctggaagtcccagcctggtgggagatacttgggtggagccctgcctcagccatgcccatgaggggaagggtaaaaggagctgagaccgtcaccctccccacgtcagaggttgggcatctgtcggattcgcccccacttggcacaccctcattgcaggctggctcaccctcagctgggggagaagaacaagaggcaaggggccttgggcacacagtctgggggcccccgaagccccctcatctttattccagttcctcagatgtggcagttcccccagcttccctggaaacaagtatcagacaaaggtggtggcagacacaggacagggccctgggtggggcttgctggcgctaaaaggatttctcagcaggctcagggtctcccgccccgaatgacccttctggccacttcaagctactcctctgctgcccggcttccctctgcctctggttcccctggctgagcagggccttcctgggcttgaccctggcccccttcagcagttgtctcagactgttcccgaatgtccctggggctggctttgaccccagcatccccatctccctggcacccttgctcctcccctctgcttcttgcctctgactgcccactgccctcctcctctgtcacagccccctgggtctcaggccactccgcccggcggtagacgaggtagccagtggtgggcagcctgtgggccagggccccagggggcaggcggtggtagccctgctccttgtacaggaagaggccaaaagtgttgggctgggtcactcggaacttggtggcacagagctggttcagggtggcaatcgaggcttctgggggcacggccagggtcttggaggtgcagccactgctgggatcctgataggctactcggaggaggtgctatgcaggaggagaagcaaaaacaagtactcagccccggctggcatgcatctggctccaaagctgagacatcagctttctgggctgtgcagggacagggtgggtaggtggagatccagtgggagaaccaagcggcaaaagctctatgtgctccaggggtcggcttgtgggccacagccgcaggtgcaaggacagcccagtggggcgctcacaagcctgagatgaagatttgatagtgagtaatttgtgccccaagcactctcctgcattaactcatttaatcttcacctcaaccccaggaggtaggtcctattaccccattttactgatgagaaaactgaggcacgaagtagttaagtaactcgcccaagtccccacaacccagtggcagagccaggattagaacccaggatctgtctacagagtctggactcttcaccaaggacaggaaggtgaaaggcggggatggcgtctggctctgaggacacggtggagggcctgttacctggaagcagtgggtggcaggcaggcggcgctgctcccagaggctgagggagcgccgtagctcctgcacggggctcagtgggagggtgtgggcctgacccaggccactcagcagggccaggctggcagagaggctggtcaggtagtagccacctgggacacagggtggaagaacacggctcaggctgggtgtggggcaccccatcccctctccccttccctgcttattcagggcccacccagacagggaggtgggtgggggtccctcaccctctccagtaagcaggctgggctccagcagctccgacatgtactcggcctccagcagcagctcaggaaggtcacagtgggccaagacgaggctcagcagaggcaggaactcgtcggcacccgcgccctcccctgtggggacatggtgagaggaagaagcttcaggtacagtccttgctttaggcagtgacccctccccatgccctagcaaccattgaggggcttcagaaaggatgcgctcctctctaggcctcagtttcgccatctgcaagaggggagggtgggctcattctctcctgcagggctgttctagggtcctggggacctgccgctggggggcccgcctctgactcaaaggggcagggcagggtgaggtggtggcagggacataccttcctgggtcctcagggccatgtagagcagcttgcaggcctgcaggagccgcttgacctgggcgctgggtgagtaggtgcggagcagctgcagcagcttctggcgcacttgctccaactctactggggagggcaggctcaggtgggacccgaaggctccggggccctgggcccgggccaggcggaggccctcagctaggcggcccagggagccgtctgcggcaagccggcgccgcaggcgggctgccaggatgggccggagaggcttgagcacagagcaatgcaatgacttctccaggacatgttctgccggagggacagggaggggtcaggggaagactgggggtatggggggcagaggcaaggggagaagggagcaggggtagaatcggggaggagaggcaaggaaagcaggaggaggtagcctgggtgagacggaagagttgggggagagaggggatggaactctctcgaacagtggtaagacaagatggatttgtaaagcagcagaacagaatcagacaggctggcgctgtggaggggagcagagggtcggatggggcagtgctggagctatggagagacggagcctcacccagcctcttaggcgacagcagcttctcagggcccagctccgcactcagcatggcccgggcccggctcagcgcctgacggatgccctgcagctcctggggctcgggcccagcccgcacctgggtcagtaggtcctgcaccagctggcccgcggctgtgtgtcggtcctgcatcagtgctgccgcagcccggcccacctgccgctccggtgccagtagggagcagaaggcggcgctcatggaccgaagcagaggtcgtcggcggcccaggtggggtgaggtcgctgggctcccccgggaccctggcaccccctcctcctcggagctgctgggggagccgcagtccacctcttggagggagggcataggcggaaggctagggccactgcctgctggcacgcggtaccccactgagctctccctccgtagcagctggcaagggggcagccgctctgtctggctggggactgcccctggcagcacggggacggggggaggtggcacggcaggtggagacagggggctggaggtctctgtggacacgcgcactttgaagcttctcttgaatttctcccgcttggtgggccctaggtcccccgggaacagggggttgaagaagcacaaggcggctccggtgccctggtccagctcttgaggggaccgggccttcagctggggcaacactgggcctccagccgggccccgctgagccttgatgttgagggaggagctccagaactctagggaacaagaaaccgactggggcctccgggactggttaggggaagtttcccaaccaaggcaaggcaggggcttcgggcggtgtgctgcgagccttgccttcccctcggcctcagcttgttcatctgtgcaatgggtggcaggaagcccttaccaatgcccagatgggagatggcctccagctctttgtgagtggctgcgtggtggatggctctggggagctgcagcgggaggagaaggatgtccctgaggccagagaggggagcagaagggagtgagggccgaagagggcgggaaggatgggctgtcccaaggagcagggcccgtggacaccaggcaccctgcgggcagactcaccgggtgtggcagtaggcacagatgagctggactaggtctgggaacatgagctccgagccctccaaggagacgcctgagagaggagggaagtgaggtgcttctctggggaacctccctgcttccagccccttcccgccaggccagcccctcaccgccagggctctccaggatgtagtggctggagacgaaggaggggccactggcttcaggcaaccgcatgcacagggcctggcactggcgggtgttagatttccgcacgaggaacgtctgcaagtggatagggctcaggcagctcaggaccttggcgtcccatccctctccctcccacccctggctggccagtccctggagtgtggggcaagactcacccccgggggctcggtcctcagcatgtgcagtgcggccgctgcgttggcttgcagctgcagccacacgggccgggtgagcagcaggcgctcccgcaggctcacaacgcgccccggccgctgcggcccgcctgcctgcccgccgctggcattgggcacgtcatacagtgggtcctgggctggcctgggggcaggcacccagatctgagcagggagccaggggctgggacccttgctctcctcttccccactcccgggtttcccactttctctatccccggataggccctcctctcgcagcccctccctgccccacctggctgccctgccaacttcactaacttttctctcgccaggtgcccagtagtgaagctggacgggctgggggctccaggagagcccgcgcctgactctccagggctttccatggctgggagctccttcgcttcaggaagagaatccagtcccaaggcaaggcacgcacatccccagtgagtaacacttcctgagggcggtccgcctgtcacacccgccagttaactcttgtgtgtccaccctgcctggccagtgcccgcctcctctgttctggaccctgctttgggggtcaggggtcccctccatgctagccctgctctgagggccccagctgggggatgccacctccacacacggcctcctgcagcctcaccagctactcacattgcacacgtgggcgggaagtggttaagcggcctcagtccccacaggccccagccatgctctgggggcacctttggctctgtggtcagttgctcatctgcccctggcctcaggtcagccttgtgggagagcaccctctactgtcca

SEQ ID NO: 512 - DNA, 18458 bp, Homo sapiens
ccctgcctcatgccatatcctatatcaagatcacttgggaatttatttccagattcttatattaagtacatttaatattatattggcttttattcacacttacctatgagtctgcctgcctgcctgcctgcctgcctgcctgcctgccttccttccttccttcctctgtttgttactttgtcttttttttttttttaacttcctgacatttcggttgggtgcagtagctcacgcctgtaatcccagcactttgggaggccaaggtaggcggattatgaggtcaggagatcgagatcatcctggcctagagggtgaaaccccgtctctactaaaatacaaaaaaaaaaagaaaatagctgggcatggtggcgcacgcctgtagtcccagctactcgggaggctgaggcaggggaatagcttgaacttgggaggcggaggttgcagtgagctgttgcagtgagccgagatcgcaccactgcactccagcctggcaacagagcaagactccatctcaaaacaaaaaacaaaaaaaaacaaacttcttcttctttctcctttatttctatgctgaggttttgttttgttttgtttaagacaaggtctctgttgtccagcctggagtgcagtggcgtagtcatggctcactgcagcctcgacctcctagactcaggtgatcttcccacccccacctcagcctcccggatagctgggactacaggcacacaccaccacacctggctaatttttgtagatatagggtttcgccatgttgcccaggctgaactcgaactcctgggctcaagtgatcccacccacttcaccctcccaaagtactaggattacaggcatgaatcctagtgctaggattaccgcacccaggctgtatggtagttttgttggaatatacaacctaaataaatattttaagagagaattcaataggtgatggttttgaggcctgacatgtccaacaaggcctttgtttcatcctcccaaatactggctgggtaaaagactctatgttcaaaatacttttcctgagaactgtgaagatactcttccataatcttctggccttcagggttgctgatgagaagtatggggtctgcttcataattcttttgtggaagtgggaaaggagtttccctttagggacttcactgccatcctgcactgtgttttgttttattctttttccctttctgtgcttgccaaagggtacctgggccactgccctgctctgccctccaaaaccaaagcccgagccaaatcttagctcaccagtccctacccagagggatactaaccacttcatttggagatatcttctccccatctgggtctggggatgactgtcttgtgtagccagtctgcgagtatgagtggagatggaaccagagtcttttgattagtttctctgctgtccaccccaccaccattccagtccctcatccattctgctctgagctgggattttctagcatttggttaggaaaactggtcctcacatcttcagagggcccttcttcactcctggtggtggtggtgtttgtatatctgacgctactacctaccttccctagaaattgctcattgtttcttgcccaccaatggcaaccttccccctgctactcatttgcttggtgagtaattattgagtgccccctgtatgccagatggtgtgctaggcaccatggttatagtggtgacccggagagacacagtatctggcctcgtggactttacagctcagcaaaagagggatcttaaaccaataatcactgaaatatatgggcacaagttgggaaaagtgctctgaggaaaagcagatggtgctgagcgctaaggagggcctcctgagcaagtgatggtcttaggtgcatcttagctgaggagaagggaacaggcatgtgaagagtggaaagaacattccatacagtgaaaaggctctgaggcagaatgagtggagagaagaccaggctgtccagaatgtggtgaacgaggggagagaggaggggcaggcagacccttccccatcatatgtcgaggttacccgacctattccatgaaaggcacaaccacaaagagaaagacaagctgggtcctgctggagacaagcctgcacttgccatttttttgttttgttttgtaattttattgaggtacaatctatatgacataaaaatcatccattttaagtgtccaattcattgatttttcataaatgtactgaattgtgcaaccatcactataatccagttttagaacagtttgccaccccagtgagatccttcgtggtgtttttggttaacgtcttcacttgcaacatgcactaatgtgaagtgacctttcccttctaggtcttgcaggtggaacagatgtgcccttttcagaggttgtgaagttagctccaaatcccagactagctgctaccccaagcccgggagcttctcaggtgagagaccatcggaatttgtttgtagcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatggggtgaggcagctctttatagctaaagcagtctccaaagtgggctgtcagctgagggctctctgccaacagcactcccatcagttgggagaataagttcttcattcccgaggtgaatctggatggcacaccatagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtggttcaacatgagaactctggtcatcttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaatttgaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgtctcaaaaaaaaaaaaaaaaagttactaatatgatattttacatttccttttttgcatgaagcttttgaaatttggtgtgcatttaacacttatagttctgggcatgcttcaagtatgcaaaggtatacatggcttgcagctactgtattggatagtgcagctctggatgtgctccacatggtgacaggacagctatagctgccccaaacatcatgtcttcacagctgtattcgaaggcagggatcagaaggtgacattgggcagagagtctctcctcacacacctcttgctcatcagggagaaaaatactggcctatccctcccctatcccacacacgcccaacaggctaccacttggtcatatggtcaattctggttgtaggaaagtctagggtagggtctggctctttcattctatctagaaggaggccagcaaggaggaagataactggggaaagttttagggcagcacagcagcgtctgcctcatctagagtacggagtggccaatcctctgagctgtatgtgcctcatcactctccctggcctgcccatggccgaaatcactgacaactcatggaaccctttaccattggatccaaatgtaacctcaaaagcccacccaacagcaggttgcaagcagtgacagtctatatgattgtcagcgtatgtgacttatatgcagactgaatttgtggactagagttaaacttcttgagagcagggccacatccttcattctctctgtggcacctacagcactgcttgtgctcaaggggaaactcaaagcagtaagaatgttttctcccttagctcagctgaacgttgcagtttctccatgaggagaaatcaaagccccttagctttgttctctgactccttaatgtccaatacaggctaggacaaccttaggcccctcgcctgtgggcctctttataaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggccgaggcggatggatcacatgaggtcaggagttagagaccagcctggccaacatggtgaaaccccatctctactaaaaaagaaaaaaacacaaaaattagctgggtgtggtggtgcacacctgtagtcccagctacttgagaggttcaggcacgagaatcacttgaaaccaggaggtggaagcttcagttaatcaagattgcaccactgcacctccagcctgggtaacagagtgagaccctgtctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgtgtgcttgcctgaagtgcatctgcatttctcaggtaagatggacagccacagggaaaactgcttagggggataaaagaagagtaagaatgtggggttgtgtttctttttggtcttttttctctgttgggctttttgtttatttattttggcttataatgcagcacattgtatatataattttgtagcttctttaaaatttctacattacaaaataaatatttcattcttaaaaatgtatgtgcataccatttttaatgactgtataatattctatctgggtagaccaggcacggtggctcatacctataatcccagcactttgggaggctgaggcgggaggatcacttgaggccaggagctggagaccagcctgggcaaacatgagacctcatctctttaaaaaaaaaaaaaaaaaaaaaaagctggcagccaagatggccaaataggaacagctcgggtctacagctcccagcatgagcaacgcagaagacgggtgatttctgcattttccatctgaggtactgggttcatctcactagggagtgccagacagtgggcacaggacagtgggtgcagtgcaccgtgcgcaagccgaagcagggcgaggcattgcctcactcgagaagtgcaaggggtcagggagttccctttcctagtcaaagaaaggggtgacagatggcacctggaaaatcgggtcactctcaccctaatactgcgcttttccgacaggcttaaaaaacggcgcaccaggagattatatcccgcacctggctcagagggtcctacgcccacggagtcttgctgattgctagcacagcagtctgagatcaaactgcaaggcggcagccaggctgggggaggggcgcctgccattgcccaggcttgcttaggtaaacaaagcagccaggaggctcgaactgggtggagcccaccacagctcaaggaggcctgcctgcctctgtaggctccacctctgggggcagggcacagacaaacaaaaagacagcagtaacctctgcagtgttaaatatccctgtctgacagctttgaagagagcagtggttctcccagcacacctctggagatctgagaatgggcagactgcctcctcaagtgggtccctgacccctgacccccgagcagcctacctgggaggcaccccccagtaggggcagattgacagcccacacggccgggtactcctctgagacaaaacttccagagaaatgatcagacagcagcattcgtggttcacgaaaatctgctgttctgcagccaccactgctgatacccaggcaaacagggtctggagtggaccgctagcaaactccaacagacctgcagctgagggtcctgtctgttagaaggaaaactaacaaacagaaagacatccgcaccaaaaacccatctgtacatcaccatcatcagagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactatgtgaagaatgcagaagcctcaggagccgatgcgatcagctggaagaaagggtatcagtgatggaagatgaaatgaatgaaatgaagtgagaagggaagtttagagaaaaaagaataaaaagaaacaagcaaagcctccaggaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcactaaacatggaaaggaacaacctgtaccagccactgcaaaatcatgccaaattgtaaagaccatcgaggctaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaaacaaatggaaaacaaaaaaaggcaggggttgcaatcctagtctctgataaaacagactttaaaccaacaaagatcaaaagagacaaagaaggccattacataatggtaaagggatcagttcaacaagaagagctaactgtcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatacccagaaattgaactcagctctgcaccaagcggacctaatagacatctacagaactctccaccccaaatcaacagaatatacatttttttcagcaccacaccacacctattccaaaattgaccacatacttggaagtaaagctctcctcagcaaacgtaaaagaacagaaattataacaaactgtctctcagaccacagtgcaatcaaactagaactcaggattaagaaactcactcaaaaccactcagctgcatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagaagaactgaaggaaatacagacacaaaaaaacccttcaaaaaattaatgaattcaggagctggttttttgaaaggatcaacaaaattgatagaccactagcaagactaataaagaagaaaagagagaagaatcaaatagacgcaataaaaaatgataaaggggatatcaccaccgagcccacagaaatacaaactaccatcagagaatactgcaaacacctctacgcaaataaactagaaaatctagaagaaatggataaattcctcgacacatacaccctcccaagactaaaccaggaagaagttgaatctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcagcatcctgataccaaagccgggcagagacagaaacaaaaaagagaattttagaccaatatccttgatgagcattgatgcaaaaaccctcaataaaatactggcaaaccaaatccagcagcacatccaaaagcttatccaccatgatcaagtgggcctcatccctgagatgcaaggctggttcaatatatgcaaatcaataaatgtaatccaacatataaacagaaccaaagacaaaaaccacatgattatctcaatagatgcagaaaaggcctttgacaaaattcaacaatgcttcatgctaaaaactctcaataaattaggtattgatgggacatatctcaaaataataagagctatctatgacaaacccacagccaatatcatactgaatgggcaaaaactagaagcattccccttgaaaactggcacaagacagggatgccctctctcaccactcctattcaacgtagtgttggaagttctggccagggcaattaggcaggagaaggaaataaagggtactcagttaggaaaagaggaagtcaaattgtccctgtttgcagatgacatgattgtatatctagaaaaccccattttctcagcacaaaatctcctaaagctgataagcaacttcagcaaagtctcaggatacaaaatcaatgtacaaaaatcacaagcattcttatacaccaagaagagacagagagccaaatcatgagtgaactcccattcacaattgcttcaaagagaataaaatacttaggaatccaacttacaagggacatgaaggacctcttcaaggagaactacaaaccactgctcaatgaaataaaagaggttacaaacaaatggaagaacattccatgctcatggataggaggaatcaatatcacgaaaatggccatactgcccaaggtaatttatagattcaatgccatccccatcaagctaccaatgactttcttcacagaattggaaaatactactttaaagttcatatggaaccaaaaaagagcccgcatcgccaagtcaatcctaagccaaaagaacaaagctggaggcatcatgctacctgacttcaaactatactacaaggctacagtaatcaaaacagcatggtactggtaccaaaacagagatatagatcaatggaacagaacagagccctcagaaataatgctgcatatctacaactatctgatctttgacaaacctgagaaaaacaagaaatggggaaaggattccctatttaataaatggtgctgggaaaactggctagccatgtgtagaaagctgaaactggatcccttccttacaccttatacaaaaatcaattcaagatggattaaagacttaaatgttagacctaaaaccataaaaaccctagaggaaaacctaggcattaccattcaggacagaggcatgggcaaggacttcatgtctaaaacaccaaaagcaatggcaacagaagccaaaattgacaaatgggatctaattaaactaaagagcttctgcacagcaaacgaaactaccatcagagcgaacaggtaacctacaaaatgggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactaggtatatacccaaaggactataaatcatgctgctataaagacacatgcagacatatgtttattgcggcactattcacaatagcaaagacttggaaccaacccaaatgtctacaatgatagactagattaagaaaatgtggcacatatacaccatggaatactatgcagccataaaaaaggatgatttcatgtcctttgtagggacatggatgaaattggaaatcatcattctctgtaaactatcgcaaggacaaaaaaccaaacaccacatgttctcactcataggtgggaattgaacaatgagaacacatggacacaggaaggggaacatcacactctggggactgttgtggggtggggggagaggggagggatagcattaggagatatacctgatgctaaatgacgagttaatgagtgcagcacaccagcatggcacatgtatacatatgtaactaacctgcacattgtgcacatgtaccctaaaacttaaagtataaaaaaaaaaatctggcaaattttttgccagaactgcaatttactcgaacattttccttgccttagtacagttgcttttagtttttcaattataattaagtcttcttagataaaggatttaaaaaaaaaaaaaaccctttcctattctacatgagaatttgacctttggttaactttctagctctgttttccttgagatctcataaaagtggactatcaacggttttactaggcaacattgcttatgtaaaaatggcctttgcttgggaaactgcatctgaactgagaaaaccataactacctggtgagaagtcttcctcagggcctccttgagtgcagtgactcctcctggtcctgcctcctacctactaagttgttacaggagatacttttgtagggcatatgaggttttgaagccagggtcattcttttgtctgtatgatgtggatctcaactctttttttttttttttcttttttttgagacagagtcttgctctgtcacccaggctggagtgcagtggtgcaatcttggctcactgcaacccccggctcccaggttcaagtgattctcctacctcagcctctcgagtagttgggattacaggcacctgccaccacacccagctaatttttgtatttttagtagagacggggtttcaccaggttggtcaggctggtctcaaactcctggcctcaggtgatccacccgccttggcctcccaaagtgctgggattgcaggcatgagctaccatgcccggccagatctcaactgtttgtgcctgggctgtaacctggttgggaggcaaagagaccctctcctggacagctgtgtgaactgctgtatggactgctacatggtcttccattgagaggagcacctcctgccactgtgtttctccaggctgtcttcccttggctcatggtggtcttataagtctgaatgtttagtggtatcaaagaagacccttggtggacttggcatcctacatttaggattatttccttaggagagcttcaccaaagtagaataactgggtcccatactatgggctccttaatacagatataaagtcaagtctatttcccaaagagttgtatcaccagctttcaccagctgtgcaatgaggcagccatttctaggtactctcaccagaatttttttgaaattttgtagatttgatcataaaaattggtttcttgtcataatttacagttttaaaaaatcttaaactgtaggtttgagaactgctagcatttcctcttttgtgaattgatgctttctttcgcccagaaaaaaagttaaattgcaagtaaacgggatttaaaaattttaaattgcaaagtgcaaccagatgtaagaggcattttccccctctgttctaaactgctttttctgcccttctaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttggaaaacaaaagaaaaccttaaactttatcttgaaagggtctatcttgttacttagaatattgaaccagaatgattagctctgagacatagcctaccaactatactttgaagccaaagaaaaagaactatgtaagcctctaggccaaaagacctagtctcttacaaaggaaagacctggttggcctcaaacttctcaacaaagcaagatagcaatggggcaaccttttcaagaaactcaaagtatgaactgaggatttcatatttcaccaagctgtcctttaagtatcaaggatataggaagaagttttaattacacaagagcccagggactattatactcacaacttcttccttagaattctactaaaagacaagcttcatccaactagatgattggggaaacttgagcaaaaggactggacatgaccattgaatatctttgtagatctgaggccaaatggaagtggggataagggtggaagaaccgtattagtcccttctcacactggtataaagatagtacccagctgggaatggtggctcatgtctgtaatcccagcactttgggaggctgaggcaggaagatcacctgaggtcaggagctcgagaccagactggccaacatggtgaaaccccgtctttactaaaaatacaaaaattagctgggtatggtggtgcacgcctgtaatcccagctacttgggaggctgaggcacgagaattgcttgaacccgggggcagagattgcagtgagccgagattgtgccacttcactccagcctgggcaacagtgagactctgtctcaaaaaaataataaagatagtacccaagactgggtaatttataaagaaaagaggtttaattgactcacagttccacatggctggggaggcctcaggaaacctacaatcgtggcaggaggtgaaggggaagaaaggaccttcttcacatggtggcaagaaagagagagcatggacgcacaagagagcaagcagggaaaactgtcttataaaaccatcagatctcgtgagaactctctatcatgagaacagcttgggggaaaccacccccatgatccagtcacctctcaccaggtctcgccctcaacacctggggattacaattcaagatgagatttgggtggggacagaaagcctaatcacatgaaatagtatcaaactatatatgctttgacaagacagaagtaacaaaacaaaaaagaagggagagaggaagaggaaaatacaaagaactccttgttgcttaggcaatatgtagaagtcaaatagtattatttaaagttgacaaaccaagtatatgaagtgtaagtaaggaaaaagggagatttagagcattaaaggtgtactatactattaatagtatagaatacatagtataattactagaataaaaatgtaaatcatcaatgctcaaagaagcaataataaagattacagtgaaaaacatgcagtaaatgtaccatcatacagtaaatatattaagtccaagcatataagttaaatcagtacatgtgaaaggacttacctattaaaaggaatatcagattggcttacaaaccaatgtcttattgtctgttatttataagagacacatctaaagtaagtgattcaggagaggctaaaaaaaaagagatgggcaaaaatagaccagacaagtaggaccacaaaaggcaaagattacagtatccatatctgaaaaggtagaattcaggaaaaaatagacaagacaatgaaggatacattaaaatgctaaaagccacaattcacaaggaggatatactatttatgagtgttagagcttcagttatctggtttgtcaactttaagtgatattctttggctcctgcctatcccctgtacaacaaagagctctttctactttcctctttctctctccctcctttttcattgtttccgttgtgttacttctgccttgtcaaagcacataacatttgcataacaaattatgcaaggaaaaatgaatagaaaccta

SEQ ID NO: 513 - DNA, 19715 bp, Homo sapiens
atggatattgacagactttgggcacattctaaggtcttgtggatatttatgcagactttgggtaggctctatgtctcgtagatattgacacagacttcaggtacgctctatgtctcgtggatactgacgtagactttgggtacacactatggtcttgtggatatttatgtagactttgggtacgcgctatgtctcgtggatattgacgtagactttgggtacacgctatggtcttgtggatattgacgtagactttgggtacgcgctatgtctcgtggatactgacatagactttgggtacacgctatggtcttgtagatattgacgtagactttgggtacacgctatggtcttgtggatattgacgtagactctgggtacgcgctatgtctcgtggatactgacgcagagttcggctatgctctatcactacccatctttgttgctcgggttgttcaacgacacacagctgccactaggagcctttacagctactcttgggtccctgtgacttgcaccatctttgtgggttcctttgagcacctccttaggctctggcaccacaagatgctcaattcctcctatatactccctgctcggccctacgattcgccatttctcaagggagccctggttccctttgttggagaatagtgttagaaaccaagaaaccaggggccgggcacggtggcttacacctgtaatcccagcacttcaggaggccgaggggggtagaccatgaggtcaggagatcaagactaatcctggctaacacgatgaaaccccatctctacgaaaaatacaaaaaaattagccaggcacagtggcaggcgcctgtagtcccagctactggggaggctgaggcaggagaatggcatgaacccaggaggcggagcttgcagtgagccgagatctcgccactgcactccagcctgggcgacagagcgagactccgtctcaaaaaaaagaaaagaaaagaaactaagataccaagatttgctgtaatcccagcactttgagagtccaaggtgggcagactgcttgagttcaggagttcaagaccagcctgggcaatggcaaaaacccatctctcccaaaaaatatgaaaatcagccaggcatggtggcatgcatctgtagtctcagctactcccaacgctgaggtgggaggactacttgagcctgaaaggcagaggctgcagtgagccaagatcatgccactgcactccagcctggacgacagagtgagacttctcaaaaattaaaaaaattaaagagaccaagatttgggcaatggatgtgtaaactgctaccgggtagtattgtttctaggccgtcccatctggtagagcaaggaaatatttgtttatggttatttttcttatagctaacatgtactgtatttactataatggaaaaaaaacattttccttttgaaacatgcaaatgatccactgtccacagagacttcatatttccacctgggcctgagtgtcctaaaactaagagggctccacattggccatatggagagtgacctgaatctcaggaagtgaaaactgagtctgggtctcttttgttctccttctggaaacatctgtgcaattccagtgatgcagtttctgcacattacagacagtgattgagactagtctctttttgtaacaggttgatagaaaatggctgtcatttccatgcctgcttttccaaacctaagggcctagcattattgtgaactgaattgacacccagagacttcatctgctggggggacaaggaaggaattcagtgacgtctctatttgtcatcagaaactcaaatcgctgcttagcttcggcaggtctctgtctccttgtagtaccctgcacctgtctatatgaaccgtcttgttttgctgacagcaacattgtcttcttagaattaacagcctatgggggaatgttttatgctacaatatttaagtacttcccctccagaccatgcaagccagagaggtggagcacttcacaaggcctgatctgctcacacgggtccacaggttccttccggcacacagctggctggccacaccctctaacagggcccatggttcgacctccccaacagcttctaactcctccttctacagcagtttcttttcttgaagtgttgtgacttttcccaaaatccaacctgtctgtcttcaaagaaagtaacagacaacggccttgttgccctctgtttttctggatcacctgtgctcaagctctattagcatacaccaaaccagctttacattcacgcagtctttccacaaaaaccgattcgctctcgctctccctctccctctccctccccctctccctccccctccctctccctccccctctcctccccctccccctccctctccctccacagtctccctctccctctccctctctctccacggtctccctctgatgccgagcggaggctggactgtactgccgccatctcggctcactgcaacctccctgcctgattctcctgcctcagcctgctgagtgcctgggattgcaggcacgcgccgccacgcctgactggtttttgctggagtgcagtggcgtgatctcggctcgctacaacccccacctcccagccacctgccttggcctcccaaagtgctgagattgcagcctctgcccggccgccacctcgtctgggaagtgaggagcgtctctgcctggccgcccatcgtctgggatgtgaggagcccctctgcccggctgcccagcctgggaagtgaggagcgcctcttcccggccgccatcctgtctgggaagtgacgagcgtctctgaccggccgcccatcgtctgagatgtggggagtgcctctgccccgccgccccgtctgggatgtgaggagtgcctctgtccggccgcgaccccgtctgggaactgaggagtgtctctgcccagccgccaccctgtctgggaggtgaggagcgtctctgcccggccgcccggtctgagaagtgaggagcccctccgcccggcagccgccccctccgggaagtgaggagcgtctccgcccagcagccaccccatccgggaggtggggggcagcccccgcccggccagccgccccgtctgggagggaggtggtggatgcctctgcccggctgccccgtctgggaagtgaggatcttcccggccgccaccccgtctgggaggagtacccaacagctcattgagaatgggccatgatgatgatggtggttttgtcaaatagaaaagggggaaatgtggggaaaagaaagagagatcagattgttactgtgtctgtgtgcaaagaggtagacatgggagactccattttgttctgtactaagaaaaattcttctgccttgggatgctgttaatctataaccttacccccaaccctgtgctctctgaaacatgtgctgtgtccactcagggttaaatggattaagggcggtgcaagatgtactttgttaaacagatgcttgaaggcagcatactcgttaagagtcatcaccactccctaatctcaactacccagggacacaaacacacggaaggccgcagggtcctctgcctaggaaaaccagagacctttgttcacatgtttatctgctgaccttccctccactgttgtcctatgacccagccaaatccccctctccgagaaacacccaagaatgatcaataaatactaaaaaaaaaaaacaaaaaactgattcggctacggtaaagtagtaaacagaatctgcatgaatttttggagaagttagacttcattctaatacattattgctggaatgcaaagacatctgagagagagatcaagtgtcaacatggagggtgagcgcaacagggctggctctggaattacttagcatccggctgagaccccagagcccagcagagctgtgcctgaacgtttggaggcgcatcggccgcacacgccaagtcccaacgggcccccacctcccgcacaatgtagtacaggccacctagcttagcctgcagccacatcccctgatgagaccccacctcccgcagaagtacaggccacttagcttagcctgcagtgagtcctcaatgcagctgctttggctcacccggctgtcggctcagacgccgacccatttcaatcatcaggagaggagaagacacacagggccgccccaaggaccccgtcaccagctcaggccaggtcacagaatgggccggcggtgcagtggtaggtagataaaggccggggagcgtttgtgggagaagacggccagacgactggtcctgggagaagacagtgctaacggcagcactgatgttcaccgaaatcacaatcaggcagggatagggtgtcggttccaagcggacgtgtgtgaacacagaaaccatgggggccgctccttcccacaccactgagactgtccatccaggcgcccgaagacgactcctaaaccacctttgccagacgcaggtccagcaacccatcaagagcacagctcgggcaagcagcgaccgcacgcaccgtgccctcctcaccacacaaccacaggtgatgagcccctgcggagacgccgcgcccctggggagacgccgcaccacatcagtgcacaggaggcatctcacgttttgcggggcttgggagagagggacccatgacgagaggacccccgcccaaccacgtgtcgcgagagcagcatgaagccgcgcgccccctccaggcagagctgctgctaaaatgacaccctgtcggttacggttagcatcacttccatcagcaccacttctagtcagcttccttttgaaaactgcttcagggaagctgctccagaagcccatgcatgtgccctgccacagccgcagcctctttggggacactgctgtcgcgatggtttctgcagagccagcccggggtccccaccgtgcctgcctctccagtcactcagtcctttctcctggaaccgggtcaagtccctctgcgtgtctgaaccgggacaaggccctgcctgcttccatacctgaagctgggccccagggcaccttcccatccacatccgagaccaccttcttaacggccaacggccactcaaccccccacagccaagacttctacctgtcgctttccaagactgaacattttcagcttcgccattaaaaaatacacccagaaggccgggcatagtggctcatgcctgtaatcccagcactttgggaggccgagacgggcggatcacaaggtcaggagatcgagaccatcctggctaacgcagtaaaaccccgtctctactaaaaatataaaaaattagccgggtgtggtggcaggcgcctgtagtcccacctactccggaggcaggagaatggcgtgaacccggtgggtggagcttgcagtgcgccgagattgccccactgcactccagcctgggggatagagcgagactctgtctctaaaaaaaaaaaaaaaaaaaaaaaaatacacccagaaacaggtgtggccacaggtctgcgtgtgctggaacatgagtagaagccactgtcgcgcccaattccccagcacgagacaagctgagacaacctgcagccggtgacctgggagagctgggcacggacctcaggggccaggtgagcacggagctctggctccgaggtcagccgggatctcccaagtcacacagtccacactcgcaacaactctgtctgcttctggtattccaggagctcagctcccaagtggcaaatgaaaggacgctctggcctctgccagcatgctccacggcctcgcggtaacagtggggcgtgcagagaacagccctctcctggttatgcatggacgttatctcctgacctccaggcgcacaatgacaactgaggtcaaaacgcaggcaggaaggagggccccgtcctcagcaggactccgcccctcgctgcccatgtgtccatggaaacagaccactaggtgataaaccttccaccgtcgcgcccccaccctccccatccaaacaccatttccaaagagctgtgctggttccctgactctctaaaggaacgagaactccccctctccagaagctcccacgacaccggaagcacatactaaggactgagtctttgacacgtgaatgttgctgggtctaaggactgagtctttgacacgtgaatgctgctgggtctgctgtcccacacgctgcatctctttcgttaggatacaagtcatcatagtcaaagcactagctggacccagactgactcggaatttataaaacgtggttacgatactgaccaaagctgccggttcttcgtggcagcgcagagcctggagggtgtttaaagtcctcccaaggctactcagatgcatctcctgagggagcctgggacgggatctggttacaggaggaggaaggagggcaggtgtctgtgagttcctcttaatctacaggcaggtccagccccaaggtcaaggctctgagcactactgtccacttcatgaacccgagctcttcacatgtcaaactctggagccttgccatgcagaaccacggtcagaatgccttcatctgatcaaacactgtcaagcacgccactgtccaggcaccaggcacgcaagtggacagaagactggccctgtgagactctcttctccgggctgagagacaatggccaagtctgtaaccagcagggaggatggtgagcagaaggacaaggacacgcagggggatggaaactggggccgccctgctgagacgaggaccatgggggttctgcatagaggagacctggcctggcttgcatctctgcaggtcactccagctgctgcactgtggtgtgatcctgagggccccggggaggcgccaggtctggcaggagagtgcagtgcatggcagtgggcaggggtcaggcactctccaagccacctctacttgctcagtgaaatgtgaggtgagggtgggtggcgggtggcaggacctcctgggagcatggacggggcctgcgtgggagagaggcgtgtgcccacagtgtgtggggtcttctctggcctgggccgcgcagcagcacagcacagctgggtcatgccaagaggacagagcatggcgggtgagggtgtaatggcgccagagcaaggacgagcttcccccagccccaagctcaggtacgggccatgtaccaaagtttctatcagttcgtgcacactgccgcttcagccatggcgcagctgaccacctgcttaggctactgacttttttttacactccaaaccattcacaactcaaatctctcgctaattctgataaatctctcatgaatccaaacagacaagcttttcactgcaattccaaatgccacaggctcagagccaagagctactgaactaagtggattgagatcacccaccgtcagactgagggcgggtgcacgtggctgcagacagcagctgctgagaatgacacgcgactctgatgaaagcgatacagcttagccggtctggctgttcaccgtcctgctgcactctacgacacatctgctgggagaaagcactagaccggggcatcctgcctggctttcagccaagtcagcctgttctcagtgccctcccacatgccagaatatctagacaagcctgaccgatgccagccactactccagaaaatagggtgattttctctgtgcagaacaaaagatgaccaagaaaaaaatcgggtcattccgatcaactcggtacaatctctgaccaactgccattaaaaggctgaaatcctttattgccaaggcagcagaatgaacgtggatcagaatggagaaacagacctatgttcctgcaggcatgtgattttcaacaaaggttcctaaggtattcaatggagaataaaaagccttttcttttttcttttttttgagatgagtcttgctctattgcccaggctggaatgtagcagcacaatcttggctcactgcaacctccgcctcccgggttcaagtgattctcctatctcagcctcccgagtagctgggattacaggcacgccccaccacgcctggctaatttttgtatttttcagtagacatggggtttcaccatgttggccaggctgatctcgaactcctgacctcgagtgatccgcccgactcagcctcccaaagtgctgggattacaggcgtgagccactgtgctcggcctaaaaagcctttccaacagatgctgctgagacaagtgagtatctacatgggggaaacagcctcaacactcacctaatgctgctcttgagaattagtcccgggcagatcacagggctaactgtgaaaccatatcatttttagagaaaaataaaagaaaatctttgttactgaagctaaacaaggtcttcctgtatcacagaccgcaataatcacaaaagaaaaacgtaataaattagattttatcaaaaactcaaagcttctcatcaacaaacacttcggaaggtgaccagccaagccactactgggagggtatttgtaatccacacacctgaaaagaactggtgtccagaatgtcaccttctgcaactcactaacaaaaactacagcccattaaaaatagcagaagacatgaacacacacttcaggaaagacaagctcatgaaaagcactcaacaccagcagtcatgagagaaatgagaattaaaaccacgaggtaccacacatccaccagagcagctaaaaacagaaagactgacgccattggggctggtatgaacagggggcaactggaactccccaacatttccagcacaagtggaaccggccactgcttcgggaagagagctgaccattccttattaaataacacccacacccacacccaccccagggcccagcagctccactccagatatctatttacccaagagaaaccaacacacgcagccactcaaaagattattatggacgtgctcatagcagcttcagtcacagctgcttccaaaggctgtgtcttctgaagaacggaaacagcccaggtgtccaacgaaaaacagaaccacaaactgtgggacagtcatataatggaacacttcagcacgaagcagcaatgaacagaaacatgcaacacgtgggtctgaaaagctgagggaaagaagactggccccacacatctgggtgacttgtttagcagaagctccaggacaggcagatctattacggtgggaaaatcagagcagcgtcacctctgggcggaggggagggtgggcagcggggccgagtgggaagggcacggcaggatcagggtgtgagtcacacggtgcccgcacttgtaaaaatgtgtcccctcactgtgggtcaatgacgcataggaaattaccaccgactacaggcgcccgccaccacgcccggctaattttttgtatttttagtagagacggggtttcacagtgttagccaggatggtctcgatctcttgacctcgtgagccgcccgcctcggcctcccaaagtgctgggattacaggcgtgagccaccgcgcccagcctaagcatagcaaaatcttaatagcaggatctaggaggagtatacaggtgttccccgtaaaattctttcaaaagttagctgtggttgaaaattttcaaaatacaaaggattttttaaacccctacagtgagatactacttcatacctctcagattcacagaaatgtaaaggttggcagagtgtgaaatgggagtgaagcaacaggaacacttgagttccgaggacagagcctgtgccagccgcctctgtgaagcacacgccccacgagcagcaggcacatgtgaggagcacacactccacgagcagatgccagtacacgtgcagagcacacgccccaagagcaggaggctccggggtgggcgcgagaacattcctgtcagcactgttctcaggttaccaaagaaacaagcccgttaacaggagcgaggagaatttcattccacagagactactacacagtagtgagcgtccatggtgcaggaaggagaccctcagaacacagaatcgctcacactgcactgctgacaggggtgtggagaacagaacagggccctaacacggcaccaagttcacagaggagccgattaacactatctctatttctaattctatacaaagaactgtttatattcaaccaatgagtaatcccatgtgaaagcttcaatgttcatgaaactgaagagaccacagacagcagcgcctattttcccacgccgcaactcacccgtctccccaccccgcgcctcgcccgtctccccacgccgcgcctcgcccgtctccccacgccgcgcctcggcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccaccccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccaccccgcgcctcgcccgtctccccaccccgcgcctcgcctgtttcccggtccaacgccttgcctgtttccccaccccccgccttacctgtttcgagtagcccccatagacgacgatgccgccctggggagtgacggacatctggcagcctgatctgggtgtgggccccgtccctgacggggacagcttgctccatgtgaaggtgtccagattaaaggcatacacgtcgttgtagtagatgtaatccctggttagaagaacagcagctgtcagggtccgtaacattgggaaaagccctgacattaaaaactgaactgatttaaattaaaggtaaatttcctactgtttggggaaaaactcaaaccatttttctcctctgctcttacaccaacacaacaatcaacacagaaacgtggccgctttccctgcaacgagccagagacgccagtcaggtctcctcaaactcaatcttgacgcaatctacctggagacagggcaacattttcacctgtttaattcaagtttgaattgatatgaaaggaccacaagcacgtatgagtttgcatttgaaaaccggaaataatgctggcccacagaggcagaggaatttaatctgaaagccatactgcgttttcttacacagttaacacaatcagagacaattccattaggttattaggtgtgcaaccgtaagggcagcagtgaatggcgcctccaaagggatgatcagaacggaggtgtgagcagcctggcagcaagggtggtaaggccccacagtggactggaggggtgagcgaggggactgggcgctccagggaaactgaagaccacagaagccgaccctctgtgcccgaaatcacagcgcggcaaggaggccccgcagccttgccctgctcagtgcctgccggacccagcacgcagactgggctgaacagggaagtggcagctttgctggaggcatggggagactcggaggcgcacccagaaagtcctgtcctaatgtggaactttgacacaattatcgtgaaagcgtaaggggctgctctccagctactcaaaaaggagagccaaactcattttttaaggaaagcatggaagagcaagcagctctagcccaagtctcaagtgcccggttttctcctgtttgttcctgttttgtgtgaagcaggaaaagtcacagggcgtttacccagcaccagctgccacatctggtcttaagataaacagcctgggcacagtggctcacacctgcaatcccagcactttgggagtctcaggcaggtagatcacttgaggcgaggagttcaaaaacagcctggacaatatggtgaaaccttgtctctactaaaaacacaaaaaattagccaagcatgggggcgggtgcctataatcccagctactcaggaggctgaggcacgagaatagtttgaacctacgaggtggaggctacagtgagctgatcacgccactgcactccagcctgggcgatcgagtgagaatctgtctcaaaaaaagaagaaagaaaagataacctgaccttgctgactgcaactcagactgaccacatccttcgcaggacgatggctcttaatatagatagaatctgaggaatgtggaaatgtggaagcgtgtaatctttaaaagactgctacagaccactgtttttttcagatttcacgtcgcagatttttagtacaaagattctactttgcacgtaagataaatacagaatattttctctataaatgcagaatagagtttaaggaaaactcccaagttggtatttgaataattttaaacaagataacaacagctttgaaaaaagttctgattttaaaatggttgcaagttaaaacaaacatgaagcatgatttgatttataacctgtaagttcaaaggaggaaggggctgtacaatctcactgtcctacacatagtaggtaatgaattaatgctctgacaaacttatgtgtgcattctgacaattatttgttttaaaataaattttaagaatgaacataaggctaggcgcgggggctcaagcctataatcacagcactttgggaggccgaggcatgtggatcatgaggtcaggagttcgagaccagcctggcgaacatagtgaaaccccgtctctactaaaaatacaaaaattagctgggcatgcggctcacttcaacatccgcctccccagttcaagcgattctcttgtatcagcctcccgagtgcctgggattaaaggtgtgcaccaccacacctggctaattttttgtattttttagtagagatgagtttttgccatgttggccaggctggtctcaaacttctggcctcaagtgatccacccacctcagcctcccaaagtgctgagattacacatgtgagccactgtacccagccttaaatactttttagtttgaattacatttttaaatctttcccccttgaaaagtatttaagaatttggatcccttttccccccgaattcacaaaattaatgagactatatcagtgaagaaaatctgaaacccggctgggcgcggtggcttacgcctgtaatcccagcactctgggaggctgtacagacttatcacgatggatcaagaatcacgagagggtgcgactggactcaccatgtgacaaaggtgtgagtggcaccttcacatcaatcaattgccatgctggttcctgagggaccagtagagaaagagggcttcaaatgaggccccggagatacagacagccactgtctctgacaccacgatgccagcagagagccttcaaagatgaccttcaccagggttgcagagtctgcgacacttcactcagaacacaactgcacttatgacagaaacagggataaccagctcccctgtgtcttgcttttctggactgaactaagtaagctcaagaagataacgtgagcagataacaggcctaaaacaatgagagagcccgcagctcaccctgggcagccatgccagctgcacgaacacccacgtgacatcaaaagagaaccgcaggcctcttccggcatcgctgtggagagtgtgctatcactgctctcccggacaggagtgttttgaagtgattacagacccgtggctctcaaagtgaagtcccctggccagcaacgtcaacatcacctgggagcttgttaaaatgcagattcctgggcctcactccaggcctctgactcagagctgcgatcagcactctaaccagccctctagggtattctgaaccaggctaaggtttgagaatcccattttatttttttatttatttattttttcaaacgaagtctcgctttgtcacccaggctggagttcagtggcatgatctcaactcactgcaacctccatctcctgggttcaagcgattctcctgcctcagcctcctgagtagctgagattacaggcacctgccaccacgcctggccaatttttgtatttttagtagagacagcgtttcactatgttggccacgctggtttcgaactcttgagctcaagtgatccacccgcctcagcctcccaaagtgctgggattataggcgtgaggcaccatgcccagccaaaaccccattttagatagaactagccacatcatttgcaggacctggtgtaaaattaaaatgtggggtcccttgttcaacaatggttaagaatttcaataggaatacagcatgaagccagtgtgaggcccggtgtgaggccctttggagggcaaggccctgtgtggctgcccaaagctcatgaagctggatttgggaggatgggtgcgtctttcttgtgtattcagaatgctctttctataaaaagcccactccttaatgcttcaggagagaaagatttttccgttcttggtaccaaccgtgtactttcatggaagccaccaaacaggatcaattgtctcttccaggccaccatccgatgtccactccgacccgaaggaccgcctgttgatctaaaatgaaataaacaaaaagacactatcaacctgcttaatttctggttgttctaaagacgacaacaacaaacaaaatccaatttttacactgatttctgttttgtgagcacttactgctcacaaattaaataccatttaatctgatctatcaactaccaaaaccatcctgctaagagcccagctagctaagctcaaacctcaagaataaaacaggagaacatctccaagaccttggactgcataaagatttcctaggtagaacattataaactggactccgccaacataaaaaacttcaaaaatacaccattagaaaataaaaagacaagcaacagacagagaaatatcttgaaacacatgactgacaaatgacttgtatccagaatacatacagaattctttttttttttttttttttttttttttttttttttgagatggactctccctctgtctcccatgctggagttcagtggccagatctcggctcactgcaaccttcgcctccaaagttcaagcggttctcctgcctcagcctcctgagtagctggaattacaagcgtgcaccaccacacctggctgattttttgtatttctagtacagatggggtttcaccatgttggccaggctggtctcgaactcctgacctcaaacctcaagtgatctgcctgactcagactcccaaagtgctgagattacaggcatgagccactgtgcccggcccagaattctatcttaatagtaagataaatgacccaataaaaatataggcaaaagatttgatcagaaagttcgtaagatagaaaaatggggggaaaaaagatggaaaaaggccaatgaaaaaaggaaagatgcccaacatcacgagcggtcagggaaacatatgccaagtccacagtgacttcctaccacacatggctgggcacccgagatcaagacaacatcaagtgctggcgaggacatggggctgctggagccatggcaccggtgaaaacgtaacacagtgaaacaacggtgaaacataaacttagcgcacagcttagcaatctgacataagacatggactcaagagaaaggaaaacaccagtccacacagacggacatgcacaagtttatacacgctcttgtgtcaccaccagcagccgagctgtccctcagtgggtgaatgaacagcatgtggtgctccccacatgggggaggacttctcagaaacaaaaaggaattgtttactgatgcacacagcaatgtgaatgaatcttaaaaacatctcgctgaaggaaggcaggttctgctggactccatgcacacgagcgtcttaaaggtgagatccgtcttcggcccaggatagctgctcggggcaggagctgggaggggaccaactacagctctctggggtgacaagggcctacatcttgtctgtggtgctaattacataagtgtgcatatttcttttttttttttttttttgagacagcgtttcattcttgcccaggccggagtgcagtggtgcaatctcggctccctgcaacctccgcctccagggttcaagtgaatctcctgtctcagcctcccaagtacctgggattacaggtgcctgccaccacgaccagctaatttttgtatttttagtagagatggggtttcatcatattggtcaggctggtctcgaactcctgacctcaggtgatttgcctgcctcggcctcccaaagtgctgggattacaggcatgagccaccgcctctggtcaggtgtgtatatttcttaacactcatctaagtgtacatctaaaaggcatgcattttattgaattttattgtaattatgtctcaataaaactgatataaaaatacatggcaataaaaaaatacaaaaagcaaatttaaaaccttaaaaatacacacaaataatacaatcacacacaaataacacataaataactacaatcaacctccctagtaatcaaagaatttcaaataaagcagagataccattttattctatcaacttgacaaagatgtttaagaattagattctttaaaatactgcatgtcacgggacaatgctcgaaaaacagcacgtgaaaaggcaggtccaaagcaaatcctatcccagcttctacaggtaaaaaggcaggtgcaaagcaaatcctatcccagcttctacaggtgaaaaggcaggtgcaaagcaaatcctatcccagcttctacaggtgaaaaggcaggtgcaaagcaaatcctatcccagcttctataggtgaaaaggcaggtgcaaagcaaatcctatcccagcttctataggtgaaaaggcaggtgcaaagcaaatcctatcccagcttctataggtgaaaaggcaggtgcaaagcaaatcctatcccagcttctatcggtgaaaaggcaggtgcaaagcaaatcctatcccagcttttatcggtgaaaaggcaggtgcaaagcaaatcctatcccagcttctatcggtgaaaaggcaggtgcaaagcaaatcctatcccagcttctacaggtgaaaaggcaggtgcaaagcaaatcctaacccagcttctacatgggtggttctcagtggttttcttgtcttaatcgtttcctgcatctcccagcagtcctccagtgagcaggcgtgactttcacaaccagagagaggagcaacaaaacagacaggggtggtgaggaggcgctcgggcagcaggtgctcagaaagctcgcagaggtgcttacgccggccacagatgtgcagggcgcccaggcacagaggaggcggggcacacaggaatggctttgggctgcaacatcaggctgaacagggtgcgtgtgctgggactacccagggaatctcctagagccgcaggcaccagggcagggccttaaggagggttgctgggcacagtcactgcagccactccctgggatcctcactgatgacctgcctcgcctcctacttaggaatccactccctgggatcctcactgatgacctgcctcgcctcctacttaggaatccactccctgggatcctcactgatgacctgcctcgcctcctacttaggaatccactccctgggatcctcactgatgacctgcctctcctcctacttaggaatccactccctgggatcctcactgatgacctgcctcgcctcctacttaggaatccactccctgggatcctccgtggctttcacacccactctctgcctggccctcccacctctccacacaggtcacagcaactctgggctgcaaaggatggttacagcttcaatcacgcaagtcagtgcctatttagataatgcattcttcctccatttattttttgtgcatgttacacagctgtccccaaaacccacttacagggttttatgtaaaagcccagaaatgggcaggtaccctaaaaaacacaagagggccgggcgcggtggctcacgcctgtcatccccagcactttgagaggccaaggtgggcggatcacgaggtcaggagctcaagaccagcctcaccaacatggtgaaaccctgtctatactaaaaatacagtaattagcttggcgtcgtggaggcacctgtaatgccagctactcaggaggctgaggcaggagaattgcttgaacccaggaggtgggagctgcagtgagccgacactgcgccactgcactccagtctgggcgatagagcaagactccgtctcaagaaaaaaaaaacacaagacatcaagacatggaatctcaaacgtaaaaggaagcttgagtgatctaatccaagtttactgaagttcagagataattcaccacatcatcagggtgactgccaggagtcttcgcttgctccaagctggagcgaattcggttctcactgctcaaacgcgggatcccaccagcttctctcctctagcaccctccatcatatcagcacccctttcaatgtatcactgaaaatgacaaccacacccctccatggaatgtcaaccagaagcaatcagttcctttttctagacaccaattctattaatccaacccggagttggcatgagcctttggggtggcctcttcacatagggatacccagcaggatctcagctcactaagtttctttggagtcctgcaagctggcctcacttcacagttccacagactccacagcagctccatcccctccgggcttggcaccgcaggggacagcaccatccagcggacacactacacatgagagtcaattgagaagaaaaccccacacatgcggagcaagaaaagaacgcccctccccctcctggcaaatttcccgatgccccctcccactcctgacgaattgcctgacgcccctccccctcctgacgaattgcctgacgcccctccccctcctgacgaattgcccgacgccccctcccccccagacgaatttcctgatggattactttataagaacaatctgaggatcagaccttcattcaaaactaaaccagtgctgaaaccccgtctctactaaaaatacaaaaaaattagccaggcatggtggcgggcgcctgtagtcccagctactcaggaggctgaggcaggagaatggcgtgaacccgggaggcggagcttgcagtgagcagagatcgcaccactgcactccagcctgggcaacacagcgagactccgtctcaaaaaaaaaaaaaagaaaaaaaaaaaactaaaccagtgtgtctgcatccaagtccgcttcaaaaaatgacagaggagaaccgagcgctgccactgccgtccccaaccagcgagggaacacaggcctggggcctgctgcagccccatagatggggcgccccccgctgccctaactgcgctggggcggggcctcctttcactgcctgcatgggaaccccaccagagtctcatcctctggctgacacaacggactcaattaactttttgtggcagtagccaaatatcaccgttttctacctaaaaggggaaaattttctataaaaagattccacgtccctctttagaaaaataaagctactttaaaaagcccatttatatttgaaacccca

SEQ ID NO: 514 - DNA, 19744 bp, Homo sapiens
tgaagacaaaaagaaagcaaaagattctataagagattatatagtaagttactatttgtgaaaaaaaaaaataaggccagaagcggtggctcacgcctgtaatcccagcactttgggaggccaaggtgggcaaatcaccaggtcaggagtttgagaccagcctggccaacgtggtgaaaccccatctctactaaaaatacaaaaaaatagccgggcatggtggcgcgcgcctgtagtcccagctacttgggaggctgaggcagcagaattgcttgaacccgggaggcagaggttgcagtgagccaagattgcaccactgcactccagcctgagaaacagaccaagacactgtctcaaaaaaaacaaaacaaacaaacaaaaaaaacaaaagaaagaaagaaagaaggaaggaaggaaggaaggaaaaagccgggcatggtggcttacgcctgtaatcccagcaatttgggaggccaaggcgggcagatcacgaggtcaggagttcgagaccagcctgaccaatatggtgaaaccatgtctctactaaaaatacaaaaattagccaggcgtgatggctaacacctgtaatcccagctactcaggaggctgagggaggagaattgcttgaacccaggaggcagaggttgcagtgagctgagaatgtgccactgcactccagcctgggagacagagtaagattccgtctcaaaaaaaaaagaaaaatatttgcacaaaatatctaggggtaggacctgggagacagaggactaggaggtgggaggagcaagagagacttctcactgtatacctatttattacttttcattttttggaagcatgtgaacatgtcatctattcaaatattgaaatttaaaaaataaaggcaccagtaaatgagaaaaccaacaataaatgctaagcagataatttcaagagtggctacttacattgggtatccggggaagacctctgagggagtagcatttaagctgagctctgaatgataagaaattagctataccacaatcctagtaaagaacatttgaaaccaaaggaatagccaacaaaggtcataaggtgggaaagaatggtgccaatatgtacaaagcaacataggtattagattgtgtaggaatttgtaaatcatagaaaggactttaggttgggttttttttttttttttttttttttttttttttttttgagatgaagtctcgctcttgtcccccaggctggagtgcagtggcgcgatctcggctcactgcgacctctgcctcccgggttcaagcgattctcctgcctcagcctcccgagtagctgggattacaggcacctgccaccacacccggctactttttatatttttagtagagacgggttttcactatattggctaggctggtctcaaactcctgaccccaggtgatccacctccctcggcctcccgaagcgctgggattacaggcatgagccactgcgcccagccagactttaggttttaaaactaactgcaacttgaagccgatggatggttttaagaaaatgagtaaggccaggtgccgtggctcacgcctgtaatcccagcactttgggaggccaaggtgggtggaccacctgaggtcatgagtttgacacctgaggtcatgagttcgagaccagcatgaccaacatagtgaaacctcatccctactaaaaatacaaaattagctggccgtggtagcacatgcctgtaatcccagaaacttgggaggctgaggcaggagaatcacttgaacccaggaggcagaggttgcagtgagggaagattgtgccattgcactccagcctgggcaataagagtgaaactccatctcaaaaaagaaaaaaaaaaagaagaaggggagtaaaggccaggcgcagtggctcacacctgtaattccagcactttgggaggctgaggcaggcggatcatgaggtcaggagttcgagaccagcctggctaacatggtgaaaccctgtctctactaaaaatacaaaaaattatccaggtgtggtggtgtgcgcctgtaatcccagctactcgggaggctgaggcaggagaattgcttgaacccaggaggcggaagttgcagtgagctaagattgcgccattgtactccagcctgggtgacagagcaagactctgtcaaaaaaaaaaaaaaaaaaagaaagaaagaaagaaaagaagagagaaaagaaaagaaaaaagaaggggagtaactagatctgaattacctttataaaagatcatcctggcatctgagtggatgatggactacagagagtcagaagaggaggtaaggaaaccaattaggagggtgtttgagtgtccagtgagagatggtggtagcagagaacatggtatgaagtagttgaattggggattatttagaaagtggagtttatatgaattactggtggataggatgtagagttaatggaaagaggagtcaaggatggtctttagattttttataagaaactgagtagatggtgataaatcataaatcagacttaggaagacagggaaagggtaggtattagggggaaattagagctgcctatcaagcatccaggaggaaatgtcactgcatgcacaggctagattcaggggagattcaagcaaggctgaagttagatttgtggatcattggtgatcacttaagcccaggattggataggttacctagagatattgtgtaagaaagaaaagaaggggcctcagcactgatcctggcatgccacgtataggagtatttttttcttttcttttttgagatggagtttcgctcttgttgcccaggctggattgcaatggcacgatctcagctcaccacaaccaccgcctcccgggttcaagcaattctcctgcctcagactcctgagtagctgggattacaggcatgtgccaccatgcccggctaattttttgtatttttagtagagacagggtttctccatgttatcaggctggtctcgaactcctgacctcaggtgatccaccggcctcagcctccgaaagtgctgggaatacaggcgtgagaccctgcgcccaggttttctttttttttttgaaacagctttgccaaggcaagatggctcccatgctggtaattccagcactttgggatgccaaagagggaaggatagcttgagcccaggagttcaagaccagaccgggcaacatagtgagaccttgtctctaaataaataaataaaagccaggcataatgatgcacacctgtggtcccagctacttgaaggccaaagcgggaagattgcttgaggtcaggagatggagaccaccctgggcaatatagtgagaccttgtctctacaaaaaaaatttaaaaattagccaagcgtgatggcaagtgcctatagtcccagctactcgggaggctgaggtggaaagattgcttgagcccaggaggttgacgttgcagtgagccaaaattacaacactgcattccagcctgggcaacagggcaagacactggctccagaaaaaaaaaaaaaaaaaaaaaaggttggatctgctggctcacacttgtaatcccagcattttgggaggccgaggcgggtagatcacctgaggtcaggagtttgagaccaaaaaataataataatgataaataaataaataaataaaagaaaaaaacagacaaacaaagagttcaagactagcctggccaacatggtgacatggtaaaaccctgtctctactaaaaatacaaaagttagccaggggctgggcacagtagctcatgcctgtaattctagcactttgagaggctgaggtgggtgaaccacttgaggtcaggagtttgagaccagcctggccaacatggtgaaaccccacctctactaaaaatacaaaaattagtcaggtgtggtggtgcatgcctgtagtcccagctatttgggaggctgaggcaggggaattacttgaacccaggaggtggaggttacagtgagccaagatcgagccactgcaccccagcctgggctacggagcgagactccatctcaaaaaaaaaaaaaaaaagttagccaagcgtggtggcacacacctgtaatcccagctattcaggaggctgaggcacaagaatggcttgaacccaggaggtgaaggttgcagtgagccaagatcgtaccactgcactcctgcccgggcaacagagcgagactgtctcaaaaataaataattaaataaataaacctgccaatagcttctatgacccaaagatgagatgcccctggccacctctaaaatctcctacaagctgatgtaactatgagaattaaagaggacccaaaactgactgagatcaaattttctgctagtcttgcaagatggaggtagaggaagaatatacattctcttcaggatgctggactgagcgtgtgttatttttttctcccttttcagagaacactaaaaggaaagtaaaagaataaaaaggttaatacagcaaaatataattgagaatgggaagggctaattatgatccatgttagtgagtaagaaatttcaggaaatttcttggccaggcatggtggcttatgcttgtaaaaccagcactttgagaggcttaggcaggcagatcacttgaggtcaggagtttgaaaccagcctggccaacatggcaaaacctctactaaaaatgcaagaagtagccaggcgtggcggtgcacacctgtaatcccagctactagggaggctgaggcgggagaatcgctggaacctgggaagccgaggttgcagtgagccaaaattgtgccactgcactcttgcctgtgcgacagagcaagactctgtctcacaaaaagaaaaaaagaagaagaagaagagagactaaaatgcagagactgcaagactgcccttcaaaatggaagagagaggcagaattgagttctctgcttcagagtcacaggctgcaatccaggtgtcagccaggtctgggttctcctcagaggctctagcagggaaggatccaatttcaggctccctcggcttggtagaattcatttgctttcagctgtaggattcacagtagattgcttcctcgaagccaggaagaaagacagagacccacacagagagacaggcaggctctagtgtcaggcagctaacaagacagtcttataaaaatgtaatcataggaatgacatcccattatttttatcattgtctattggttaaaagcaagtcacagaccctgcccacactcaaggaaaggggattagggaattatacggggctgaatacccggaggcaggggtcacagggccaccttaaagtctgtctcaagtgggtattgttttgttttgtttcattttggcattggtaaggaagagggtatcaaaaggtaggggcagctgcctgtacattggatgaaaatatgctgaaattgatgggggcgagtccagtctaaccccaccccaactctgacttcagtcatgccaaagaaagagatatggagattggagctatttcctcaccattttataacttaactgcctgcagagtactctgtagatctaatgtacagtacaaaaagatgaaacaatagaatgcggaaggctgggtgagatggctcacgcctgcaatcccagccctttgggaggaccaggctagcgatcactttgagctcaggagttcgagaccagactgggcaacatggtgaaatcccgtctctaccaaaaaaaaaaaaattaggcatggtggaacatgcccgtagtcccagctactagggaggctgaagctggagaatggcttgaacctgggaggcagaggttgcagtgaactaagatcatgccacttcactacagcctgggcaatggagtgagaccctgtctcaaaaaaaaaaaaaaaaggccgggtgtggtggctcacgcctgtaatcccaccactttgggaggctgaggcaggtagatcacctgtcaggagttcaaaaccagcctggccaacacggcgaaatcccatctctactaaaaatacaaaaattagctgggtgtgctggtgcgtgcctgtaatcccagctacacgggaagctgaggagtagaattgcttgaacccgggaggtggaggttgcagtgagccgagatcatgccacttcactccagcctgggtgacaaagtgagactccatctgaaaaaaaaaaaaaaatcagaagaggtttcggttgtattggattggactcttgtatttatgatcaaggaagttacagcaaatgggtaagagttcagaaaattttggggggagctgagataaggtggaggaagccacagcttccagacgttagatgcaaaaatgaagggtgatagggtttggatattttttcccccaaaatctcatgttgaaatgtaatctccagtgttgaaggtagagcctagtgtgggaggtgattctatcataggggtgattctatcatattaaactcattaatagtttgacaccatcctcttggtgataagttagttctccctcagttagttcatgggagatccagttatttaaaagtatgtggcacctccccactagctttctcttgctctggcttttgccatgtgacacacctgctcccccttcgccttccaccacgattgtaagcttgctgaggccctcaccagaaggatatgccagcaccacacttcttgtactgtccagaaccgtgaacaaattaaatctcttttctttagaaattacccagcctcaagtatttatttgtttatttgtgttttttatttttttgagatgaagtcttgctcaatcacctaggctggagtgcagtggcatgatctcggctcactgcaacctccgcctccctggttcaagccattctcctgcctcagcctctcaagtagctgggactacagatgtgcgccaccatgcccggctaatttttgtgtttttagtagagacggggtttcgccatgttagccaggctggtgtcgaactcctgacgtcaggtgatcagcctgcctcggcctctcaaagtgctgggatgacaggcgtgagccaccatgcctggccaagtatttctttatagcaacacaagaacagcctaacacggaggggatgggtcctggaccattatttagagtcatcccattcacccctttcagtttcacaacccatccaaagtaacctctcagtgttttgcatttttttttttttttttttgagacagagtctcgctgtgacgcccaggctggagtacaatggtgcagtcttggctcactgcaacctccacctcctgggttcaagggattctcctgccccagcctcccgagtagctgggactacaggtgagagccaccatgcccagctgatttttgtatttttagtagagatggggtttcaccatattggccaggctggtctcgaactcctgacctcaagtgatcggcctgcctgggcctcccaaagtgctggaattacaggtgtgagccaccacgcctggctatttgttttttttttatacttagcataattattttgagattcatacatgttgttgcatagatcctccattcactcccttttattgtggaggagaattccatttatgaatatatcacaatttattcattcatcttttgatagccatttgaattgtttcctgtttggggtttatcaaaagtaaaattactggccgggtacggtggctcatgcctgtaatcctaacactttgggaggccgaagcgggaggatcgcttgagcccagaagttcaagaccagccttgacccctcctggggtccctcaccctcactcacagctctactctggtgaggtggctggtgggggagttgtatctggacccccagtgggtcccaaggggttaggggctgcctcatccactggggcccctggtaggaataagcagcaccccgcatgcactacccccatttcagtatcaagctcgggttggtggtgctccccctacaaagatgtctaacactccaatgggtgatgggaacctatcctctgcttcaccaccaaccaccttcccccatgtggcaccaaacctgcctcccccatctgcccaagccccctcaacaatgcatcagcagctgggcatggtggctcatgactgtagtcccagcagtttgggaggacaacacaggaggatcacttgaggtcagcagttcgagaccagcctggccaacatggtgaaaccccgtctctactaaaaatataaaaatagtcgggcgtggtggtgcgcattcgtagccccagctactcgggaggctgaggcaggagaatcgcttgaactcaggaggcagaggctgcagtgagccaagatagtgccaccgcactccagcctgagatacaaatctagaatctgtctcacagaaagcaaaacaaacaaaaaaccccagcacattagcttctcctccaggcccggggcccctgccctgtggcacagggagagagcatctgtcctctccctgtgccacggggcagggaatgggagggtttcctcctggcccagagaacgacttgactctagctcccacagcccaccctctgccccggctccctgcttcctcttcttccgccccactgaggtttctttactcatgctctagtagcagctctgcggcagcctcctcttccagttcttcctcctcctcctctgcctcccagtaccctgcttcccaggcattgcccaggtatccccactccttccctcttgcaacaagcctctctgtccccaatcaggcccccaagtatactcaatcttctcttccagcccaggctgtgtagagccagggtcccccacaacctcctgtggcggcctcttaggcttcctccttctcctggaggccaatccactgcccacatcacccccaacacatcaccatcaccaccagcagcaacactgtggaagctccaggccccctccacctggagcatttccccaccacctggagagctgtagccacatagccccataccatgcacactcttttttttttttttttttttgagacggagtttcacttttgtcacccaggttggagtgcagtagtggcactatcttggctcactgcaacctctgcctcctaggttcaagtgattcttctgcctcagcctcccaagttcctgggattacaggcgctcaccaccataagtggctaatttttgtatttttagtaaagacagggtttcaccatgttggccaggctggtcatgaactcctgacctcaggtgatccacctgcctcggcctaccaaagtgctgggattacaggcgtgagccacagcgcccggccaatgcacactcttatgccatgtgttcctccctggggtctctttggctctatccatcagggccagcatacctggccccatctcacagccagatgtcctacagccaagcaggccccaattgccccctacctcccacggtctcttcttctctttttttcctcctctcaagggtcctacccactttcacacacctcccagggcccctacctcttcctgctggtgcctacggtcaccacctccttggctgccctttccactgccattgctattgtggcttcctcaccagcagactacaaaacagcctactcgcctgggcccacgccatagggagagaaagctgcatccccagggactagaagacaggccacacagatacaagccagggtgcctctctccatctgaaggggaccccatcgggtcaaaccagtcttgcccactgtgggacctgtcacttgtgagccctcaggtgtcatctctgccaccaccacctgtggcccctgcctcagggttacccctaagcaccagacagatcaaacaggagcttgctgaggagtatgagaccactaagagtccagtgcccccagcctacagcctccaactcctcctaaggtggtggtagtcctttccagccatgccagtcagtcagccaggtgagtgggtacgggagggtgagcctggaagggggttatgaaggggcgacagagagtggcacaagaggggctttctgtttatgtggtggtttttgttgttgttgttgtttttttgagatggtttcgctcttgttgcccaggctggagtgcaatggcgcgatcttggcccactgcaatctccgcctcctgggttcaagcgattctgctgcctcagcctcccaagtagctaggattacaggcatgtgccaccacacctggctaactttgtatttttagtagagacagggtttctccatgttgatcaggctggtcttgaactcctgacctcaggtgatccacccacctcagcctccaaagtgctgggattacaggcgtgagccaccatgcccagcctatgtggtgttttttatcttattttttattgagacaaggtcttgctctgtcacccaggctggaaggctggagagcagtagtgtgatcatggctcactgcaaccgtgaactcctgggctcaagcgatcctcccacctcagcctacatgcctggagctgggatgacaggcacaggtaggagcaactggctaatttttttatttatattttttgtatattttttttgtagagaatatatatatttatatatatttatatatatttttgtagagaatatatataaatatatatttttataatataaaatataaaaatataaaaaatatatattttttttctagagaaggggtctctatgttgcccaggctggtctccaactcctgggctcaagtgaacctcccgaagtgtggagattacaggcatgagccaccgtgcctggccttttggtgaaattttgagtcaaaaaaattttttttgagacaaggtctggctctgttgccccagctggattgcagtggtgcgatctcggctcactgcagcctctgcctcctgggttcaagcaatcctcccacctcagcctcctgagtagctgggattacaggtccatgccaccacacccagctaatttttgtatttttagtagagatgggtttcactacgttggccaggctggtctcaacctcctggctcaagtgatccacccgccttggcctcacaaagtgctgggattacatcatgagccactattcctggccttcactcaaatctttttgtccatttttctattggggttttctttttcttattgttcagttttgagggttcttaaatatattctggattgaatgggctcatggatatttatgaaatcatgccccccaagagttaaagataccagtgactgttaccaagcaaaaggagctcactgcccggtggtacagaagtcaaatgctatggcactaggtttttgagaagaaaaaaaaaaaagctttattgtgagtcagccaacaaagagacaggaggccagctcaaattggcctccctgtgcaattcttaagtcagtgctttttaaactttttattgtattttattttttagagacagagtcttgcttttttgctcaggctggagtgcagtggcttgatctcagctcaggtcactgcaacacctgcctcccaggttcaagcaattctcctgcctcagcctccccagtagctgggactaaatgtgcatgccacgatgcccggctcttttttgtatttttttttagtacagatggagtttcaccatgctggccaggctggtcttgaactcctgacctcaagtgatccacccacccctgcctcccaaagtgctgggagtaaaggcatgagccacaacgcatagcctgcaaatgggttttgttttatttatttatttatttatttatttatttatttatttatttatgagacggagtctcgctctgttgcctaggctgcagtgcagtggtgtaatctcagctcactgcaacctccgcctcccaggtaccagcaattctcctgcctcagcctcccaagtagctcggattacaagggcatgccaccacactcggctaagttttgtatttttagtaaagacgggatttaaccatgttggtcaggctggtctcaaactcctgacctcatgatctgcccacctcggccttccaaagtgctgggattacaggcgtgagccactgtacccagcctctacaagtgggtttttaaaggaaaaaagaagaggtagttcctaagttgtttaccaataataatttacattaaaataaaataagttattgattggctacacattgttttattttattttattttttgagatagagtctcactctgtagcccaggctggagtgtagtggtgatatctggtctcactgcaacctccacctcctaggttcaagcaattctcccggctcaccctcccaagtagttgggactacaggcacgcaccaccatgcctggctaatttttgtatttttagtagagacgaggtttcaccatattggccaagctggtcttgaactcctgacctggtgatccgcccgcctcggcctcccaaagtgttgggattacaggcatcagccaccgcgcctggcctattttttcttttctcaccaactaatggaaaagtgagggctttatttatgtattcattttcagatggagtcttgctccgtcccccaggctggagtgaagcagcacgatctcggcttactgtagcctctgcctcctaggttcaagcaatttctgccttagcctcttgagtagctggttttacaggcatgtgccaccacaccccacccagctaattttttttttttgagacgtagtctagttgtgtcaccaggctggagtgcatggcgcgatctcggctcactgcaacctccgcctcccaggttcaaatgattctcctgccttagcctcccaagtagctgtgattacaggcacacagcaccatgcccagctaatttttgtatttttagtagagacagggcttcaccctgttggccaggatggtctcaatttcttgaccttgtgatccacccgcctcagcttcccaaagtactcggattacaggcatgagccaccacgcctggcctttttttcttttttgaaacagggtctcactctattgcccaggttggagtgcagtgttgagatctcagctcactgcaacctctgtctcccctgctcaagagattctcccaactcaacgtcctgagtagctgggactacaggcacctaccaccacgcctggctaatttttgtgtttttttagagacagggtttcgccacattgcccaggctagttttgaactcttgagctcaagtgatctgcttgcctcggcctcccaaaatgctgggattataggtgtgagccaccgtgccctgctgaggagagtcttagtttgggatccatggattcctttgaggcctattcatgggcttcaaaggattaatcagtccttgaaatcatacgcaaaatttgtgtgtaggtagatagcttttatcagatttccaatgtggtttttaatcccctcttccaaagaaaaaacaatcactgtaatatctagtttctagtttcaaggagtgaactatcaaagtataaaacagtagagacatccagcaggatactgactgtttgtgtccatttaatatgacaattagaaggtcacttcttggaagagtcatttggctttgctccctcaatttcctttccacttcacctcacttcagtctggttttggaatgctaacactcactctacccaaactgctcttgttgtggagtctgtggtatccaccaatgggttctttctgcctgctgcacaaacaaaattaattgacagaaaccatggcattgcagtaaagaaagtttaattgacgcgaggctggccatgccacgtgggagacagagttgttactcaaatccatctcaccaaaggctcagaggttagggggtttttcagatagtttgacaggtacggggccagggaatggggagtgctgactggttgggtcagaggtgaaatcataagaagtagaagctgtcctcttgcactgagttggttcgtggatccccaggttgatgagtcagggtggggccatccacttgtcagaaatgcaaaaacctgaaaagacatctcaaaaggccaatcttaggttctacaacagtgatgttatctgcaggaatgattggggaagatgcgaatttgtgacctgtggaataatgggtggtaatcatttaactacaattacaacttagaagaattcaggaccctctcattctcctaacttggtggcctttcatttagttttaaaagggcagttttggggaagggttattatcatttaaactataaactaaatttctcccaaagttagtttgtcctgtgcccaggaatgagcaaagacagccagtctgtgaggctagaatcaagataggagtaaaccatgtcagatttctcttactgtcaaaattttgcaaaggcggtttcaacagaaattaacatgtctaggatagttgctttttctattattttttctatcactgcatttactttcattctgccttatgctttaactaggtaattttttttttttttttagttttggcggtatcaacactatattcttctctttgaccaccgcatgctgcctacgtggtagactctcaatacgcatggaactgaacctcttacaggatttgtaactcacttctgtggtatctagtaaactggaacacgcgctttccctgggctgctctgtcatcccaggtttcagcactcggaaatcgcttgggcccccgcccagaggcggggcttgggtgggctgaccactcctctggcctccaatactgtcgctgacattctcgtctatgctccagcagccgtacctcactccggtggaggcgggacttcctacagcacttccggccagagcctcaagcttcgctgctgggcagttggctggaggggctgctgctgggaacacctggagtctccgcgggcaggtgagcttcagaggttcggggagctttcggaacgagcattcctggccggtgcgtcaccctgcagtgctcttggccttttcttcctttcctggaatcttcccagattgccagagccgggcgttgcctgctccgtgcgctgggaggcggtccagccggctgggttggggccaccctgcgcctcctggaaggccttatttaggagtagccgcacgtgatctctagcattttaagcttctctcagagaattggcatgtcactttggaagaggtgaaaatggtacaggcgaccaacgacttttacaaggtgtcaccttagaggaacagcctcgtccttccgaatcagttaacattggtgatgacagagaaataacgttaaataggtggagagcacttaaagtaactgtttgttcttttgagacagtcttgctctgtcgcccaggctggactgcagtggcgcggatctctgatctcggcttactgcaacctccgcctcctgggttcaagcgattctgctgcctcagcctcccgagtagctgggattacaggcgcgtgccaccacgctcggctaatttttgtatttttagtagagacagggtttctccatgttggccaggctgctctcgaactcctgatctcagatgatccacccgcctcggcctcccaaactgctgggattacaggcgtgagccaccgcgcccggcctaaagtaactatttttacttggtgtttactaccaaatggggactgttctaagttgtgggtggatccaaatgatggtgtgacagccttatcctcagagaagcagtcctggcaggaagacggggttaacaaattgccaaactgttagagaaagttagtggaggtagagatgaagagagaagacttttcttttctctggcattaatttagccacggccgctgtgttttgatacttgcttcaaacgtttttcatattcttaagttttaacttttctgtatgctcatattttatatactgttgtaaacagcatatctctgggttttttttttaatctaagtggacagcctgctttttttttttttttttttttttgatatggagtcttgctctgtcgcccaaggctggtgtgcagtggcccaatctcagctcactgcaaccacgcctcccaggttcaagcatatctcccacctcagcctcccgagtagttgggatgacaggtgtgtgccaccatgcccagctaatttttttttttttgtatttgtagtagagatggggtttcgccatgttggccagactggttttgaaggcctgacttcaggtgatccacctgcttcagcctcccaaagtgctggggctacaggtgtgagccaccgtgcccagcccagtctgccttttgactagcaggtttattggatttacattcattgtcactactgaaatatttgtctagatgaaaatctttggtatcatccctgattaatctcttccatatatatcagcaaatcctatggactctccacctttaaaatctgtccacactcccaggctcttgttatcaccttcacttgttcaagttacgttgtctcgtacttgaattactgcagtagtttctgctctttcctcttttagtctgtttgcatcacagtatctcggttgatcctttaaaaaaaaatcagatttatgtctttcctctcaaaaatcctccaaggactacacatttcacctggagtgaaagccaaagtcggccgggcgtggtggctcatgcctgtaatcccagcactttgggaggccgaggtgggtggatcacgaggtcaagaggtcgagaccatcctggccaacatggtgaaaccccgtctctactaaaaatacaaaaattagccgggcgtggtggtgcgtgcctgtaatctcagctactcaggaggctgaggcagaagaatcgcttgaacccgggagacagaggatgcagtgagccgagatcgtgccactgcactccagcctggcgatagagcaagactctgtctcaaaaaaaacaacaaaaacaaaaaaaacaaaaactggctgggcgcagtggctcaagcctgtaatcctggcactttgggaggccaagactggtggatcacctgaggtcaagtgttcaagaccagcctggccaaagtggcgaaaccccgtctctactaaaaaaaaacacaaaaaattacccaggtgtggtggtgtgtgtctgcaatcccagctattagggaggctgaggcaggagaattgcttgaacctgggggcaggcgcggaggttgcagtgagccgagattgtgccattgcactccagtctgggcaacaagggcaaaactctgtctcaaaaaaaaaaaaaaagccgaagtcttcagagtggattattcatcgaaggtcctatgtgacctagccctgcttcactgctgatctcatgtcgttctcatctcctgtttgctctactgtatggtctcctcaagcgcatcctagcctcaggatatttgcacttgctattcctttccctcatatgtccacatggctcagttctttacctctctcatattttggggacctttaccttctcagtaaggccttctctgacaagccactgccatctttaacatttccattgcactcgttatccttgtgcttatcatcatatgacatgccatgtgatagagtcatttatctggtttattatgttttctctcactggcatagaaggtttatgagggcaggtatttttctgttttgtttactgctgtattctttttttttttttttttctgagacggattcttgctctgttgcccaggctggagtgcagtggtacgttctcggctcactgcaacctctgcctcctgggttcaagcaattctctgcctcagcctcccaactagctgtgattacaggcgcatgccaccatgcctggctaatttttgtatttttagtagagatggggtttcaccatcttggccaggttggtcttgaactgctgaccttgtgattcacccgcctcagcctcccaaagtgctgggattacaggcgtgagccactgcacccggcattttttttttttttttgggaagatctcttattgtacttccctgtaaaatccattactgttttattccaattgcctaaaatagtatctggcttttagcagacactccataatataattgttgattgaatgaatttggggtttttgcaccatcttctacacttcatatttttatgcttttttcctccttgtcttttcttttttttttttttgagatggagtcttgctctgtcgctcaggctggagtgcaattgtgtgatgtcggctcactgcaacctccgcctcccgggttcaagcgattctcctgcctcagtctcctgagtagctgggattacaggcgcacgccaccacgcccagctcttttttgtatttttagtagaaatggggtttcaccatgttggtcaggttggtcttgaactcctgacctcatgatccgcccgcctcagcttcccaaagtgctgggattacaggtgtgagctatcacgcctggcttttttttttttttttttttttttttttttttttgagacagagtggttgctcttgctgcccaggctagagtgcaattgcatgatcttggctcaccgcaacctccgcctcctggcttcaagcaattctgccacctcagcctcctcagtagctgggattacaggcatgcgccaccatacctgactaattttgtatttttagtagagatggggtttctccatgttggtcaggctggtcttgaacttctgacctcaaatgatccacctgcctcagcctctcaaactgctgggattacaggcgtgagccaccgcccccggccactcttgtctttttttttttccctttttttttttttttgagacagggtctccctctgtcacccaggctgtagtgcactgacacgatcttggctcactgcaagctctacctcccgggttcaagtgattctcccacctcagcctctgagtagctgggattatacgcgtgtgccaccatagcctggctaatttttgtatttttattagagatggggtttcatcatattggttaggcttgtctcaaactcccaacctcagttgatccacccacctctgcctcccaaagtgttaggattacaggcgtgagctacagcacccggccccacctttttttctgagacagagttttgctcttgtcacccaggctggagtgcaatggcacgatctcggctcactacaacctccacttcccggattcaagtgattctcctgcctcagcctcccaagtagctgggattacagggacccgccagcatacccagctaatttttgtttttttagtagaggtgggggtttcaccatgttggccgggctggtctcgaactcctgacctcaggtgatctgcctgccttggcctcccgaagtgctgggattacaggcatgagccactgtgcctgccctttttttcattttttcatttttttgtacaatagggtctccctctgttgcccaggctggagtacagtggtgtgatcagggctcactgcagcctcgaactcctgggctcaggtcatcctccaacctaagcctcccaaatacattggcctataggcgtgcaccaccacacccagctgatttttatattttaatttttaattttgctgtgcatatttagctgggattacagacgcactccacctcgccaggctaatttttgtatttttagttgcaacgggatttcaccatagtggcaaggctgctctggaactcctgacttcagatgatcctcctgccttggcctcccaaagtgttgggattacaggcgtgagccaccgctcctggct

SEQ ID NO: 515 - DNA, 20250 bp, Homo sapiens
acctatttcttctttttgataaaaactgggggtatagaggggaagatgtagccaagatactcacctgaggagttctggccattctcatcatgatcattataggaggtctaagtcttaatgtttcttttatacagcgatcaagtaaatttagatccttgagctaaaatgagaaagcatttcctgattgttataaataacatacttcaacagtacaaaaaattagtttaacttcttagttagtacaagacagcttgcattccagctaaaagtacagaggtaactggttcagggtggctggggttatcatgctctaccactgtccatggtgaaaaaggagggcaaggtaacagaagcgattgccctgaagaatgaagtaagaacctacaaaaattcactcctccaaaaaatgaaaacagtagcaacaatcttaatgtcaactttttcaaaattctggaagattaaccaaaggcttgcaacaatctaaggagagttaattcaagaaaaagaaatctgaatcttggtaagaagagtaagctttgtggtagtgtaagttgtatttctttcatcctcctctccccaaatccatggtagccccggaaaccaacagcatgacaactatagcagctgtgaaagccagaagcctaacaactattagaggagccagagcaaattttccaaaaatatttagcaaaaattgtttaacactgaaggcgcctgagatggtgatatcagttggtgctaagagacagaacaagaagtttaaaagggaaaactggggagtaagatgtccacaggagactttgaaaagttccaacataagagaatcttgaaggccacacatatgtataagaccatgcatatgcccaggtaagatctaagaggctgtaatcttttacctctggctgacctgtacacacaggtagtgaaggcagacttgtaactgcctgttggagtgttaataacatcccctaacacacacatacagagcctttcagcaaaagctaggagactggctgttcaaagcacttcagtaaatctctgtccaaatattagatgcccactaaagtaagcaagcagagatttcagtgacctcactgaacaaggaatgacataattaatccaggaaacgcagtaaacaaacagcagcagcaacaacaacaacaacaaagagccagcaacaataaacccagggaggagggcatctgatttccacagttgccacattattttaaatgtacagttttcaacaaaaaaattacaaaaaacacaccaaaacaggaaagtatggccagtacatagaaaaagcaagcagtttaatagaaactatccatgaagaagcccagacattggacttactagataatgaatttaaatcagctattataaacaggttcaaagaactatagcaaaatatgcctagatatctctagtaaaatggagaatatcaatatattatttttttagagaaccaaatagaaattcaagaactgagaagtatgagaactgaaatgaaaaattcacccgaggggatcaacagcagatttggactggcagaagaaagaataacatcaaaaaaataacaataataaaatacttaagaatacatttaacaagagaagtttaaacattgtgcaccaaaaactataaaacattgttgaaagaaattaaagaactaaaataagagaaagacatctcatgttcacagatttaaagactaaaattgtgctcccaaattaatatggcgatacaatgcaatcattgtcaaaaatctcagctagcttctttgcagaaactgacacactgaccccaaaattcatatggaaactaaagggactaggagtagataaacagccttgaaaaggacaaagtcagaggactcacactcccgaattcaaaacttattacaaaactacgtaatggcatcagactaaacatatcaatggaatagaactgagtccagaaataaagccttaaatttatggtcaagaggctttttaaaatgtatttattttttcagagacagggtttcgctatgttgcccaggctggaccccaagtcctgagctcaagcgaccttcccatctcagcttctcagtagctgagaatacaggcacgtgccactgcgcctggctataatagatttttttacaaagacaattcaacgtggaaaaaatagtcttttcaacaaacagtgtgggacaactggataaacacatgcaaaagaatgatgacctcacatcatatacataaattaattcataatggatcaaagacctaaatgtaagatatgaaactacaaaacactaagaagaatacacagaaataaatcttcatacactttgattaggcattagtttctctgacaccaaaagcacattaaaaaaaaatagatgaactcttacaactcaataataaaaagacaactcattttaaatatgggaacaggatgtgagcagacatttctccaaagaagtataccaaagccaaagaacacatcataagacactcaacatcactagtcaccagggaaatgcaaaatcaaaacaaaataccaactgggcatggtggctcacacctgtaatcccagcactttgggaggccaaggcgggcagatgacttgaggtcaggagttcaagaccagcctggccaatatggtacaaccttgtctctaccaaaaatacaaaaattagccaggcgtggtggtgtgtacccagctacttgggaggctgaggaaggagaatagcttgaacctgggaagccgaggttgcagtaagccaaggtcgcgccattgcactagagcctgggcatcacaccaagactctgtctcaaaaaaaaaaaaaaaagtatcacttcacacctattataataaaaaaatcaagtaacaagtttggtgagggggtgaagtcaggaccaacatatactgtttagtgagatttgaaagtggtgcagccactttttaaaacagtctggcagttcttcaaagttaccttataacccagcaattctactcctaggtatgaccccccaaaattgaaaacacatgtccacataaaatcagtacacaaacgtttagagcggcattattcataatagtttaaaaggtggaaacaactcaaatgtccatcaactgatgaacaaataaacaaaatgtggtctatccatataatggaatattattggtaataacaaagactgaagtactgatacatgctacaacatggaagaaccctgataacatgctaagtgaaacaaggtagtcacaaaagactacaaattgtatgatcccatttacatgaaatatccagaataggcaaactcacagaggcaaaaggagattaatggttgccaggggcagcagtcagggagaatgaagcatgactgctaatgggtaccagctctcttttgggagtgatgtaaatgttctaaaattaaattatgatgatggtttcccaactcttaatatgctaaaaaccacaaagtgtacattttaaatggatggatttatgctatgtaaatatatcagttaagctgttattttaagttactaaaaacaagaatgagtgttgagacatcactactgagcttacagaaataaaaaggattatgagaatactatgaacaattgtatgccaacaaattaggtaacctagatgaaatggacaaattcctagagagatataaactactgaaactgacataagaagaaatggaatatctgaataaacctgtaacaaataaattgaattagtaagtaaagtcttctcagaaagaaaagcacagatctagatgatttcactgctgaatttttgcaaatatgtaaaaaaggattaacaccaatcatccacaaactcttccaaaaattagaagaaaaaaagaatacttccaaatacattctatgagatgagtatgatcctgatatcaaaaccagtcaaagacatcacagtgaaactagagatcaatatcctttatgaatatagatgcaaaaatcctcaacaaaacaccagcaagtttatatgtagtaacatatagaaagaactatgcaccatgacaaagtaggatttatcccaggaatacaattaacatctgaaaatcagtgtaatgtgccatattaatataggaccaaaagcacaaaagataacaggaagatgacatcaccaaggtttgcttccaagatggaatgtcaggttgtgcagtgagttgtcctctcttcctttccacccagcaagttgcatgtagtatttgtaaatgtcttgtcctcattactactactactactacttttagaagtctctgctcatgcccaggccactctggacatacagaattctaagtaattcagaggcttctacacttcataagacacacaacatgcacataatatcctctatgtacagaagccagactttgaagcagaggaagtaagtaccaaagaaacatccccaaggatctctaagccatcaacccaaaacatatctgataaagcttaatggcaagaagcaataacattaagatattttaggtaaggttatagggaatttgctaaaaatagagaagctgatcaatttaagctatagtatatagaaaatctcaaattgtcccttttaaaaattagccacagatcctcaaagtcataaggcagcaatgaaactgaaaaatccaacaaacctggtcataagttaaaggaggcagattctctccacagactgttttctgttctaaataacattttttttgaagtgttttgtctctggccaaaaagaagcccatccaagcactagtagttgaggatgtatgctgccctgccaagagtaatccaataagcatccctgctacttcatcatcagtcaaaggacgcccatccctaaggaatgaaccaaagacacaaatttaacattttggcagatacatttcatgcctcaacctttaaataaagtgtcataatgaatacatttttcaggtatagtggtctcttatatttgactatcacaagtcaagagttttttttctcttagggaagagacagaccagcacaaaacgattttgattacaaaagactccattacagttcattagcaaacttttaccatacccagtcactgggattacagtaagacacaggatgccaatagtttatgtctcaacaatttaaagagtccaaagatcacagctaccaacttattttgccagcatcactgttttttaactggaaatactatttaactgtgttttaatgtgtaatttcctgcttcagcttaatatgttatctgaatagctcttacttgtatgtagcatctagtaaagtttggagaatgtcatcaattttttcttgagactgtctgcgtttctggattgccttatagaaaatatccttgatttcccgatgagctctgtccctgcgtctgtaattaaaagataaagatgattttcttaaataaagaaataaccttctaggatcaaattcattttgagaaccaggaccgagcataaagcatcttatttaaccaactttaatgactctaaaataattgacaaaaaaatcagaaccaggaacatactggaagtcatgaaaatcttacattgttaaaaatgtccatagtccctaagggcaagaactgtgctttatttaacatatatatcccagattcttaacacattgcctgtgttcaaactaaaggcctaaaacaagcaagaaattcctttagaagtattttccagttcaacagaaagtaggatactcttttaaattaacataaaattccaattttaataccaaatcaagtcttaaagcagaagagtcactctggttcttccatggaatctggttctacttttcactttctaatacaatagttttttgtagggggtgaaaatactagcagattcagaaaacaagcttcaactcctaaactttacctttaaatagtatgttcactatgtagcaggtaccatgttaagtgttttacatgaattactcacttttatcttcctgtgaggtacatactattaacctcaagttatagctagctgcataagatcacacagaaagcaaacattggagctggaatttaaaactaggcagtctgactcccaagccccctcttaaatcaagccttctaaaaaaaactcctactctgtttcatttacaagactgttaatctgttattgaggatcaactgaaaccatgtgtacagaagagaagatgttggggcttaactgtatgaatacagtcgaaccaggaaaacataggcctgtttaagaaagtgaattgaataatctggttaaattagttggtatgagtagaagaaagaaagactgggccagaatgtgaagggcctaacatagcaagctctgacttcatccaagagacagagcaggtagaaacaggcaggtagaaatgtacatttatgggccaggtgcagtggctcacgcctgtaatcccagcactatgggaggccgaggcgggcggatcacaaggtcgggagatcaagaccatcctggctaacacggtgaaaccccatctctactaaaagtacaaaacaattagccaggcttggtggcgggtgcctgtagtcccagctactcgggaggctgaggcaggagaatggcgtgaacctgggaagcagagcttgcagtgagccgagctcatgccactgcactccagcctgggcgagagagcaagactccatcaccaaaaaaaaaaaaaaaaaaaagaaatgcacatttatggagaacccactatgagtccagggctgtgctgggtgttctaatataagatatatgaaaacattttgaaactgcaaagctccttgcaaatataaggtatgatgagttccagagaactttagggaatctctcctggctcttccttttactcccacccctcttccaatctgtaactagatagagggggcagaaatagaagaaaagggactagcaatctatctcctccccatctgtcacctaaacaccaataaatcaacaaaagtacagaaagcctactaatatgcaaaacactaagcactaagctatagatcaagtcctaagagcaatatttctttatatcagaggcagtccctgtccttaagaaacagaaaattaaataaaggcacaaatatttaaaacaaagaaacttcacaatacaataaaaagccaccaaagatttcaaacaagtgctagagaagagctgtatcacttttaggtatagttcagagactttcctgaggataaggaatacgtgaggtaagcaggcttttaaactaggctgggctcagtggctcacgcctgtaatcctaacactttgggaggctgaggcaggtggatcacctgaggtcaggagtttgaaaccagcctggccaacatgatgaaaccctgtctctactaaaaatagaaaaattagttgggcatggtggcacgtgcctgtagtcccagctctcaggaggatgaggcaggagaattgcttgaacacaggaggcagagactgcagtgagccgagatcacaccactgcactacagctggggcaacagagcaagactccatctcaaaaacaaaaacataaataaaatattagactagacagacaacaaatcacctttttaataaactgaaacttactttaaatgagctcattatataaagaaaatttgtcttgaattcttatagaagaaaggggattcataatcttacccattttgtatgttttacttgtttaatttttatctttgttaaggcaaagcataccaacactacaataattatacaaagttaaataacctagtgtaatatattctttatccatacctgaaactaggcaaaggcagccaacctggtaagagccaggctgcatggctgaaacctccatccaaatctgcatacagctgtgctaccttttcattgagttgacttctgatttcctttccatgcaaacaatggctagctgttaaaattatgagctcagaaagagcttcaaacacatctagggagaaaaaaaagattattctcattactatttccaaaaagtgaaagaaaattgagaattaaaaacagaactcaagaagaaacaagatcctattcatatcatcaaaaaaagtctgtagacagacatgtgactatgtacaacaacaaagaggggcaataaaccaaacaatgtgaagcaccctgtccctctaaacagccaaaacagatcccagaaacacatctcaaaaccccactcatgagcacttcatcatgaaaagaataaatgtggttatttgatttccaggtcacaataacaaaagcagaaaaaaggttatttatagtgcatatgacaataataaggtacttcccaaggaatagtagccaaagatcagattatttcccaggttaaaagtaggaagatcagggccaaaatggaattactggcgatatgtaaaagaaaactataatcaccaattagtatatcccaacactggagacaaatgcaccaggcaagcataatttgatgacaactaataaaaattatccaattaatttcctgttaattccacattcactaaatgaacttccaatgatcatctggctttccaattatatttgtcaataaaaagaatatcagtaaatattctggatttcttggtgctgtaattatatgtctcacatgcattattacattggcattctaatttatacatcagtttcttgtatggttagaaaatatatcaatatcaacttaagtataccaaaaacaaagattctggaactcttacagaggccaaaggccagacccagaatatagtgacctgctgccctgggtcctgctgccctgtgggcagatgttgcttcctactatgggcacagcaattgcttctgaaggcaatacttaacttgcagcccagtataaaaactggattctcagttacaacttcatggtaatcattacataaccctcccataaatctaaggtagttttacatacactgtaatttgttttttatatactacacacatatatactctacttttctattcacagagaagtagaaatgttaggacaaacataaaacattttgcttacttttttctccactttctccccaactctcaaagtattcctttgtttctttttcaattatagaaacatgctgtttaaagtgggctatgttaaggccactttttaacattttcttctgctccaagaaaaccttcaaaaaaattcaaaacggggatacggcattaaaacacatttttgttttatcataaaatccatttaggttattataattatgtaacactaacacaagtaatggttttaaccctttgggcatttacattttaagagtctaaatgaatagatctatctgactctaaatgaatagagtctaaatgaatatatatatctgaacagagggattttccagggccctgttttttggccttaaggagaggcattcattccctcattccccatcactagaaacaagatttaatgttaactcttaactgctatactagggtactggctaatgtgtgttacattcacagccagagcccataccaagcattggggccaattgtctgatttgtgttctatatcaacttaaaacaatttcgtatttggcttttgagggtaaaacatacacatagatgtaccccacacgtgaagttgttgcattaaaagaggacttctgaagtcagcaatctctaaacagcgcttatgttagaatttcaggcaggaatgggtaggcaggaagtccttttgatgaagtaacagcattgtctaataaccctttcaaattaaatcccagtatgctaagttatcattgattccattatttgtacaggaagccctttaatattgtttagccatgacagcaaatataaaactaaatacccattacttatcagttatccatggcctttcttctcatgattcttcagacttttgaaccaaggaataaactggttctacattttattacatttttgtttggttggtttctgtgtgtgtgtgtgtgtgtgtgtgtgtgcgcgtgcgtgtgtgtgtgtgtgtttggttttttgtttctgtttttgagacagggtctcactctgttgccaaggctaaagtgcagtgttgtgatctcggctcactgcaacctccgcctcctgggttcaagcgattctcatgcctcagcctcccaagtagctggaatttacaggtgtgcaccaccagccccacccagctaatttttgtatttttagtagagacagggtttcaccatgttggccaggctggtcttgaactcctgactttgagtgatccacccaccttggcctcccaaagtgctgggattacaggaatgagccaccatgcctggctgtttctacattttaaatgtataatgtctcactattagctataactactgaggtatagatttgtctttatttatggtaacagtgtcacctactggattaggcacatcgtatgcaactcccttcccaaacacaggtgttgtcaggcgactgtagacatcttctgcattcaggtcttcatttttactattaaaaagcagtgcagcagcatcactccccagaaggtaagtaaatgtcttgcctaccatggtaaaactaaatacaggtccatactaaaaagagaaaagtacatatagtgatgttacaaaaaatatgcaacactacgacagtaactttttaaaatcacaaaataatgcattattaaaaaaataaaaacatatataaaccttaaagcaattcttttcatcttgccatactcctccttcctttgtccaaatttataattatgttcatttagttgcaaatgtagtataaatataactgtttattatgcttttttcagtttatattgacaatgttttctattgtctatataaacatcacaatgttaatttactgactactctttcattattggacatatgggtgatatgtcagggttttctttagttattacagctaattctgtgatgaacacctctgaaaatatagacttcttccccctttggttaaaaacaaattttacaagactagccaaagaatttgaccttttctatagtacctgctatgtgaagacactacaagtttatttatctattttagcactatctcacctacactaaatgacttcattttttattttatattaatttggttagatgttaaatactttcccttgcagttttctggttatgattgaagactagactctgggggtataatcatgaaaaaaaatactgtcccaactcaccaagcttagtctattggaaaaaatacaaattaatcaaataatcacattaacaaacataaaactgcaaatgtgacaagtattacagaaaggaaagcaactctgtgatgagagaatctaaaaaagggagacctaatagaggaaaagacaactaggttgagaccagaagaatgaggagctggtttggtagctaaacatacacaaaggccctaaaagtaagagaaagagaaaggaggagatgagagttgagcattaggcagtgctagaccatacagagcctcataagccattttgaggaagtttttaaacgggtgacaagaatttttcagagaaaaaggaaagatgccattgaaaaagaagtcaacaatacactgagaaaacaaataaaagtaaaaagttcctgagacaaaagagggatggagagttcagcctccgataagaggcaaaatatagttgtaataaaatcaaagtggtagaacgcagtgagccagactgtccgtgttcaaatcccagctcctccacctacttgctgtatgactttggtcctatagtcagagaacttagtctctctgtgtttcgtttctctcacctataaaatggtaataataataatagcagttcttcacagagctgctgccaaattttatatacagggcagagaagagtaccttggcttacttagcatcttaatgacttgttttccattattgttatcattaataaaagtataggctcagaaatcagaccatgtgtaaatcctggcttggccactgtctagcagtgagtccaagaagaaattatatatcctctctgcttctcagttttgtcatctataaaacaaatatacctgaaagggtttttgtggagcttcagtgagatgatctttgtaaagcactaagtactggcataaagtaagtgtttgataattattactgtgataggaagaaagagaataggattactatataaatacaagtaggtttgcatatttgaaattgagaaaatgaggaagttttctttgaatgttttaataattgtctcctaaatcaacgtttttaatcattgtctcctaaacaggagaaaaaatcatctgctttgatggagaggtagaaagattcagaagtttagaaaagtgaaggtttgaattagtcactgtaatgagtggaaaagtaggcccaatcacaagaacataataggactgtggagcagtgttcaaatatcattaaggtaggcaatcataaaatcaggaagaaactaatctggtgcagaaggagacaataactggctgcctccaagggtgacttctgccagctgaacacaatgaaaagatgcggggtcgaggaaatttaaagtacagtattgccaagagtgtaacagaaacgacatgccatggacccaaagcggaaagaggaaagtgaagaatgaaggctgatggatcaggagaaagtaaatggaatgcaagatccaatgaggtcaaagaatagttataatttaaggagttgcacaagcaaaccaggagacggtatggtctacgaataggatatctaaattaatattgtggaagtgaaacagttaagagtgacaagtccaaagcgagactgtgaagtaaatggcttaactggcacagggaagctcattagagagaagacgggcaaataattgagtagctatggtgtcatgtgggtcattcaagtggacagtgaaatcacagaagatgtatagagcaggttagaaaaccccacagatgcatggtaaagaaaaatgagggttaattaatatcaattttaatgacaataagtgaatagaaaactcagaacagtggcttttaaaccatagttgccagaactacaggtttcctcaatggtgtctcaaagacgaccccaggacatgggaaaagctaaaaggataggtatctataagacaccatctcttaaaccagagcagtttccattttgtttcctatactgaggatatgtatatgattacaatgtttttaaatgttctgccacttttttaaaaaagtttaaaaagcacttctctagttgtttttttttttttcctctaattatttggaagacttaccttctcatatgcattttctagaaattcaattggacttttcccaaatgctatggcatgcccaaggaatggaattggggagaaaatgtatggaggacttttctacaagagaaaaaaatagtaaattcaattcgtgtttcatttcaagagagaaacccagtttcgtttcatgaccaaacaattaaacaaaatagctattaagacttcaaaaaaaagttaccaaaaaaaaaggaagcatcagaagtaacttgagaacagccaaattgcaaatacctcaagagagtagctattgtagaaaagaacagaaactcaaaacacggtataagataaacgaccagataaacactaaggcactgtaaatttaaatgatggacactgtccagaatatgtccaattattattggtgtctccaggcaacttttctaaccattagtagcaaaaaaccaaaaaggtcaaactacacttgtcccttggcatttgtggagaactggtcccaggaccccctcacagatttgtatccagggatcctcaagtcccttatataaaatggcaaagtatttgcgtataacctatgcacatcctctcatataccttaaaccatttctatattacttacaatacccaatacaatgtaaaggctatataaactgttattaaactgtgtttttttatttgtattattttttattgttgtgttattttgtattgggtttttttcccctgggtattttagatctacacttggctgaattcccaaatgtggaattcgtgtccccagagggcccactatattgtttcttcactacttactactactactactcacaattttagtcccagatacttgcttaaagaaggtatagaaaaagacaagcagtaacttgtagtatagaaagaagggaaatgtttaagaagctatatttacttctcagtaaacaatcaatctcatgcttctctcactgcaagtgaactagagccactgattttagagtttttaagagagtagatcagctctagcaagaactctagcattcttcataaaagtttctttagatgccacaaaatgagacctgcagattacaacattaagtatcctgaaaatcaaacaaaataatgaaaaagggtaatactcctcaattctctggtggtctcaaatagaaaggagcaccacaacctcacagtacacctcagctaatagaactatctttaaacactaaaagtaactttgtcttcccagagacaaatatcatttccttaaagatcccatgtgtaggaaaaaaataaataaataaataactctttcttatgcctggtatggttcaaacaaaaattattttaaaagctacttggtcaaaagtttgtacattgcattgtcagtaaaagggtagttttcaaaagctacttattgctgactgtaaaaggcacaatcaaataacatttgggagattgaaagctaggttaataaggctgttaaattgaagaaaatgattttttttttttttgagacggagtctcattctgtcgcccagactggagtccagtggcgcaatctcggtttactgcaacctccgcctcctaggttcaagtgattctcgggcctcagcttcccaagcagctgggactacaggcgtgtgccaccacatccagctaatttttgttttgttttgttgtattttagtagagatggggtttctccatgttgttcaggctggtctggaactcctgacctcaggtgatccgcccgcttcggcctcccgaagtgctgggattacaggcgtgagccactgctcccggccgagaaactgttacattattagcatcagaggaaggcccttaccacactccagtcactaccattaccacactctacacatcctccttaatatgggtataaaccaccattaggggcactgctacagcccacagaacactgaaccacacagggcagcctccaggatgacgggccagctgccaacagcatctccgtcaggacccccaccaagggccccaacgaccaccgggtcgttcaaacccacagccgccaatccagccaccgccactaggggcaccactgctgcggtcagtacagaccgctacaaccacaaatgccgcaaccacgaccccgtctaggatcagatacacagccggggaggccagcaccgccccccaacacaaggcaatggcgggtgctacagccagcgccaccagcagcagtgccgccgccgcagccactactccagcccccagcgcgcctgccaccaaagccacgccaagcatggccgcagtcgcccccgcccttgccatccactgagccggtcggggccacggagccgcccacgccagcccttcggccgcctcagctgcggcgcgcgccccactcagaccctaaagaatgtacgtaccacccctgcgggcagctggaccaggtggccggcggccagacggatcaggtagaccaggctgagggtgaaggcgcaggcgatcagcagcatggacaagaggttgccgcctgtcaccttctccatcgcctggcccagcaccgacccacccgcctgcagcaagcccagcagcagcatcccagccgccgccgccattcactccgtcggaaacactgaaggccgaggtcgccaccgctcctcccaatcgacggaacgagagaagctggcagatggtcgtccacagggggccttgccccaggtctcctactaaacccagccccacccctcgggtcccacgcgcgccaccccgtgcgtcacagaatggggcgggatgttccgctggccacgccccttaaataacactctgtgaagccgtggtcttcttgcgcgggatagggcacctgaggaagcgggctgcgcctgtggcacagtggtacggggccggaagataacttacctgaagaggcgatcaatccctgagaatcgcgggcgacccgttttttgtgtgcccgggtgcggggtgccgggacacggcgttgaaggcgctgagcggagggatctcagggcgagctcgagcggcgacggcgcgctctgtgattgcaccgcgagcgcctgaggtgatctcggcctacatcgcgtcagcggggccttgggcgtgagcaccgccccctgtccggacgcagggtactggggcacctcgaactgtggcacctcacccttctccggggccacgtcttggggactccgacagccccaaataagccctcggggactggggttgtgaaaagcgaggtcgtgaagacgccggcctcataccgaagggtaggacggtgaggtcagccccgtcccactccaactaaaatcaacctgacaggtattaatatgccaccatgaagttaacaaatgttggtgattaagtatgctaggttttacgaaaacagattttccaaaataaatgtacatgttttaggacgtcgcgagccgtttgaggcagcattccccaaggacgccacttagtctgtaggtttagcggctagaaagattcagaagctgagttcagtcctgccgccacaatcaatcttcgctcctatggcttcacagaagcgtctcccatgactaccaaatttaactccttccagatcacccacgggagcacctgaccggattcatttatttaatcaatgttaagaactaggttttgtgctaagctaggggatagagcagcgaatgagacaaaactgcaaggccctgggggaattagtaggaatatccagtgaaagggaaattaatgaattttataagtatactaatcaagaagtatattcttttcctttgaggtagaatgtaatatagcacctcccctacccaaggcctgggttaagagtatattaactgcttatttctcccctatgcgtggagaggcttatctgtgttccatcgtttcacattccttgaggcacagcgagttcttgcttccctccctagcgctgctgtaaagtcacaaaactgattagcaagtgttacaaaagcatgtattcccaaggacgtaagacatatggtgtaacaaatgtaagagtaatttactgcctttgttcttgcttctgcaagtacacttcatgcaacacgtaactcccaacacaaactgcttaaaaggtgattgatccctttgttcggggctcagactttctggaccctagtccgactgagccggtgatcaccttaataataaaggctctcctgaactctgctcggtctctcccgtctatgatttgtcccgcaacaccagttgcctgcggaacacctctacctagagagctaacactcatccccggtcagtaaatccaaaactaaacccgttgcctcctcctaccaacctgtccctcctataatgcctgtgaagaaaaggcatcactgtgcacactgttgccctctccatgcttcatctaatcagtcatcagatcctataattctaccaccttaaaagtttcaccgtttcttccgtccagtcgcggtggctcacgcctgtaatccctgcactttgggaggccgaggcgggaggatcacctgaggtcaagagttcgagaccagcctcaccaacatgatgaaacctcgtctctactaaaaatacaaaatattagccggacgtggtggcagacgcctttaatcccagctactcgggaggctgaggcaggagaatcacttgaacctgggaggcaaaggttgcagtgagccgagattgcgtcactgtactccagcctgggcaacaagagcaaaactctgtctcaaaaaaaaaaaaaaaaaaaagaaagaaactgtgatatatataaatatatatttatatatttatatatggaatggaatgctacgtggtcacaaaaaggaatgaatgaatggcattttcagcaacctggatgggattgaagactattattctaagtgaagtaactcaggaatggaaaacaaaacatcatatgttctcactcctaagtgagagctaagctatgaggatgcaaaggcataagaatgacacaatggactatggggactcagggaaagggtggaagggggtgagggataaaagattacaaattgggttcagtgtatactactcggcgatggttgcaccaaaatctcacaaatcaccactaaagaacttactcatgtaaccaaataccacatttcttaaaaccctatggaaataaaaaattaaaaaagaaaaaagaacccaacagtcttctattaagccaggtgtaaaagagatttacaaaaatctaaaactatgccattcttctcactaatattttatttttgaaaatatagctataggccgggtgcggtggcttactcctgtaatcccaccactttgggaggccctggtgggtagatcacaagttcaggagtttgagaccagcctgaccaacatggtgaaacaccatctctactaaaaatacaaaaattagccaggcatggtggcgcgtgcctgtaatcccagctactcaggaggctgaggcaggagaatcgcttgaactcgcaaggtggaggttgcagtgagccgagattgtgccactgcactccagcctgagtgacagagcaagacaccgtctcgaaaaaaaaaaaaaagaaaatatagctatattcatgaaatgacattatttatgtaaataattattttcaataaacattttcatttattttaatttgtaatactgtaagttttgatagatataatccatttaaaaaaatgactctctagggttcttaataatttattattttaagtcctaatgtaaccacccaaggggttcaccttgcctgctgcctagacagagccaattcatcaaggcaggggagttgcaataaagtaattcacgcagagccagctgtgtgggagactggagttttattactcaaatcagtctccctgagcatttggagagcagagtttttaaggataacttggtgggtgggagttggggggtagccagtgagccaggtgtggtgattggtcaggggtgaaatcacagggagttgaagctgtcttcctgccttcagtcagttcctgagtggaggccacaacatcagataagccagtttattagtcggtggtgccagctgatccatcaagtgcagggtctgcaaaatatctcaaacactgatcttaagagcagtttagggagggtcagaatcttacagcctccagctgcatgactcctaagtcataatttttaatcctgtggctaatgttagtatagttcccaggcaagaaggaggcctgttttgagaaagggctgttactgtctttgtttaaactataaactacaaactaagttagtttctcccaaagttcgttcagcctacacccaggaatgaacaaagacagcttggaggttagaagcaagatggagtctggctgggcatggtggctcacacctgtaatctcaacattttgggaggccgaggtgggtggatcatttgaggtcaggagtttgaaaccagcctggccaacatggggaaaccccatctcttctaaaaatacaaaaattagctgggcgtggtggtgggcgcctgtaataccagctactgaggaggctgaggcaggagaatcacttgaacctgggaggcagaggttgcagtgagccgagatagcaccactgcactccagcctgggcaacacagtgagactctgtctcaataaaaataaaaataaaaaaataagcaagatggagttggttaagttaaatctctttcattgtctcagtcataattttgcaaaggcggtttcaggttcccttcatagacacagagcagttgtcctgtctgaagtttacctctctgctgctcctcagtgaatgggctttctttaatccctccccattaaaaaaaaaaaaagtcccattcccttgcaggaaaactgtaatgcctacccacagggattggtctccctctggcatccacagcccaccccacaacactccaaaccccaactctacctttcac

SEQ ID NO: 516 - DNA, 20331 bp, Homo sapiens
tacaaatacctgtctggttgatatgtgggatctagaaactattttaacttgtctgctggggcaggggtgtgtgggcggtgacaagtacttaagatagagtctgattcttcagagctcacagttagatgcccaaagtcgctaaagtcatgggattgtaagctgccgggaagggatgcggagaagagggaagcatgtccccaggatgaagggcggaggatgaggcagcacgcagaccccaatttcctattgctgctcctccccctccactgttctccccctcatacaatgtgggtggtcacagcagtgtctggagaaggggctgaagtgccatgctgggggaagggtgcttaatgacctacacaagccttgatccaaacgctcacttagagacaagcttcttgagcagcaagctcgggctcctgcacagttctttgcacgggactaataagaccttccaagtgatgacctactagattagttgtcctgggaccccacaggatcatagccactagaagcaaaggtggggggcttagcactagtcacatttggagatacagagacagcccctcaaatcatccaggcccaggcttcccaccgtgtcattctcacaccaacttcatgaattctgcatctctaagcgccacctgtgcaaccacacaggcttctcctcacccaccccaccctgactgcctgtcacacctccggcagacaggttcccggctgcgggaacccaggatcaaggcaggggacagcagagaagggactttccaccctgaaatattcagcaggtcctggtgccagctggtgagcagccgggccctggggctctgtggggctgggccccacccaggctgctgctggagcaggagtcctagtggcctcttgggagcagagatgatgtccccagagagacaggtacatggccaggactccagctgagagctgccttggccggtgctgacctaggtctcacctccacagctcctagaagtcccaggcacaagcacctgcctatcctgccctgtcctcaaggtgtttttatgttcattattgcattcaaacccagaacgtccctgtgaaatggaggccacagcgccatgcctcctgggtcttccatggcaccatcctacttcttcatgtctttgggcctcaagttctcctcttccaaaaggagagatagggagaacagcacaataaccacagtggaaggaactggggggtgtctaggccagagaagacggagcagtttgctgtgtgcatgcacacgtgtgtatacatgcatgcatgtgtgcgtgtgttggagttttggaggacaccagattcaagctaataattgaaagccgagctaataactggaaggaacaactgcagctcaacggcagggaggcttttttcacatttctctgttattgtcttctgcaaccctcacctctcccccaaaccactgcaccccaagcataccaaattacttttactcccctgagcacgctgcatttgctctccttctagcctctgtcccagttgtccctgcctagaccactctgagcccccttgttcctcccctgagtagctctccctaggcagcctcccctctctcctcaacctaggtggggtgccctcctgcatgccccagagctcctttactgccccaccagaacactgtgcatggagggtgccaactcatcccataggaggagggttccctaaggccctgccaccctgggactcacttgcaggaggtctactgaaccctagtccatggcaacaagaaaccacagatcagccaggcagaaggcatggcccaggagcactggaccaaggtccaaagatctgcaccctaggtcctggcctctctgatcttccagggcctggcctgtccacttggatcatctagaatcctgcagttcaaatgcctttcaggaagtagctctagtatgactacacataggaaatggggaacagtgaaagttccaccttggatttttgcccataatcagtaacattttctcctcctggtcagagaggccacttgtacacacagtatactcctcagtggctgtgaggaaggccacagctaggacttctctgagggtactgatcctataacatcctgtgctcttcagaaactgtgaatatcctataagcccaggttcactgggggcagtcatgatgtcaaggatggatggagttttattattactgaattcaaccattccgtaaggggaacatgaggcccaaagacctcacagacagcttctgtctgtgcattctgtggccagtagttctgggttggagtaagggacaacggggcccagtcccatgattttcttcaagatccccaagtttcttctccctgccaatcccatcgtcacactgactgcatggctttctccaacgccagccaacagacagcaccctcaggcaaaccccaacagagtagagtggggttttttgttttttgagacttgctctgtagcccaggctggagtgcagtggcatgatctcagctcatcacagcctcaatctcctgggatcaggtgagtttcccaccttagcctcctaagcagctgggactacaagtacatgccacctttgtattttttctagagacagggttctgccatattgtccaggctggtgtcgaaatcctgcgctcaagtgatctgctcacttcagcctcccaaagtgctgggattataggtgagagtcaccgtgcccagcctcaacagagcacagtcgaggtcagaatcctacctctgaccatggccagaacctagtctcagccacatgggagtaaaagttctcaggtgcctccaattctattgcccggcagaacagtcagacatgagagactgaggttagagtctcccaagccaaggaaattcaatcccaaatgggtgtgacagagaacatttctatatccagagcagagaagtcaacaaggatgtctttctacctgtcaagtatccatttcccttcgtcaggccaaacagttcaggtgggaccaactccacctccttgctccaagaaagaacaggttactcaggcacagccaatgagaaccagacctgggccttcccctggaatcactgggcatgagttatgttgttttctccctgggctgccaagacagcagaatggaagcctggagctgctgatgactaccatgccaatgcaaggaagaacctacccaagaatgaagccaccggaagaagcccagctcacacaggcagaatcttgacactatcatttggaaacccctggattcaaccagacctgaagccctgggcctctctgtcagataagccaatacacatccttttctgcttaggatattgtgggttatattacattatggtgacctgcatctgaagagccatgacttgtaacaggagcaagcaaagcctaagaacctttcctccttttttcaagctgaaggtaccaggggtctctgtagcaggcctagtggctccaggaggatcccaggcccagagaaggctgagtaccaccttcaggaaagagaggccccttacctgtgctggtttggccatggtctccggttcgcagcagaatccactgtagagaagaaagacagcatgtgagattccccccaactctaaccatcccctttctttcccttacatttcctccctctgctgttttccagctgcccccagcccttcaggttaaatcagacccaatgacccagctcaaggccaatcacatttttttcagaagacaatggacagactagatggtgtccagacattcacagcagtatgggaaagggacgcggatccccaagggagggcgggcatggcactgacccaccactgaccccttgactcctccacactaggcagggtacctgtctcagcaccgtctcagttactactctcagaaatccttccacacatcagattctccttttttatagagaggaaactgaggctggagcatcgcaataaatgagccaagatcacacagcttagaactgaattcaacaatttctagatcccagagtctatactatctgcaccatgcatgcccccttttcaagtcaacaaggatggcttcagaacccagagcttgaccgcctgcagataggactcaaagtgcttccaaccacctgctgcaatatctgaaggactgtcattcctgaacaagtgagtatgcactcatttagcgcctatcctagtcaggcattgctctgggcactgtgcatgcagaaatatgagcaattttttaaattctgtttctctagagcttatgctgtaatgggaatgaataacaaatgcactcatcaggctgagataagaactacagagaaaagacaaggcttggtcaggaaagtgacaaggggtgtagtcccaggtggaggggtcagaggatctcacgagtgtgactggggcacaccgcggggtggtgcaagtgaggaaccaccacgagctcagtgtggctggtgtggtagcagggagtggtgtggtaggatgtaggatctgagaccggtgcctgaggccactgtaaagactggatttttcaggctggtcgtggtagctcatgcctataattctggcactttgggaagctgaggtgggaggataatttgagcccaggagttcgagaccagcctaggtaacatagtgagacccgatctctattaaaaaaaaataaaaaaaaaatagctggacatggtggcacatgcctatagtcccagctacttgggaggctgaggcgagaggattgcttgaactcaggaggtggaggctgcagtgagccaaggttgcaccactgcactccagcctgggtgacagggcaagccctgtctcaaaaaaaaaaaaaaaaaaaaaaagacaggaacacacaggaaaacaggacacatatctcattgaaaatggataaggaatgcgggtggaggatatcaggagacagggtctacagtgaaggaacaaagatatgatacgtaaaaataaatgcaaaaagagatgtaactgatttgggaagtataagagaagcaggtagggagctggctaatgagcactcaggagggcaacagatgaaagtttaacaatcttcttaagagaaggagaagagaaacaaaggaccactactttccactttaagcaggtctgggcaatttgatctcttttttttgagatggagtctcgctctgttacccaggctggagtgcagtggcgcaatctcagctccctgcaacctccacctcccgggttcaagcgattctcctgcctcagcctcctgagtagctgggattacaggtgcacggcaccacacctggctaattttcgtatttttagtagagatgggtttcaccatgttggccaggctggtctcgaactcctgcccttgtgatctgccctcctcagtctctcaaagtgctgggattataggcgtgagccaccaagcctggcctgatctcttttaacaatgtctatgtattgctttttaaaagtgaacataacagaggccaggagcagtggctcatgcctgtaatcccagcactttgggaggccaagcggcaaggaccacctggggccagaagtttgagaccagcctggccaacatgcgaaaccccgtctctacgaaaaaatacaaaaattagccaggtgtgatggtgtgtgcctgtagtcccagctagtcaggaggccgaggcaggtgaatcgcttgagctgggaggcagaggttgcagtgagcagagatggcaccactgcactccaggctaggcaacagagtgagactctgactcaaaaaaaaaaaaaaaagtaaacataacaaagtcaatcagatttacccagtaagacctaaaaggaacagaactaggagagtagaaatcatggagacatttcagctcaatgccttccagttctccacatattccctgttcccccaagacttagggaaaatcttagccatgtgaccgtgggcttattgctcatttttgagttcaaggtgatctcaagcacaaaactgaagctttcccttttctgctttgtagggttgttggaggataagacctaagttatgtcaaaggcagcacataagaggccaggcacaagacctgttcttagtaaatggtgatatttactgtgctggtgggaagttgaggacagggcctctgtcgtgtttgcctctgtgtcttcactggctgattatgagttccccaagctgcagtcagctgaggacagtcatcatatggggttgggagtggaaggcagaggacggatctgcctgcaaatgcagctcagctcagctcagcttcaggaaaccttgctgtttccctggcaaccaggggccccttggtacaactgtgcagctctcaccaggaaatggaaactgtaccccctttccagtgtgtggtggggggaggagggggcccacatctaccccgggatgaggctggaggccagctctcggtttcctctgacctgggggatagtagggggagacagtgaaggaagcccaaggctagcagagaaccagggactgaatgagacccaggaagttagttgacacagacagagggagggctgaggcctgtcacctgcatctccagccttgaagcactttcctctgggcttgttgctggcaatttcagctgctggctgcagcccaggcccatctggaggagctcccctttccaaggagagatggcttcaaggaggggcctcttactgtttgggaaaatattctcagctctgagagcagtttctgtgtgccttgtgtgagtgcacagttcatatgtaaaaagcaagctccttccagaactagatgttcagactgcagttctgagggccagtccccctgctgattccacagccccgcctctgagggttctgggaagctcctgagctaatcataaacacaccatttaccctggctttaagatggcttctgatccctcccagagcaacctagaccatactgctcaaattggctgaatattttacatctagtgtttctgaatcccacaagggcccttaataatccatgactccaagtccctcattttctagacggggtaaaggcatctcagaaagagaaagtgacttgccagggcccaggaagcagccaacatctctgcctagcagccctcgatcataacaagtccccacacaactgtgggtcttggctgcaatgggacaccaggaagagtccaaagaataagaccctggttctggttcccagtctgcccccatgtaacctcaggcaagccagatccctctctcagccttagtttcttcatctctaaagtgggacaatacatcactccctctttggtaggatctatagttagaggcttttagagacttcaactcaggattttcacagcagaatatcagtcctaggagggtcatctcccaggccacaggattcctccccatctccacccgccaatatgcaacattcatcaccttggttgaaagagctgttcaagactagtaaacagggtcattccagacctgtgcctctttcctcccaggaaccctgattctctcagatctagatgagatatactgtgacgacttatcatgactgatcattcgtgaaacccacacaggagcagaatgaatggcctgggtggctttgtgctgctgtggccaccccttgcctcatccttttgcctgcaatcaatcacgttttcctccttccccttcgagagttccaggctgactctagaaggaacggctcaccactgcccaaccacagagatgtggataggggaagggttttatccaagtcatgtgaaggcatgggccttcaggcacagatgttgcccagcagtttgtgatgtaagtaagttacttaaactgaatctcaatttccacatccgcaaaatgcagatagaaatacctataggtactgagaaataaatgaagtaacggggggaaaacacttagcacagtgcgtggcacacagtaaaggctcaataaatggtggcttttattataataagcccaaacatttacaatggaggcaatgtggcattagaatcaatgcaggatttgtggtcgatgcccaagttcaaatcctgaccatgcaaattccgagctcagtaacttgggcaagttatggaatttctctgcctcagtttcttcatcctgaaatgaccctcttgtaaggtttttgtgaagattcaatgaaataaggcaggtaaaacacttagcatggccaggtacagattaaatgtttaacaaacggtgacttctgttgccacaatcatcattattacagcagtagtctccaaaaaggggtaatgggtatgacaatccactggggtgcaggacaagagtatcaccactttccaaatgttttaatcttgcccttttatgtcccatttttatttgttatacatgtataaagttaaagaaaatattaggggtgcaggctgatagaggtgcacagtcaaaatctggattcaatggaatggaggcaggggcatgccaggaagaatagtaacaccagggtaagaaaaagcatttctgtcatcgaaaggtagcttgggctgtggaggaacagagtacacttttgagggaaaggagatgttgagcgtaagggggtgaaaccaggtgtggtgggagggtgatttgagaaaaaagaaataatatggaaaatcatgcaaaaaaacccacccagacctctgcctcaggggagtgcctgaggggctacagcctgagccacagcactcctctgctcacaagtctccaatggtgccccttaatactgggcctctaagctcagcagtcgaggccattggttctccttactgacttctttgccatcaccactttcctctttgccctgtcttccctgctaaaccaggaacgccttccaccaacatttttaatccagctttccagaatctataccagtgcttttcaattctagcttcactaacagaacctggggaatttttcaaaactaccaaagatttaaggtcagcccttagagattctgactcaactgctggggtgaggcctggcctttggtaatttctaaaaactttcctaggtgattttaatggcagccaaggaggctgagaaccactgttatctgctggattcaaatgccgccttttctaacaagccagaaggtattcccccgctagggtgctctgaaaccaccttgatttgactggctttggtcaaccactgtggatttatcatttctccattagataagggctgccagcctccaaggtattatgggaaagaatctgtacttcaaaggaaaaccctccaggttgtctgactcgagactttcattgtctttgagtgattttacaggtcagtaagttgcaaataattgatggtaacacaaagtaattctaatacatactccttgccctattttgtaaaggtccaattgatttcccaccccctcaggtaaaaaaagagttttgtctctaattgcacatttctttcaatacaaatgtgtcttttgagctggttataacatcggcctggtgtggtcattgattaataagtagaacagcacatgatcatttttgtatctgcatgagtcataattttacactttttagaaaattactgcatatgcctctttcctgcaccccctcccatagggcgtggctcctatggatggttgggggtaaaatgcactaagtggctttcatgctttctttagtgacctcagcaaatggaaccatctactattggttttcaaactgtgctttactcctctttctatagccaggagataaactagagaggttaagtcacttacccaacatcagaagaaaatcagtcatcaagcaggggcgtgtttttccataaacatttatttgagcacctcctacaaaccaggcccactggtagaagttgggggttgaacagaaaatgagacagacaaggctcctggccccacaaagctggtgataaggtgatgtcatatggcagtttgcagtatatatatatatatatatatatatatatatatatattgatcccatacacaacccataaccaaagaaaaattgagtatttaccatgataaacagaaatatacctttaaaatatgacattaaaagtacatttaataaggagtccaatagtttcttcctgtacccccaaaagatcatcttcagtgcgtcctggggtatatccatcccacttagaaggcccctggcctataaaatctagatccttccctctttgccctttcttgctggcttctcccccggtctgcaggaagacacccaggacccgctccataaccctccaggagccttgattctgatgaagctggggtaaatgccttccctggctctgtgcgtgggcacaccccccagcttgacgactggggtttcttagggagcagtgtcttttcctctcctgacccagaaccattgatcctaggactggacaaggcctcaggagatcatctctctgcctcaggattggaactagtctagcctaggtttgaaccccagcttgggtcacttttgtgagaggcagcaaagtagtgtctcacagtatagatgctggagccagactgcctgagattgaagcctgagggtgatatttagtagctgtgtggtgttgtgcaagtattgagcctctctgtgcctgtttcatattaaaaaaaaaaaaaagggataaaaatagcacctccctcataggagttatgatgaggataaaaaaaattaagacaagtctagagcttagaagaggacctggcacacaggaagcactatattttataagcatttgtcattattatttcttccttaaactgttaagggctggagtttccatgtctgcaaaataggcattaataacagcgtctaacatagcaaggcttcagccggggcctggcaaatttaagggttcgagaggtaatagtggttaccattttattgctattatttaaggaccaccaggacatggatttttcagaagaggaacttgaggctcaggtcgcctgccttctcaagcaccacacccttttgagataacacagcacttttatatctgccatcttacagcctcatgaaggtatcgatctcattctcattttgcagataggcaggacatccaaggaacctatagacagtcactcccccatagccagtctctgtgggggcttctcaactccaggaggaaagggagtgaggctggattccaaggcaagtttataggcataaagacacccctccgacttcctcccctctattggcaggagaaggggtgcatgcatgctcaggaatcacggtagagaccacatcctgtgctttgtcgccacccaggaagtatatcggagaggctgggtggggtgaggctggtgattccactgggcctccccagaaaatcctagaatggtagagcaaaagccattcagacccaacccattttattaataccagtggggtgtcctgggtatatgtcctatccctgtagagaggaaggggctaagccccagaggggtagtaggtgtgcccagggcgcctagctgattagtggcagggcaggggctgggtccgaggctggatcctggtggcccagggctccctctggatgctgcagtgcggatgtgccagtcactggcagctatccagcactgcagtctcccccacttcatcccaggagtcagtctcaagaggccaggccttgggcttccctggcccctcctctgcacactcacatctacattttgccccagcaacagctgtggcccttatccagaaactgcaagtattttctgtatctcagcagatgctgccttaggaacaaagggtagataaggcaaagaaagatggatgagtgattgtcacagctgcagagggggatgaaagcctctgcctcctgccctccccagtcccatccaactcccagaatcctaaatcttagaacagttgaatcctagaatgtctgcactggcagtggcagccagttcagcagactttgctccagatggggcacaaagccttagagaaagggcttgctcaagaagtcccagcacatccggactgtaaccgggctttcctctgaccccaggccagtgccctcggcgtggctcagggcctgcctgctaggaggtcagggtccacaggggctgaaactggggcggtcattcacttcaccatgaagggctacgcaggtcaggatatgccatctgggtcagtggaagcaatcccaagcatgttttgggcaagggggaaggaataatggagggaaaagggcggactcttggggggaaaccagagtcctttcacaaacccgggagccatatgtccaaatttggaattgtcagagaagacccactagaatctagggaaaggaaggaggaggcaggaagccgtggccagattagttgtcccaaaggacctcctgccctttccccttgtagggcctacaagggttgtgccaggcttcccaaatctataatcaagactcccaaacctgcaatcattccatacagctgacaaataaatcagttttcaaagccattgtttcctttgaaagagactgggtttctcaactatggacttggagaaggaaatccaggctcagagagggaaagccaccgcccaaagtcacactgcaacaggggctgggattccgattcagggtattttgctcccatgctggtatatggggaattatttgaagcccccaaactttgggaaggcctagaccgcttaggggatgcagaaagaagggtagtgcccctgcctcaccataggaggcctcggagccccgttgggagactgcattcatagacaagcagtggcccaaaggggatggggtccaatgaggccctgaggtatgtacgaccggacgttcagctctctgcacgcaggcagccctcccccgacaccacacacaagccattttataagcagctggagggtccaacgctcttgctctcagtcttgggcctcagccacacccttctctgcgggtcctttgactggcgtccagctgaccccaaccccggaccttcaaagtctcttgagcccccccaaattaaggccggcaggaccagcccctggctcagctccggcgcccaggaccctcaaccagaccctctgcagcaacgggactccctcccctccccctagccagggcgccctccgcccgcgcctctccgccccgaccccagatttgctccgctgcgctccccagacacacccagtctgcgacactctcgggttaccgcgccctcccgtccctgctcctggcggggggtacccatcagccgatgactgggcgcttatttcttgtgtccctgcagcccccgggaaggggttcccagagcgactcccctctccagcctcagcccactcaccgcgcagcggaggcctcgggtcgcagacggacgcacgggcgcagggactcgaggacgcagcgctcgctggatcggagcccgttagcccagcagcaaccgcagcgcggggcggaccgggaggacagccgtgggctccgagccggacacgtggcgcgcagaggccaatccggcgcgcccgcctccctcctccaccccacccctctagctccttagctcttggaatcttagaatgtcactagcccgaggggcttgccgggagaacctcctcagtttccagcccccggatctgagactgagaaggattaggggctttggccaaggtcacgcggcccttcagggctagaagtcagggctcctgactccgggttctggacactttcccgcaaattcttataagtcgccaaagctttgttgagaaacagaaaattgaggtttgccaggggcactttatctgcctgatcagattccatgcctcaacagcctcattaggtcggtgacattatttacccactttcaggaggagagcccagtccagttcctggaccaaggtcacacaaatagtgggttgcggaggcaagcttcttcgtgctctgggaagcagggaaggcaggcagggagaccagcagttgtaatccagcgctagaacaggaaaaattgataaactgagaatacagaggaaactgagaattattgtccccaggggattggtaaggagaagatgaggaagttagaagaattggacagatacctgcggaaagtgttccaggcagaggaaactgctggagcaaatgctcctagcaggaggccacctggcgcctccgaggatcagcaggggggccagtgtggctggaatggagtgagtgggagggagaggagagataagagggacccaatcaggtgggacctccggggcccttgaaggcacgctgtcttttactctgagtcaactggggatccattgcaggatattgagcaaagaaagggtattatttttgggtagatgaaatccacacaacataaaattaaccattttaaagtcaacaattcagtggcattttgtacagacacaatgttgtgtatccaccacctctatctagttccaaaatattctcttcacggaaaaataaaacagtatacccactgagcagtcactcctaactttcccttacccctcgtctctggcaaccaccaatttgctttctgcttctgcggatgtgcctattctggatatttcatatacatggaatcacatgagatgcaacccttcttgtctgacttctttcatgtggcattttgtttgtttgtttttgttgttgttttttcactcttgtcgcccaggctggagtgcagtggcgtgatctctgctcaccacaacttctgcctcctgggttcaagcaattctcctgcctcagcctcccgagtagttgggattacaggcatgcgccaccacacccagctaattctgtatttttagtagagacggggtttttccatgttggtcaggttggtcttgaactcccgacctcaggtgatccacctgcctcggcctcccaaagtgctgggattacaggcgtgagccaccgtgcctggcctcatgtggcatgtttttgaagttcatccacactgtagcatgtatcagcactccattcctttttttttttagtttcagttggagttttgctcttgttgccaaggctggagtgcaatggcgtgatctcggctcactgcaacctccacctctcagattcaaggaattctcctgcctcagccttccgagcagctgggattacaggcatgcaccaccacgtgtggctaatttatttttgtatttagtagagatggggttttaccatgttagttaggctggtctcgaactcctgacctcaggtgatccacccgcctttgcctcccaaagtgctgggattacaggcatgcgccaccgtgtccggtccagcactccattccttttaatggctgaataattttccgttgtataagtacactataatttgtttatccatccatctgttgatggatagtgcattgtttcccccttttgctgattgtgaatagtgctgctaatgaacatttgcatacaaatacttatttgagtacctgttttcaattgtcgttgtgtatttacctaggaatgaaactgctgggtcatatagtaattctacatttaagtttttgaggaactgccaaacattttttcagagtggctgcaacattttatattcccatcagccatgtcatgtatgaggcttttaatttctccatgtccttgccaacacttgtattttattttttaaaaatttgtacccggccaggcacagtggctcatgcctgtaatgccagtactttgggagggccgaggtgggtgaattgcttgagcccacgagtttgagaccagcctggacaacatgacgaaaccgcatctctacaaaaaattaaccaggggtagtggcacatgcctgcaatcccagctactggagaggctgaggtgggatgatcccttgaagctggaaggtagaggctgcagtgagccgtgattgcaccactgcactccagcctgggcgacagagtgagaacttgtctcaaaaaaacaaaagtacaaaaaacttgtgctctagtcattatgaaatggcatctataattgtgtttttgatttgcatttcccttctgactaatgatgtggagtatcttttttgtgtgctcattggccactatttgtacatcttctttggaaaaatatctaatcatgctttttgctcatttttaaattggattttttgtcttttttgttgttaagttatatgagttctttttatattctggataagacttttgtgtttgtttgagacagaggctcgttctgttgcccaggctggagtgcagtggtgccatgtcggctcactgcaaccttcacctcgtgggttcaagcaattctttccgcctcagcctcccaaatagctgggattacaggcacctgctaccatgcccagttaatttttgtatttttttagtagagacggggattcatcatgttggccaggttggtcttgaactcctgacctcaggtgatccacctgccttggcctcccaaagtgctgggattacaggtgtgagccaccgcacctggccaagacatattttttaaagggtcactgaagtctcctgtgttggaaatactgaatactgttgggggaagagtagaagaaggggatctgctaggagattttgcagtaatccaggcaagagacaggctggtataaatgcaggtgggggaagtggttggagatgggatgtatttgaaggttgaacatgatttccgaaggatcaggtgggagatgagaaagagtcaagaatggcttcagggatcctggcctgagccactggaaggatggagttaccatcaactgaaatgagcaagactgcagggaaagcaattttgggaattagaagtggggaaaagatcaggagttcagtttttgaccagtttgttgaacatttctattagacacccaacaggagatgtcaagtacgcagttggctagtcaagtctggagttcaagagatgagatccttaagggagaagagaactaaatatggagtcctagttcggcaaaaggagtcaggctggcaggaccaagggaaagcaaaaagagaaagcagataagctataagtctgcctttcttcatggcccaggatgcatagccctcctgtgcgaataactcacaatcttatctgcgcccagctattgccagaccctcacctgatagaaaaatgcacgcaagctccctgcacccttgatgttatcagtactgcacaaagccctcttcagcacacagcacaagcaccatcctataaaatccttagccagattttgttttcttgcagttagcttctgttttgctaacttgcccgttgcacccttgcaacgtattttcttttcttttctgtttttcttttgagatgaagtctcactctgtcgcccagactgtagtgcagtggcactatctcgactcaccacaacctccgcctcccgggttcaagcgattcttctgccttaggctcctgagtagctgggattacaggtgcgtgccaccacacctggctaatatttgtatttttagtagagatgggttttcaccatgttgatcaggctggtctcaaactcctgacctcgtgatccacctcggcttcccaaagtgctgggattataggcatgagccaccacgtctggcagcaatgtattttcatactttctctaataaatctgcctttctttacctacaactgccttggtaaattcttcttactgcctgtaccgccagccccaaatagttgctgatcacccacgatgctaaggaccgagtctgagacactcttatgttaccatttggggagaggccggacccggtggctcatgcctgtaattccagcactttgggaggctgaggtgggtggatcacttgaggccaggagttcaagaccagcctgaccaacatagttaaaccccatctctactaaaaatacaaaaagttagctggacgtggtggtgcatgctgtaatcccagctacttgggaggctgaggcaggagaatcactcccaggaggtggagattgcagtgagatggcaccattgcactccagcctgagagacagagtgagactctcaaaaaataaaataaaagagttggggagaagaaaagaattcagcaaaggtgactgggaaggagattgtagtaagatgggaggaaactaccccaggagaatgtggcagcaaagtgaaaaataagggagtgatcaggtgtgtcaaatgctgcttttaggtaaagtaggacaaggtctacaaatctatcattgggtttagcaatgtgaaagccaacttatctcttgctgtgaattgcagaatgttgggggtaaaggcctgatgggaacggtgtaagataaaaagcctaaactacttattctgggagttttgctgcgaaggccagcaagggaatgaggcagtgtctggcaagggaattggtgtcaagagaagggcttttgtttgatttttttaaagattgaagacataacagcatatttgtatgctggtgggagttatcatatagaaggtaaaaaaattgatggaggagagagaagggagaattcctgcagcaatgtttggagacagaatgggctgtagtgtacaaatgtcagggctatttgtattcttaatttgcaataaaagtaactgaaatttttgatctttgcccaaattcagcccacgtgactgaggcaggattgaaagccagattcccttgactgcagagcccagggccttaattcctgagctacagcagcaagtaggagtaaacactaatatactgctcattctctttgagctaatcatcacttacaggaatcaatcctaagaaaataatctaaaatacagaggaagctgtaggcccaacactgttttattgttgttgttggagacagggtctcactctgtcactcaggctggactgcagtggtgtgatcatggctcaactgcagccttgacctccccaggatcaggtgatcccctcacctcagcctcccaagtagctgagactacaggtgtatgccacctgcccagctaatttttgtattttttgtagagatggcgtgtcaccatcttgcctaggctggtctcctatgctcaagccatcctcctgcctcagcctcccaaaatgctgggattacaccagcattggtataatgtgagccaccatgcccaactttttttttttcattctttttttttttttgagacagggtctcattctgtcccccaggctggagcagtagcacaatctcagctcacttcggcctcaacctcctgggctcaagctatcctgatgcttcagcctacggagtagctgggactacaggtgtgcaccaccacgtccagctaatttttttcattttttggtagagacgaggtttcactgtccaacactgtatttttaaaattgttttttatttcaatggtttttggggaataagtagtttttcattacatggataagttctttagtggtaatttctgagattttagtgcacctgtcacccaagcagtgtacactgtacctaatgtgtagtcttttatctctccccactcaccccagagtccccaaagtccattacatatcattattatgtattcatgtcctcatagcttagctcccacttgtaagtgagaacatatgatatttggttttccattcctgagttgcttcacttagaataatggtctccaactccaatgcaggttgttgtgaatgccattatttcattcctttttatggctgagtagtattccacggtgtatatataccacattttcttttttttttctttgagatggagtcttgctgtgttgcccaggctggagtgcggtggcacaatcttggctcactgcaacctccgcctcccgggttcaagtgattctcttgcctcagcctctgagtagctgggaacaggcacctgccaccactcccagctaatttttgtattttttaattagaggcagggtttcacctgttggccaggctggtctcgaactcctgacctcaggtgatccgcctgccttggcctcccaaagtgctgggattacaggcgtgagccaccattcctggcccacattttctttatttactcgttgatcgatggacatttagactggttccatatttttgcaattgcgaattgtgctgctagaaacgtgtgtgcaagtgtcttttacatataatgacttgttttcctctaagtagatacccatagtgggattgctggatcaagtggtagttctatttttagttctttaaggaatctccatactgttttccatagtggttgtactagtttaccttcccccaccagcagcaacactgtatttttcaagtgcaaaagggaaacaacctacacatccaggagctgtggaattgcaagcaagccggggtcacgca

SEQ ID NO: 517 - DNA, 20898 bp, Homo sapiens
agaaaaagaatgaaaagatcttggtatgagaaaaaccatctaattttcactacagtgaaaaataacagctgaactaccttctaattatataattatattttaaaagagtactctgttaagcaaatgattagctacccattgaaatagatgaaagggaggagttatttttgagcataagttttttccatccttttgaatctccagtggcttgggtcatgtctggcaagtaaaggaccctaattcaattattgaattgtttgctccctggaatttcacaaaaaaataaggaatcaggtacacagaggaaacttgacttgctcagagctgcacacctacaaaaagtagcagagctgagactactatggcccgtgcttcctgacccgtggccagtgcacctaccgctgggtttaaacacatgtgatcacacttcagacactatctttggtctttaagtaacttttctgttttgtttgttcaaaagattactaacaaaagaaaaatgaggaagtttaccatttgtaggtgaaaagtcacttttatatctggttgaattggttagggaataccagcagaaggaagttgttcctctggctacatcctgtgtcatttcagcaactggatgaatgtgatcagaaggtgaaaatcactgagagaagccactcacctccatcatgctggtctatcaaaattaacttcccttcataggacacaatagggttgttactttttttttaaaggtatacctacatatgaaaataattaattttatctaaatttaatgtaatatgcataaaaatacacctgatgctgtcctaactatgcaatattctcctttgtgtgtcaataaaagtgtattatttcaatacatggagttggttattattttacttgcaacctaaagcaccttaacagatatatcatgtgtaacttgtgtatttttttaatttagaagagacaaaaatgaggaccttacattctaaatattaaaatgtgcaatcacatgagtccaggagtttgagaccagcctggcaacgtagtaaaaccccatctctactaaaaatacaaaaagtcccagctactcaggaggctgaggtgggggaatcacttgagctggggaagccaaggctgcagtgagctgtgattgcgccactgcactccagtctgagtgacagagtaagaccctgtcacaaaaaaaaaaaagtacagcgtatattctatagtaaaaaacatgtgggccattacattctgaaagaacatagtgaaacatttacagaatatcaaggcctcaccatctagaagaaaagaatccttactttcctcatctttctacctcaagaaaaaagggaagcgggaagaaacaaaagtgctaaagttacaagtggtaaccaaacaagaaaaggagaaccgcttaacaaaatgcactttgaaaagcgctggctcatataaaaaccagaagtttgagagtatcacaatgaggccacactccaacctcccagaaaccatatattgtgcgtctacaaaatcctgaacaattctcactcagatcttgagagaagaaggggccattgtttatccttagtttttctcatttttgactgtggagtagtgaaaatggctgcagtggagattagtgcaaaaggaaatagcagcaatgtggcatgattttgtcagagtgtgaggactccaacgacccacattaattgggggaatgagctgaaactcacagatgcccccaacctcgctggacagagtaagctcagccttctccctccctcaatgaagtgcgaagcctgcatgttcctcacagtctcacattggaaggaggggcccagtttgtgcaacacaactccagctaagcccacccccaccattcccacgctcaaaggttatagaaaatcaagctcaaaaggaatattaagccgtcatatgtaatccagaaaaggggtaagaaaaggctctgacatgaggatttaggagctgccacacacaaaggggcagagcaaagtgaaagtctgaagaaagctgccaagtatggacaagatgaaatcaatgaactagcagctatgcaaaccttaaaagaaaataacatgcacaaattaaaaataaaatccagtctgaaagaatttttaagtgcacaggctacaaaatttgataagagcctgcattcaattttttaaaaaactcaagaaccgattgaataaccaagagaaaataactaaaaagagtgagatagagagaaccagagacaaagaaataatttgaggaccaataaacctacctacaggtaaattagaaataacaagaaataaagcagacccagctaaacatttagttcccgaaaaaaaagaaagggagagagagaaaatcactgtgaaccaggaagaaaaaacaaagtagattactacaatcagagaaaagataatagacttagatgataaaaagttaattaatatccttgaagaaaagcacttaacaaataaaaaggtatttaaaatcacacaagaaaaaattctttgaatgaagatctaaatctgcgcattacaatggtggatacacagcattatatatttgttaaacaccatacaatatacaacaccaagagggaacctcaatgcaaactttgggctttgggtgattatgatgtgcattaaagagtgcattgtgtttaagaaataaaagatggccgggtgtggtgactcctgccatcactttgggaggccaaggcaggatgatcacctgaggtcaggagttcgagaccagcctggccaacatggtgaaactctgtctctactaaaaatacaaaaaattagctgggcttggtggcgggcgcctgtaatcccagctgctcaggaggctgaggcaggagaattgcttgaacctgggaggcagaggttgcagtgagccaagatcacgccattgcacaccagcctgggcaacaagagtgaaactccatctcaaaaaaagaaaaagaaataaaagatgctggttgatctgtatcagtatatatccttgtcaagtttcttaatatctcagttaaagaaagtttcctccagcagcctggaaagaagagcaagtcacctaaaagaggacaaaggactggctgttctcacatttctccaaaacaacattcaatgccaaaggggcaagggaggaaaatcaaccgagtctaggccaaagggaagtaggatggagacacaatgtgcccaccttgatgtcactgcaatacaacagcaacagaataacatcctgaaagtggagagcattgatagatgcagtatgtgggatcacatcttcacagagtccatccagctcatcaacaaagaaagtaggaatgagatatggtggtagaaaggtctggaggtgcataaggtatccttttaaatggagaactaagaagagaccactgagggtttatggttacagaaatcaaaaattttaaacttaactatgtaaaactcatataactagggaaacgtgagaggtgagctgaagtgaagtggagtgagagaggtaattggttcatgtatcatagcagagttactgatactgtctgaaattaaagctcatggtttagaagaaatgacgaaaactgcttattattgtcacttttcttttcctttaatcaaagtggggtcatttcagaaatgatacatttgtggcaaagaatcatttctataaaatcagcaattctttagatcccatttcagaattttttattctgttaaatttaagtagaattaaatatcatatttaacatggataaaatgtataataaatgtattatatttaaaatgatgcccatttttatatctattgccatgtgtacatatagaaagagataattttgtaagggtcacctaacggtaatgatgattatgtctgaaatttgggatgtttctatttcctttgtgcttttattcttttaagggattgcctattaggaatacttgccactgttaccaaaaaaactatttttttaaattaaacactattttttagagcagttttaggttcacagtaaaaatgagaggcaggtaccgaggtttcccatatacccactgacctcacacatgcacagcctttcccattatcaacagccccatcagactggtacatttgttacaattgatgaacctactttgacacatcataatcacccaaagcctgaagtttacactgatgttccctcttggtgttgtatattgtatggtgtttaacaaatgtatagtgctgtgtatccaccattgtaatatcatacagcatactttcacagccctaaaaaatctctgttctccttctattcatcctgccctccccaccagcccatggcagccactgatctttttactatccagatagtttggctctttccagaatatcacctgttgaaattatacagtatgtagccttttcagagggcttctttcacttggtaatatgcatttagatttcatccatttcttttcataacttgctagtgcatttcattttagtgtggaacaatattccattacactgatgtacaagagtttatatatccattcacttactgaatgacatcttgtttgtgtccaagttttggcaataaacttagtaaataaagccagcgtaaacatttgtgtgcagatttttgtgtgaacataaggtttgaactcctttgggtaaataccaagaagcacaattactgggtactactttaggtaaataccaactactttgggtaaataccaagaaggacaatcctcttataattactcatgttgtaagaggatgtttagtttcataagaaactgccaaactgtcttccacagtggctgtaccatcttgcattcacaacagcaatgaatgagtatttctattgcttcacatcctcactagtgttcactgcggtcagtgttccgaatttgggccatactgatatcttactgtcttcatttgcatttccctgatgatacataatgtgaaccatcttttaggctaggcatggtggctcacgcctgtaatcccagcattttgggaggccaaggcaggcagatcacgaggtcaggagatcgagaccatcctggcgaacacggtgaaaccccgtctctactaaaaatacaaaaaattagccgggcatggtggcgggcgcctatagtcccagctactcgggaggctgaggcaggagaatggcgtgagcccaggaggcagagcttgcggtgagctgagatgatcgggccactgtactccagcctgggcaacagagtgaggctccgtctcaaaaaaaaaaaaaattactacatgatactaagtaatgcggaaggtgactcaaagggggaaaggaacacagcagtgtaaaggaaggaggttgtagatggatctagaatttccccctcatttccatcaggtgaaagcctgagaaaactgcaatctttgtgcaggctgggtttgctttgtacacactggtcccctagtgttcatctccaataatgctgacaactctgaaaaccatctgtagacattctgcaggctccatctcaggaacaatggctattttttcgggtagttgaagcaaaattaagtccaatgataagcaaatataaccattatcaaaatcttccatttatgtttgttaaagcaacctaagtatgatctgagaaggactctgtattctatatttgagtccttgtggatgaactgtaacctagcttaataggcagacaagattgaaaacctaatttaggagtatgtgcctttaacaatagctgagtcttggccaatcccagtggccatacttcaaccattcatacactgctgagtgttcaaactgtgttcaaagaaggcaaaagccaacctgtaaccaatccagttgtttctctgccttacctccaatttctgtatgtcacttccctttttttgtctataaatatgttctgaccatgaggcatccctggagtctctgaatccgctgtgattctggaagctgccccattcgcaaatcattcattactcaattaaactgctttaaatttaattctgctgaagttttcttttaacaggtttagaaaaaataatggcaaaaatgaatgaaaatccaataaccctggaagcagaaaaggctgggggctccaataagtgtaaatagtcccatccctatattttctccatggcaattacaatccagcacattatatatatatttttttgcttctcgcattttggcttagggtaaagctttttaaaacaggcactgccaaccagtgttatcaagaaggtctggatgccgttttgtgggaacattttaaagaggaatgtccaaaaggaaaagggggatgggttgggagaagggtatcaggcgggtatctcaaaaccattcttagggctataggtttaatttatttggttgtggacgtcagagccgtcatggtaagaaggaagcaaagccttttgtaataattaaagccttcagaagcagcgtgccccattgcccactagtgcgccgtgaagtctggtgttcacctacagggtccctctcagcactgcccaggcctcccgagtgctccagcacagtagcttggagcttgttggtttggtgaccaagatacactccagggaatatgccatgcagtggagtctcttccccggcactgcatagcaaaaggaaagggccgctgggtgtctgtgggtcctgggcagtcacagaagccaccgcgctggcggggaggagggggaccgatgcggtccatgtcccgggcagccccaccttctctgcctgcgaagggcccttgtccggcgggaggagagaggcgcgccccacccgggctcctctacacctgccgccgcctgggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtaaaagtgctgaaaccatgtgaataaaatacaggtgggttccgccagcttcgctcctgaacctacccgcgctcgggatccagaagctgcgccgggagagaggggctcaggcctgggcggaggggacggaggtcagaccgtgcggaaagtgacccgggcaccccagggcgcccaggcccccagggagcgcggaaagtgcggtcgcggcccggccctcgggagacgcgggattgggatcaggcacagcgcgaggaagtcgatcttggagctagaacattttcctttggccatttacacgaatccactggaaaatgccgcagtgtttatcaaagttactcaaagtagaaatgtccagacgtcttatgagcttagacaaatcttttactacaaaaagaaacagcagttgcattcaaacaacaacccttctgaaccactactaaaatttagcataattactcttgtggatacattttcattgtcaagtaatttacttagccaatgaacttggagagcaagaaagttttatgtagtaaaatgtaaatttgagttaagagttaagggtgtttctttttgtctgtttgtctgtttttggcaatgtggctccaaaaccttaagcccacctaaaaactatataaatgcaatccattcttttgttggaatgttcaaggactagaaagacaattggagaagtgagagtttgaatctttttttacgttggaaacagtgttgcaaaatattttttgagttttgcctgacttagcaaagattcagtcgaactcaagtagagttcaaagcattgcagcgtgtagtaaaaaaaaaaaagagttgaagatgttgtgccatatctgattcttggtattaaaaataaaaaaaggaaccatttaatccctaagagttcctggaagaaatggaattgattctaccatctgacttctttgtcttagtagggacaaattcattgccttcacacaggcagcattttaattaaatgcaactaaatacattgatgtcctccttctccccagtgaaagtccgagcagtgcatagatagaattatattttctcaaaaaggcttaaatacatgtaaattattaagtgttttaagtgagaaatctttgtcagttgaaattattttatcaaatcatttttgttctgaacggcacttttgttttaacgtatttagaaaactcttgcattaaaacagaaattgatttgtattatcccctgtatttgaagtgcactttaaagtgtatttgaatgagagattataatcaaattacttgatttgtgtcttatcctcttactcttctaccttggatttgaaaaggttggatttgaacactaggaaaaaagagatttttctactgagggattgtgggaagatttttttttaagcctctgtatttgaagtgaaatataaaataggattttataatagtcttaataactagaaagttttaagctaggataaaaatggggtgtatactttaggtctttatctttcctgagagatgaaattggtagaaacgttattttattgctagatttcactttagaaatgaatcaccctgatctttgttaggcccctatttaatattctaaatgcaggtctaatctctctgcttttttttaatggaagacttcttagtagaacttcacttatttagcacattgtttgcccatggttataatccaatatgcttgtgccaagacgtattttggaattcaagctttttcagaatttggaattaaaatttagaatctaaatttcagaactgagaaagacattgctcagaatttagaaaggtaaacatacatgttgaccctgctggttacatgccattccaatatagtctggagagaatcctgtaattccatgcattaatatttctgtacttttacatttaagaacatgaatattctcactaagtggaataaataaagactataaagagctgtgtgtctgtttagagcaggtgttatcactacgagagcttctctaagacttaccaaaaaaaaaaaaagtgttgtttttcagagctttttagagctgcagctgagggactgagtctgtattagactccactgaactacggtttgcttttaaaaggaaagtgcatttatgttgttcaatacttcacactttccagtaattagaagggcagttcctctctctttagggagtcttaaatagcaagattttactgaattttcaatcataccgatcaaaatagaggtacttcaagtaagagtggatgtctcatctttgtaatataatttcaaacagcatagtttctgacagtctaccattttagagaaacagagcagaagttacttacaggaggggttactgtcaccctttacagctgcagtctgtccatggaagaaatattatttcctgttaactttgcaaccagctgggtttgtgtcagttatctaagcctaagtgatggctaatttttactttctcaactttccctgtatagatttttttccagctaccccctgacttttctactcttgctttgctggttttaacattttccactacttctggattggtttagctataactgggtggagaaaacaacaacaacaacaggaatttaggcctttggggaagaatttgttttgttttagaagtctacacattgagcattactttttcttctaaagcaactaaaatcagaaggcagagtcctaatgagagattatgatcaaattgcctcatttgtgtcttatcaccttcctcttctacttagatttgaacaggttggatttgaatactaggaaaaaagggttttctactgagggattgtgggaagatgttttaagaactagtctgattggattttaggaaagttcattcattttgatatgatgttatcagggacattttctatttgcttataattttatctgaccaatattagcttgtatcaatttgaggtttttttttcctttatgaatcaattgtgcaaggtttgccctacatctcttaaaaggtggttaaactggaatcttaaagacagttgaatttagccaagaccaaagatatgcaaagaaagaatattttgtttatgttacagtacatttaataaatccaaatggctcccttgattcttttctttctgggacaccacgtattgatttctggcagctggccaaaggcagatggtggtggagcaagcgaggacagttaagaatgttgatgattactggattactgaggagtactgtgagctttctggtcctctgctcagaggtgtctagctctgaaactgggatcctggctctgagctggagaggcgcttccagttactgctgtcctggagcgctggaagggagcataagtgtgaggagacagtgggcttttagcctgggatgcagatgagagatgtcttgacctgagtgaaaaccttgcaggcaagctgcaggtctaccgagcagggtgagggaggctctcgacctggatactgtgaactagggagagaaagtaaattcaacagaaggagggcccagggcagagatttaggaatatccacagtttaaatattgctttacttaagtatactctgcctgactataagtagcatttgaatgttcaacatatgacctttcatttctcccctccattggtttgtcttaactgataaatctttattttcccatggtcaacctggtagtttattaatattacatctatcagttcctgttgagttgacatgaaaatgttttggtgtgacctaagttaatttctctttttgtttaattttaatttgtaatgagttcctcttttcattctgcccatcctttggtactgctttgagttatgtcctctagaattctcactatttccttatgattggcatattttcaaagttttttggtgtactaattttaaacagtgtttgttgacactgagaattcaggactttggagttttagaccaccatcaccttctactccttctcacaccatcccaggataattattctctcatttgagattaagaagttatttggtttattttattatggttatataaatatagtttactgctaaagcaaggtatatcattccattttctatctcgtacccctttttgctcttcctggggtaaacccttgctttgtttttgtgttttcttagtttgcactgtgcctattatcatttccttcccaactttctgacataaagatgaaagccctattgacacaattttctacagtgtcagatataccaagtaatctcacggttccatttttctttctttttttctagaaccctccatcttcttcttgtctaacagttgctcttcagtcttgctatacatacagtaatacctgaagaatgtttggaggatatttggtgtgggacttttcttttttttttttctttttcttttttgtagagatgggctctcactatattgcccaggctagtctcaaactcctgggcccaagcaatcctcttgcctcagcctcccaaagtgctgggattataggcatgatccactgtgcccagccctatggggaatatttgttgactaaatatgttttatgtaaattgcttatcatactctttgttgtaacatctgtggcattaatatgcctcttgttaacactcacctacattttacctgttgtaaatccactgtcataattattgaaaatatttctccagagctttttaattctatggttatttatttattgtagtatagaacttttatgatttcttccatcagggtgcattctgaatcatgcttagtgagagatggtttttaactccactttaacagttagcatctatgttttacatcagtgtcaatgtcacttttgtattatatacgacaccaacattttattatctgagtgatgagaatgtttatttttgtggaaatggagatctcatgagactttaagcagattgctggccttctcctcgatttccttgattgattcctgaagtggaactgcagtgctaagtggaattccctgggaagcttgctcaagtaagtaagcatgagaaatgctgaatgaaataaagtgcagcaagcagggataaatatcatgggcatcttcagagcctttgtgcaggtaacatgcacagagattctctgagagagtcagtctcagccagtggtcctacacttccatgaccctgcagtgcgtttgttcttagagtggctttcagggctggctctgccacagcctctttgggaaaccatgcatgacctcttgctgctccttaccaagctccttaggctttgcttggtagaggcagaatgttgtggttgttttcatcttaaatgctaacaatatatgaattatgtggtggatacactgcctcaaagtgacatttatcgaatatttttgtagctacgggttgagagtaagggtctgaggccccactgggttcaagtcccccttctttatttgtaagctcttcttttgtaaatggagcagtcacagggggcttcactctgatacctaatggagaccgtgcctgcagtgctcggtacctggtatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagcgagcaacagaaaagcccttcttaacctccaccctcagtcccagccctgcccccagtcccactgttggggagcagttggagctctaacctctcttctttcgtcctgtgcattcatgtgtgcatgtgtgcacgtcttcagaagatataatggtgggctgtgtatgtcttcttaatacctttatcactctggaactttctttttattaatatgttggggtgcggggaggtctccatattcagtgattattgtaatttttatgacagtccagaataggcatgtcgattttttttaatttttgatattataaacagtgctgcaatgaatgcactttttcttttcattctttccctctcctttgccatttgcactgtgttttcatgaaaccatcaggttaatctttatctcaaggaagcccttcatccctgtccatcctgttcttcagtccatccacttagttttcctatgattattttagcaagcaggtggttaatttccaaggaatgtagttacttctttgggatttttttaagtgatgtattagttttctgtgtattttattacttgtttgagtgcaccattacccccgtctcccggggtatcagttcatctgcttgcatgcttggtgcctctctctcctgctgtcagctttcctgatgtgctgggtatttccacgtgtgtgttggtttttttttttttttaggtaccctaggcattagtcttttaaggctgcattcttgcagcctgtcccacatgagataggaggagggcaagacctggatgtgcacagggcaggatgggcccataactggtctgtgtggtgtgtgggtggcaggaactccctgttctttgtgggtatggccatgccttccctattcaaacgaagccacacacctgtcttttcctgcgaggcgtcttctgctgctttcttggagctggggagcatctactcttcccttgtcctcccgctcctccctgttcctccctcaggtctctgtcgcttctaaggcactccacccttggtcttctcccaccttgcaccccccacactgctgcctgcctgcacagggggactgtgattgcccccttcagtgtgagcctgacctgcttcatgcctttcaaggagagcattcattgccaagctactcatggaacatctcctcagatcctcagcgtgctatgacttcattttctgtaatactgtttttcatgtttcttccccttctctgcatttatagctgtgcatatgcttgaggtggaaggccaccacttccttttggttaacaacaccaatcagctgatggtcatggctacgtgaaggaactcacagtgagggctcaggaagagcctggctagagcaggctgcatcgcaggccttggcgttaggttccccaaatcactgctggtgatcttgtagctctgtcatgaagtctgtcctgcttattaggataccgagggtccaaattcatagattcttagaagcctgtttaaatatgcagagtatctaattcaacccgattagaaacgggctcagaaaggtgaagggatttgtccaaccactgagtgatgctgctgggattagaactctcaaaactaggtgtttctaatccagaaccagaatccctatccactactctaataaggcgtaaaagaggatctgctgtcctgcctaattggtgggcaggtttggagtcctgtcagcagctcaggaaagcctggagaggcagagggaggacacaggctcagtgtcagacatgccaattttactcatcaccaatggttacacaaaacttgttttgatctttgtggcttttgcattgagaagttaagcatatacaataggaattagacacaatcccaaaccaatgagagactcaagtgagaagagctgaagcttttatgcatgccttccttccatagagataaatttactatccagagtgaactagagcctcgtggaaagtgagtgccgagcccctagctgtgagtgtctctgtccttcccacatcagacctccatgtctgtggctgtccccctacggggcagaactgctgctctctgcttgtgttgctgtcgtgagggttgggagtggacaggtgtggacagatctcagacccgtttccctcctgttatggaaatgtttgtgaggcaggtgggacttcaatgatttggtcaaggaaaggcagcttggcagctggggagaagggctcaggctagaaaggcaagcgtttgtgagggatgatttccccaaagaagccagcagtgtgtaaggtattccccggagcttgtttcttctcagaagactctggaagctgtgtcagtgtctgttatggaggaatggagtatcagtccgatcaggctttcataacaaagcaccacatactgaacggcttgaacagcccaatgtgtcgcctcccaactctgagccaaagagactgaggtcaggatgtcccagggtggctccttccaagggttgggtgggacaatgtgcccccagcatctccttggcttgtgggtgaccatctccagctccacatggcatgctccctgtgtgcctgtctctgggtccagatctccttttcatgtaaggacaccagtcatgttggagtagggctcaccctaaggacttcaatggggcgtaatcactgctgtaaagaccctgtctttaaataaggtcacactcagaggggttagggagttaggacatcaacatttgaacttggggggacacaattcaacctgtaacaaatgtgtgagtgaagactggcacctccccacgatggcctttctgtgatgccatcaagagcaccagggagctctccagatatggagatggacagatgtctaaggcccctgaaatgagcctgctgtacagatgattccagaactctgtcagtgtgaagaccaaacacaattaagcacattaaaatacttacggtaaagtgtttctttcactttagatgtgcaaaaacttaaagagagagagacttatgagaagactcagggaagaaatgtaagataaaggtgttaagggagacaaactccacaaaattgtaaagtgaagctgctgtggggagtagagcccagacccagataatatgcaggcatgggtccaagggaggctttgcacaccaggcgggggaggtgcagggccatggatgaatggtcttgggaaaacggcaaatcgtttggaaaaaaaaacaaaactttgctctttatatcaaaataaattccaagctgaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatacaaataagtgaaaaaaatggtaagatatatttaatttcaatacttgtggtaaagcatcaatagctttaatatgcagcgagttttttcaaatcaataagaaaaaagacacagatgggtgctgacagggccgtttggtaatatcttttaaaatttaaaacacaagtgctttcactcaacaacttcacttttaggaacctatcacacatataaattgacaaaagtggagaaatattcattgcaacattttattttataatagcaaaaaaaaatcactaagggaagtacagttgattcatatgttggaatcctatgcagtcttctaaaaaatgtggaatttatttcatacaccaaatataacaatgtccaagttctactagtgaaaaagcaagatgtaacatatcattgtatttgtttaaaaaactcatgctgggttgggtgcaatgactcatgcctgtaattccagcactttgggaagccaaggtgggtggattgcttgagctcaggagtttgaagccagcctgggcaatatggcaaaaccccacctctatgacaaataccaaaaaaaaaaactagcctggactggtggtgtgcacctgtagtcccagctacatgggggcgctgaggtggggggatcacttgagtccaagaggtcaaggctgcagtgagctgagatcatgccactgcacaccagcctgggtgacagagcaagaccctgtctcaaaaataataagtgaaaaaaaaaaaaaaaacctaaaaatctcccacatgcacataataatttaagtgatattggattgtcgtttactacttatacatgcatttctgcctatacatattctatccagtgtgtacacatgtgtatgtaaatatgtagcatgatctggaagtgtaagcaccaaattaagaacagcagctttggggggaggggaatagaattggtttagagaaaaaggtgaaattaacatttttattctgcctacttcagtgtgcctgcagtatttacaacgatcaggagtgtgtacttttttcaatttagaaaaatgataataataaggtttgcttggggggaaagggtaagtaggatgagaccaggaagagaagtaacttagaaacacatcatgcatcatgactgctggcaccattctgtcctccaatgaagagcgaggctttgagaggttcagcagctcacccaaaggtgtacagccatggtctcaaacatgcttgcaccctgctgtcactcaggtcctgaagcccaggccacctccaaggacactggggtgctctggggtgcagcctgccttcagatgtttcttaaagccactcctactccaccccacccagtgcaggagccaagattgaggaccaccatttgacagctagttcataggatttcatagcacacaaacacatctttaaaggctgatgaggtttccaccaaattgggatttattggtatgctgggtataatggcagctgtgtgtgcctttgactgcaaagacactgggcaggccagagtggctcctccccatttgatatgtgtgtgtgtgtgtgtgtgtgtgtgtgtgtgtgtgtgagagagagagattgagagagagagggctcgtgtttttctgttgcgaacagtcctttccacgggaacttatattctcctaaggtttgccactctgcagaacttttggaggaaggctttagagtgagaatgtcagtgcattctcagcgtgcaactgtaagacttgcaggaggtgaatgcacatgaaataattctcagaggaagaatatgtgcactggtcagatagcaaaactgacctgtaacattttctacacaagaggatttgaatggttttcgtctttaagatttttttttaacattatgcttagtccaccatgctttattctgtcagaccatttgccatctgcatgcttcatgagaaatgtttttttctcgtgagaaggacgtaagcaatttcgctcctggttgagagtttggtccatagtttcttggtgtctgtgggttggcttctgggcctcgctggctgcagctgatggtgaccagaagggctgttcttgtgagtcattaggggatgggccgctgctgctacctccccaccccagccacctccatcagcactgtgccatactcgcccagaagggcccctggactcatcgcctgcccccatgtttacactttttaataaaatctctagaattgtggcttagacctgtaaacatccagttccaagaagtggctctaaagccctctctgggggcagagtggttgtcagaagcagaccaggcctcggggtctagattccatccttcactggaactgctgggggctggtagtaccccatctgcaaaatgaggttaaaaatacctaacccttgggttgctatcaagctcagagatgctgtatgcaaagcaccaatcagactggctcacaaagaataggccctctgtcaaatgttcatggttgagtgcgggatgtcaaggataaatagctactggttaccagggaattgaagacagggttcttttacaagcaaaaagattttataagagggtcacagaaacagagtgactcttgcccaacagtatcataagcaaataagctgtgtctagatcctaatcatgtgtttagggctctgctgggtttaataagcaacacatagggggtgcgttgtcctccactctcacatccccagtcactagacaaggtcactcccccggggggcatcttactcagaagctctaaaagactttgttgcatgactttggcccttgctcttttaaaatgtccagttagagaccatggcatggagagttttgtatactctgctcccagcatggcaccctctttgcatattgtgggcactcttaaagttatttctcatattgtaatatatcagatatgacttggatatagtcaactagatatttagtgaaaaatgtatcacccccattatcaaaagaaaacccaaagccttcaagtttggcccaactagaaggaatttctggaagggggaagtaccaggaccacacagactctggtcctggcggtgtgtttataagatgcagctcatcatgttggtctctgtcatccctgctaaggctgttcattatggaaccactggccacatgtggccactgaccgctcaattacttaaaaccatttaaaataaatgttgaatttcatttaaaatttaaaattcagttctcagtcacacaggccaggtgtcagggaccagttgccacacgtgggtggaaggtgtgtgtcaggcagagtagaacaggtatttccattgctgtagcaaggtctgccagacaccaagctgctctcagcccatcccctgaggagcccagaagggatatgaacttccacccacctctcccctttcccagttctcagtgccactccttgcctaagtgcacggtaacactcgccactatttcatgtgttgatacctgcagctcccaattttcttaagaggatctgaccctgggaactgatgagggcaccaggagtgccctctcctttgacatgagaccttgagtcttgtccatggggccctggcctggcccttttcatccccaaggctgtaacattctcctgcacaacacaacacacgtgcacacacacacacacacacacacacacacacaaaataatgttacttctcagtcacccgggaactgacatggttcccagttatttccttgcagcagccctccaagcggtaacacagccttggagaaagctactaagtcatgtatccttggggtaagcacacttggttcagaatagtttctgaaagaacaaaccaggtttttgctcaagagggttttgagggactggagaaaaccttagtgcttgttcctttctcttcggttaaaaaaaaaaaatccaacatagtttccttgaaacatttggaacctgaggttttgtccattttgaaaagaagatgtagagaggtaacgtgtttctcacgaaggcaaaacaaaaaaataagatgccaagcaagtggcccttgtaccttcaagaccaagaaataaggcgtttgtttctgggaatgccttccatttgctcattttgtaagtaatcaaggcaggctgagaggggagccttctgaggcaccccagtgagcagaggtggggtcctgccactggcccctcggctccaaccttgcctcactccaggcgctggggcagagatgtgtggttggcctgtctctggagttcctgtgctgcttaatttgagtagagataaaaggccacaagagaagtcgttttgaagggtttgtgaattataggacttcctttcatgattcagcctgactccaggaagtgcagtcacgtgctgccctcctaggggagcttcgccccaccaccagcactcaggctccacttactgcaaaaggcgcgatcaagattcttcttcctgaattattgtcttaacaaaattgatacgtctaaacattgagttaacactttcattcacta

SEQ ID NO: 518 - DNA, 21556 bp, Homo sapiens
accacctacacaaaatcttcaaccaagaatcttaattgcatttatcaacttgtgtccttagatcataacatttagattcatttgaaagaaatttattgaagtaaaagaaataagaagaacttgatagcacaaaacaaagaaaacccagaaagagagagagagagagaagcagaaaaactaaacactgaaacccagagagagagagagaagtagaaaaactaaacactgagtcttaatctgttctgccactagtcagcagcctgcacagagcactttaatgtattctctgtccattagtttccttgtttatgaaagtatatagctccaaaaaaattctgtgttctgatttttgtctctccaaaccacaaccagtcccctgctcccttctctcctcctcctcctccttcttcttctttctctctctctccctgtctctctctctctctctctctctccccctttccctctcccccacccacccacctcccaacccctgcatacacctaggacacctccagcataggttactaccaattttgcacacctccagcataggttactaccaattttgctgggtttatctccttctgtcctttccgctttgatctgaggaatagctgagatttaggacagcaacaaggtgtacctccttccaggttataaaacaggattaatgattaggctcaaggccccttcctagtcactcagtaaagtctgtgcactggaaaactgtggtagcagttttctgagcattagaaaactgtggttctcacagaggctggatgagtcaacactgccatctggcggcctcttggagggtgatgtggagcctggctttcattgaagaatgaaggtcccttgatttcctgaccctcagccaactctccagcagcttctcactgcagaagaggtcaggccattggtcagcttgaggacaaagtgggaggatcacactttcgatcacctatactttctaacaatcagccctgtggacatctgctcacgccccatgctgtttttaaaatattttcccattatagaaatatttttcaaagatgattcacaagctccaggagccattcagacaagggagagcaaattggcagctaaactcattcaagagtggagcagatgcacatgaagctctgtctggcggaggaggcacaagacaccgagcctggctgggagggtgctcatgacaagagtggggccacaggcctctcctttcattggacatagtggccatacaaagtggctgccttgaaatgcacccacatacactatcggtcctcccggtctagggagaaaactagcacagtatgtcaacagataaatcagcgcaatcctgtgggtgaagcagtgcacccatactcttcattctgctgagcggaactcaagggtgagacacttgtattcctaactccacttgccttcaggctcctccaacattccaaattgcccatggacagagctactacccctccatagaagtgacaacttgaaataaaagatttgaagctccttcccacgtttagacccaggcctgctgctaggaactccagaggagggatggaaagaagtttgcactgctcacagatttaatgtttctctcacaaccagaagtaggcagcaggatggattttcaatcaacactaacaaacggatcactcctgggtcctttaaacaagttccatgtctctttataggttttaggtgcctcctatgtgttcagacttcgtataatggatatataagaaaagtaaatgggaggggcaatatttaagaaataacagcaaacaattgcattcatatttaatataaactacaagtatcaagttaatagacgctcagaagaaattcataaaatctagaaaagttgggaaaatctcaatagagaaaataaaacttgatctggactttaagagtatgatttataaagttcaaggggacagtacacaaagtcagacaatgttagctgaatcactgaagaatgagaatatcacacccacttaacaaagcagcccagctagttaaagaagtatgttgaagaggtagggagttgggtgggggaggcgaggatggcgtggagggatctgaaaactatcaaccttaaataatgagatttagaaaatatgattaagtagagggttaattcgagtgcagagcttgagaatggccacctggaaacactgactctaaaccagtaaggttaatgtttcaaagtggagaagttaaggtttcacttagaaattttagcaggatcacattttccatacaagaccagtgcattcgccacagcaatttgattggttatagattgctgctcattccaagattactttattactctgtgcggaggagtagtgatttgaggggtcttatgtctggtgcctttttgtcttgtttacaggggaaaaggcagaagttgcgcctgcatgccgcataactcaggctctgcatagccacatgtctttcaaggctcagaataatttgaagttccaacagctttaagtttgaattaatttcacaaagcggagaaagacttggacttcgtgcagtaatgaagaccaccgatgggtactgaacagctctggtgggtttgcactcagagaaaggagcctaagatgcagaaggtgcagtgaggcagcagccatctgctcttgtgctgctgagcagagcatgatgggctgtcaccgctcacgcgtgttctttacctgctgactcacctggcggcatgggctgcatatggggtcccagctccttaagctcctgtcaggcccttctgcaacttctcccaagctcttgggccaggtgcatgtctagccatgaaaaaggaggccagtacctgatcactaagtgaaagttctaaggtagtgggactgccacaggtgtcccccatggtcccaggtcacaatccagtctgttgaccctcctccttttgcaccatcgcccctttgacagcctgtgctatgggttttaggctcctagcaccaaacagaaacaggcttatatagatcatctaatcagctcttcttatgtgaggccgaactctgtaataaatctttttatgtctcctagggcttctctgattgaacctgtctgatgaggagttaaagaagttctcaaattgtgtatgcataagaatcacctgggatttctagctcagagactgggacaataggtctattgaacctaggagttcattttgaacaagtgctctacgtaattctgatacagggaatcttccagttacagtttgaaattcacaaatacaaggaatgagagacctagaatcagaaagcatgttaatacacttttgggccattaagtgctcacccaggtaacaggtacagaaaggcagaaaaaggaaacctatcagggtaataattatgcctttttttttttttttttttgagacagggtcttgctctatcacccaggctggagtgcagtggcacaaccacagctcactgcagccttgacctcctgggctcaagtgattcttccagttcagcctcttgagtaactacgactacaggcatgtgccaccatccctggctcattttttgtagagagggggtttggccatgctgcacaggctggtctcaaattcctgggctcatgtgatttccccacctcagcctcctaaagtattaggattacaggcgtaagccactgtgcttggccaagacattttggtaagaaatattattttcctactaaattgtctacattccccttgggtaggcttgcaaagtcactgtgactacagcaggagctattgctgcatgggaaatatggagacacgagtggtacctggcagtcacgggctcagtttgtttctaacctcccaagtcagcacagccccactgagcagactgccggaaagtatttatgccatctgtcggataattaagacaaatccaaacatctacgtgcattctgtgtgtataaatggagtcatggccaacctctcaagcagttttccatcaatcacttgtaatattaccagatacttccaatccccttgcaggcagtaatgaagagaaagtctctacatcagcagcttctcactggaatcttcaagcctaactcttaagaatgaatcatacttctaatgtttatcaaaggttttcttttcacacaaggaatgtgcctgaatgatctataaaactacccaaataactagtagccaggttagctctaggagccatatgccaaacacattctggactaagtcgtgttcactccaaaactaagaccatgttcaaagtctacagcaatactggattaaaacaatgttagctgaaggttgtaaaaaaacatcatggaacactaattatgtgccatcaatcattactcaatttgtagaacttccctatacaccttgggaggtgagaaccttatagaaaatcctagatacacaactttatataaacagaaaattccaaaatgggaaatcctttagaataagaatatacctagtgtatataaagaagaaaaaatgtagatttgaaattgggatactctacagtttttagttgggacattgggatagttaattttaggtgtcaacttgactggattaaaggatatcaagacagcaggtaaagcattacttctgggtttgtctgtgaggatgtttccggagactggcctaggagtttgtggactgagtgcagatcagcctgtgtgagcaggcaccatccaactgaatggagcccagatagaaccaaaaggcaaaggcaaataattcactgtctttctcctcgagccagggacttgattagcaacccctcacacccaactccttattttcaggacttcaagggttataccatcagcttccctggttgtgaggccttcagacttggactgagccatgctgccagtttctctggctccccagcttgcagacagccaggcatgggaattctcagtctcaataactgagtgagccaatttctttaataaaccctttctcatctctctctatatacaaacatatcctattggttctgagtctttggagaatcctcatacagacactgttaagagatgaaccaggtgttaccactgtgtccccaatgcctgggatagtgagtgacagtattgatgtttgtgcaataaatgtttacaatgtgtatctactagcagctttcgataatttgaattatttataaaaggcaaaataaacaaaagtggtatctaagattaaccactaacttagtaaaattccatttataccacaggttgttctggtacaaagcatacaataactcccatgttacatataatttgacttgttcaataacaagaaaattactcaaatattataatggagttaaaatgtatttaatagatctaaaaaattttggctctatcaaaacttaggtctcaattataacattactaaagtgcttgtaaaaattatcccagatttctggctacagcttgtataaaggcctatttttttttttttacagttttattttggttgaagatttttctccaaaatagctattccagatggcttaacagtcccagaagtgaaaaatcttaagatatttcatttataaccattagagtcttaataaaaccctagtaaatactctcccttctggatggtttaaaggtcccttcaggcaagctggctgcgtaaacaccagagccctcttcataagataagtttgctcaaaaggtcaacttttacagagaaattcctacctcattagtgtaagggaaaattaacatgacctgttttcattacttaaaatgcaaaaaaaaaaaaaaaaaaaaaaaaaaaatctcagaaaaatagaaaagggtgggaaaaatgaagaaaattaaaagaaattctacttcctatatctgtcctgcttagagaagacaagttatagcaaaatgagtacttcaggtttctcttttaataaacaaaaccatccaaggtacagttccaaagtacaaaatcaaccaggtctgaactgattggtgataagagcacacagatcagtccttccttaaggaaacagtttcctccctgatgccctctttggtcactatgcagatccggagtgcgtccccagtgtacacatctctctcagccgcagaaatgaagacatctttcaccagccgcatggctctgtccaaggacagcggaacatgctccacattctgcatgttcttaaaaccaacctggtgggacatgaaacttgggtgagatgtcatgtgacagtgagcacaaaggaaaggttcaagtttcttccaataccctcatgtgtacgaggatttgtgatgaaaatactacacaaaattaaaatgtccttcagactgaataaagacccttccagacctggatgaattacacacatcagaaatctgacaacgattccctggcaaagctcccactcttgagaagcacatgacccggagaggtggacgtatgcaagcaaagtgatcagagaattgctataactaagaagaaaataagagccaggagagccccaacagatgtccactaagtctcctagaagaagacaggcttcagcagaaaggacttttaagtaggtgagcgctgaaggctacactgaagagcacagaacattccagactgaagatgtgggacggagttaggaaaagcacatcttttctgagaaaagcagagttagggtctgggtgtagtggggtgacaggagatgaggtcaataagcaataagcagaggagtagctatatatgacatccttcagaaaactgagcaggaggaattagggaagtaaacttgtaggcagaaaggatgttaggaaataaatccaataatctaataatgtaggtctgaatttagccagcagtaatcacaaagagggacgaattagaaatacaggcggcctttgaataacaccgttttcaaccactcaggcccactgacacataaattttcagtaaacacactgagaagtttttggagactcgcaacactttgaaaaactcagatgagccaagtagcctaaaaataccttaaaaattaagagaaaggtatgccacaaatgtataaactatatgtagatactagctattttatcatttactaccataaaatacacataaactgattataaaaagttaaagtgatctctcaatgttctcctttgtttttcattgtgtttagtgcgattattataaaccttaaataacaagtggcccaaacaaagcactattagtgatgctggaactgctccccaagaagcagggaaagttatgacatcacaagaaaaagctgaattgcttgatatgtactgtagattgaggtctgcagctgtggttgtccaccactccagacagatgattctccttgtaaacagatgatgtaaacttacagtatcaacaaatacagtattgtaaatgtattttctcttcctataattttcttaataacattctctttcctgtagtttatttatcataagaatacagcacataatacatatgtaaaatacgtgataatccacagtttacattattggcaaggcttccagtcaacagtaggcttatttgtaagttttcttggagtcgaaagttatatgtggattttccagtgctcggggaactggcgccccaatccccgtgttgttcaaggctcaactgtatgcttgggagttcaagtacagtattgggtaacacagaaagggggggtaagagggaaaaaggcatttttatgatcttcaggtaaagacagcaagagaattagccactacagacataaaagagttggaagccatgagaatacaggaaaacaatcaaaaccatgggagtaggtaaggacccacaagagagtaggcagaacacagagagagaccatgaggtttctgtaggacacgtctgccaaactcaaacagtaatttataagaaagtctttatatcttggctctcctaagctaatgaagaggagaacttggaggaaggcacttcaactgaacaccatgacaagttggacatagtatcattacctggacacagtatcattacctggttgtcaagcaggggctgtagcatggcacttgctgagcctccagccttgaaggagtctctctggtaagaccctactggatcaaagctgtatacagccccctttccttaaagaagaaaacagtattcataaggatggtatccaatcacaatcccaaatcatcgcaaaaataaatcaggtcaaaacgtgacacaaaacggactatcaccttggctaaaacttcagggaacagttggaacacagccactgttgcactggtgacagctgcagcacacacactgttgcacatgtgacagccagaacccagtcaccattgcacaggtgccacccagcagacagccccaatccccgtgttggtgtgttgttcaagggtaaactgtaggcttgggagttaaaatacaatattgagtaacacagaaagggtgggtaagagggagaaaggcatttttatgatcttcaggtaaagatgacaagagaattaaccactgcagatgtaaaacagttggaagccatgagaatacacaaaaataatccaagccatggtagtaggtaaggacccgtaagagagtagggagaacacagagagagatggtgaggtttctgtaggacacatcagccaaactcaaacagtcatttgtaagaaagtctttatttcttggctctcctaagctaacgaagaggagaacttgaaggaaagcacgacttatgtatatagacaggtccaagggacacatccgcaagacacagtaaaacgaagagaattctgtaacctgtaaaatacgatactgcttttgtttaaaagaataagaaaactatttgtacaagcacaaaaaagtctggaaagataagtaactgtggctggtcatctttgagctctgaattagaggcaagaaaagaagggaattaattcatgtgcttctatcttatttgagtttgttacaaagaacacaggtgattctacaatcgttaaaaaggcctgttaaaaacaaccgtgttctgggtatgagaaatcacgagtcatttacaaggtatgattttttaaaaacataactgatttagaaaacacattatataccagaactcagtaccctgggagatgtgatatagggacaatctccttactaaccatgtacaactgccactgttagctttgtatgttttctactatagaactgcgtaaacttggccaggcgcggtggctcacgcctgtaatcccagcactctgggaggctgaggtgggccgatcacgaggtcaggagttcgagatcagcctggccaacacagtgaaaccccatctctactaaaaatacaaaaattagctgagcatggtggcacgtgcctctattcccaactacttgggaggctgaggcaggagaatcgcttgaacccaggaggcggaggttgtggtgagccgagatcatgccactgcactccagcctgggcaacagagcgagacttggtctcaaaaaaagaaaaaggattgtgtaaactgaattctctggtggagaaggcaccatctgaggtcacctaagaaactgggaagtatttttgctggaagcaagcttgggacaagacatgagatcacagcaggcaatccactaacctcaatatacaaaaaaagaaagagatgtaaggtgtaaaggcagaaaaatgattgtatctctcatgaggatgacaggccacaagtaaactgaggcccaaaagctttacccaaggatggaaccaatctcagaaaaccacacacaacaaatttaaaaaaataaaccaaagaaagggtgggctatgtccaagaacacagctttaaagaccccctagaagaagcaagagagacactagtaaaatcagtataaaacagcaaaaatcaataaataaaaacaaaaataaatgtagaatggcatgaatcttgattacaaagtgcttttcctcatcaaagtaaaatccaaaaagcacaatcatttcaatgtaaaaaataaaatcagacaagtcttaaaagaaatacagctaagctttggatgggagaagtttttctaacaaggcaagaaactgaatgtcataaagaaatgattgacagattagactgtatgaaacacagcaatttctgtgtagcaaaaggcaccacccaaaagagacaaataacactcttgggagtatctataatatcacagacatttgacacagtcgaatgtagttcttgaaaatcagtaagaagaaaactaacctgcaaataaggaaatgggcaacagttaatatatgaatcagtctccaaagaggaaatttataaagtcaataaacatatgaaaacatgcccaagaatatatataaatgaaaataataaactgttcaataggcaaaaagatgtttcaaaatgtgttaattctaatactgggaaggttatataaaatcgggtactcagggtactggcgtatccttcagaaagagtatactcaacaaaatacaaaaaaaaatttatctgacccaatacttcaactactcgaagtttattctagcaagacaagcataattggggaagtacacaaaaatgtatgtacaaggatgttcatcatagtgtttatattaagaaaacaggaagccaaaatgccctttagaggactggttaggtaaatgatgctatgtattacagcagcaaaaacagaagacaaaaaaattttttgttaattaaatacaaaaatcattatgcatatagcttagatctccttgataatacataatgtatagttacagaaaaacagataccaaagtcctacttacataaaactgcatgagtgtatgtataaacatgtactgattgttttcactacagaaaaactaaagccacttttaatttgggagaaaaatttttaaaaggcatgagagcagctaagagattaaagacagagaggttagtgcagacagcggttgacaccaagggaaagagctgtggaccttgctgtcctgaaggtttcaatatggagcactgctctccaggtccctgcatccaccaacacagaagacagtaaaggaagtctcctgagacattagcagaggctctggacttaggggaccaggctctagagtggcaaagggtaggagcaaaacacatgaaatggaaagttgatgtaaacaaaacacagaccttcagcccccttcctcctctgaggcctaaaaagctgccaaccgggcttctcttcctgtagtcccacctcacctcaggaaaaaagattaaagaaattcttcatctgaagaaaatgctgcttacttaagcacccagttaacggctgtcagttgacaagccatgtcaacaaggactttcataatcaaattttggtacaagactcttcaatgtgaatggacagcaaaaaaaaaaaaaaaaaaaaaaaaatcagagatttgaaggaagcctctaacatagaagacagaggccaaaaatgaacacataacatgaaaaaaaaaacattctgatgaaatacagaaaactgcaaagaaagtaaacaggattttttttaaaaagacaaaaaataagtacaagctcttggaaattaatgacaccagaaataaaagcaatcagtaaaggatgaaaagctaaaattaaggaaatcttcataaagtagaacaaaaaagacagacatggataacatggggagtcaaaaataaagtaccgggtcataatccaggtggttgtggagaaggtgcagaggggtaggggaggaggagaggaaagaaggtggagaaagaggataaaacaaataagaaactctaggcaaggaacatcactatacaatttcagaacaccagggtaaagaaaagatcctaaaagcaaagtctcaaaaaggtcccgttttgtttttttcagaaatcttttaggaggtaagcctctaaaataaggaaataaatcaagaaagaggagaacacaggatgtgggggaatctcaggatggcagtggtccatcctggagcaaggggaaaagggatccacctagtatgtgaggtctgacaaccagatgaattgtactcagagaatgtacaaggaactgacaaaaagtttaaagaaatctgagccaattagagatagttaacttaagaaaaaaataaaaacgagttacacaagaaagaaaatattaatgcatgctacttggcgcaacaaagatcaatatctatctggtcataataaaaacattaaaggtctatgttaccaaaagtgtaatgtgttaaaggaggatgctaatgaggaagaggacacaaaagagctaagaaccatcatctaccagaacaaaacaccaaaagatatctcaaaagagtgcagtacaaatacagagttttggaaaatggaggtaagtaccaggaaatacaggtaaaagagctgaaaactgtcttagggcaatggaaaaaaaagatagaggactgctttattattcacacaaattcctctataaaataaaaattagtttaaagaacacttaaaagccaaccagacagacaagcttagaaagacagttctagagacacctgaggttgtcaccaaaactagcaacactgttacatggaaatcaaagaacagggctctgaagtgaaacaaaagccaaacctgaatcttaggtctgctgcttagtaggtatcagctttcccagattagactctctaactctcggaaaaactcaaaggatgctgtctggcctgctgaaattcaatggcagctcagctatttttaatgttgctaaaatctgaatctattaatctgacattaaagccaggcataatgtaagtcaaaaaagacaccagaagcatccagcttgctaagttaggcaaattaatttgtagctagactctaattacccatgttaaaggtaattcatttctatttttactatttctacactttactttttctcttggttttcaagtaaggttgaaagccttaaaaagaaattgtgtcaacctaatttgtctacgcctaaaccatggcaggtaaaatgatcagaatgttccccaaggctgtgtatgggggcggatgttaagagtcagagatagcgcacgcaaagaaaacgctcatggaacagaaagcgataggagtcaacaaccgagaggcagggcgctgaaatgaagcttgaccctttcctcttagaattttccctcacaggatttagggtccccagtccccttgctttctttctgtgtccaactgagatgttctgtgatgtggccagccgcatgtattcccctggaggctctgacccaagccaaggcctgccttgaacattcccaggcgctgacaatgttgtttaggctattgcttgaaacactgagaaattacccctgttgctaaacacacagaaactatccctggccctgaaccaaattccttcaacactcaaatcaactccctcaccttggacacatcttttcctgctgtctgctgagaggactgctgcagcactaaatgcttttgactgattaccctgagatttagtgttctggaaccccaactaggttcggggcagtcccttacaggaattcctctgcccctacttttagggcaacttcagccacaggttcagccagaaggaacacagaagatgggcttactccaatgatatcctcatctagacacttctgtaacttcttatctcaatggactactctaaatgacacagatggactacttatccatctgtgtcaatggactactctaagtgacaaagatctgtcctgggacactgtacttgtatttgatttttagatgcaaccaaaagccaatccaaatgagaacatttggattgcaaatgagaacaaatggattggaacatttggatggaaaacattggtgcccatgtggcgtaatgcagctctggaacaaaaatgggatggaatattaagtaacaagacttaatattctcagggaatcctggtctgactctgacaaaatcagagaggtgtttcaaaaagttctgaaaacactggagtagatgcttattattaattaccccaaatgacttctagaaccgttaaagaacttttttgaagtgtatttgttaataaaaaaattttcaatactcagaatcacatttaggtcaagctttctaggtccgatttctttctataagataaaaatgcctaattatttactactaactcatgcaagttcctgagaaaatagcaaaataactggctgctcaacattcactattagagcttcaatgtgcctttggaggtcatacattagcttcagtttcttcatcactttcattatcagaaatgaaatgagaattgtgtcagatggtatttatggttcttttcaactctagatggatacacacatctagggaataataactcctcccccccaccattttccagaaagaaggaattctaccttcttcatcaagtccaccgatgatgttgtaaacatagtatggaaagaagcgccttgaatacaggattgtagacagcattgcagcaattgcccccgtagtcatggccttattattggaatgcttatacatctgcaattattgataaaagtcacaggcatgtagaggcagaggccattatagactagaacaatcaacagtataaagtgaataaataaatgcataccacagtggaaggggaaagcatgcctatttccttcatgatcaaccaacacagtattactaacataaaattttaagggaaggaatgccaagtttgccctcagctctctggtttagactctattttccataccacccttatctcaggtactgctaatccaagagctaatgtgtatgaaagggcacatgaagtggcctaaggaagatgggtttaaatccatctctctccctcactctgcatatagaccaggggtcaacaaactacccctgtagtttggctcaggggccaaatccagcctactccctattgctatgaatattgtccgtggctgctttttcactacagaagcagatcaaatgaggcccataaagctgtaaatatttactatctggtcctttacagaaaaattacggcaatccctgatcaaacctagatgtaagtccctctctttgtggagcagatctctgtgagaacagaagacacagggcagcacccttactctgcatgattttaatacacagcagtggtcgtgatccttaaaacatctacagtagagaacacaagcatccaaaacagggtcttagcatgacaatacagtgactgcaaatcctagctttactatacctttgcgagccctacattacccactggtagagaaacttcacaaaaattataaacataaaatgaattcaagatcaccaatttttgttaaccacatagcaaacatctctaatgagaaacttaatggccaggcatagtggctcacacctgtaatcccaactgaggcgggagaatgtttgagcccaggagatgaaggctacagtgagctacaatggcgccactgtactccagcctgtgcaacaaagtgagacgctgtctctaaataaatagacagatagatatctaactagcaccgtaaaattaaataatgacagtcaaaacactgaaaaatgattagaaatgaactacaagtaacaggtaagttttttatagaggaatgcctttccaagataaaaactataaaaaattattcataggccgggcacagtggctcactgctggcctgtaatcccagcactttgggaggccgagatgggtggatcacctgaagtcaggggttcgagaccagcctggccaacatggtgaaaccccgtctctactaaaatacaaaaattagacaggggtggtgacaggtgcctgtaatctcagctactcgggaggctgtggcaggataatcacttgaacccaggaggcagaggttgcagtgagccaagatcatgccattgcactccagcctgggcaacaagagtgaaactctgtctcaaaaaaaaaaaaaaaaatttcattccatttcatttcgaaaccaagcaccaacatttatttacttcaccacctaataaagtatgagagaaaaacttcaggaaggggtgtgtattatgtagaattcaccattccttgttttattaacaatatcatgtttacttttgtcttctaactcccatttataaaataagcattaggaattatcatataaatatgccaataaatgtaagtcactatggctttcaatgtaagtttctaaaaaagcattaacaattgataaatactgagtgaaatcctttctacacattcaaaaagcatgtgtcagttaaataaatatactatatactccagtaaccactcataagtgtaaataatctcaagtgttattcatgaataggcaaaacagaatgtgatcacccctgacttctggcagctggctatcaactgaagctggtcaggtgacagacgttaatggtgcatgttgtgcctcccatccaagctcccagcttattcattctttcgtatttctactcatgcatcctgccaactaagagcacagcactgtaaagaggaaaagcttgtcaactgatggtgatgcaaaccaagctcctgtgtcaaatctttcctgggctctctcctgccacagaaattgatttgctttgtttttgagggaagagtatcttcagaagaagaactcctcccaggctccttctaaaagggtagagaacccttcatatgatacaagactttaacaaatggaatgtgctgctgtttcacattatgctactttaatgaccctgcattaatgatatcatttcatttctagcatacatttgtaattcatctactaacctagtgactctctagctatctgaccaacagtcatgctgtaggcttaaaagaatttaatgaattactattaatttaaaatagtgtagaaatgtacaaaagcatctacctttagtcttgcttcaataatctttgtcagcgtaagacagtctccatgaaaaccgctgcatccaatgactgttttgtctgttctgtaaaaagcacatttcagaaaactgagctggttagatagtagagcaaaacatatcttcggcaattttaaatttaaaattctgattcccactattccctaaatggtaatgggacaaacagtcacccttctggggaggaggggtctgtattccatcttaccccttattccagatgaattacaggtggatcaaagactttaaaaatgcgactatgaatggactaaataaatcatgggtgaattttttttactatcttgggctgaggaagatacgtaggtaggttaattgactgatttttgagacggagtttcgctcttgtcacccaggctggaatgcagtggcgcaatcttggctcactgcaacttccgcctcctgggttcaagcaattcccctgcctcagcctcccaagtatctgggattacaggcacccgccaccacacccagctgatttttgtatttttagtacagatggggtttcaccatgttggccaggctggtctcaaactcctgacctcaggtaatccacctgccttggcctccaaagtgctgggattacaggtgtgaaccactgcacccagcctcgtgaaggtagatttaaacaacacaatccaagggccacacagaaaaatttcataaatttgactacataaaattctacagggaaatttaagaatagctttttaaaaccctaagaaaatatattagtagcatctacccccaaagtctaattttaattctataaaaattcttacaaataaggaaagcaataacataaaggaaagatgggtaacttctatgaacagacaagtcacagaaaaaagagacattaagtcaccataaacataagagcctctatgttactcagaaatccaaatctcaaaaagagactatttcaaccaattatactggctaaaaatgcctaactaactaaatgctggtgaggttgtggaaacagtataaactgattaacctgttagatgggcaatttggtggtatttattaaaaatttaaatacacaccactctcaccaattctattgctagaaatccatcttgttaatatacttatccaagtatgcaaagggatgctctagactcaccagtgagtactcatttaaatagcaccccaaaacaaaacaaaacctaaatgtccatctgtatggagaggattaaaatttggtatagacatacaaattcaaccgtgtatttcaaaaattaattcctagatcttgatatgaatctataaagaaacctaaacaatattttgcagaggccacacaattcctcttggaaacttacgaatgactcgcacaaaccatacctgtcctactaggagagcagctgacacctctagggtcatcactaacatcacctgatctatgcctaccatcaacctcactgcactaaggtgaagacgtccaatcccctataaggctttactgcctttactgacaagattggttgacaataccaacagggaaagacagaaatcttagaacttcaagatgcttttcccaaatatccaggtgcatcaaaggaatgggagttttcatgcaaagaatacagtctgaaacaggtttggaagaggcaagcttagttctaggtcagacccacaggacgtgggatgagggatatatacaggcattcgttaatgctgcattgttcttattctctatctctatatctgacgtgtttcacaaaaaaaaaaaaaaaaagtgctcacttcaccagcaaacgtaactaaagcaatatttaaaagatgagtaaaagctagtacaaggatggtatccataaagttgttttaaaatcttatttctaatatttactactttcaagttgtacaagtgtcgtccttgaggagaaaaaaaggtaacacaagagcaccataaacagaaagcagaaagggggtatcaaaagatgcaagtggagagaaacagaactgggaagacgaaaacaaacttcattgctttttaagatgtgggccatccctaggagcaggaaagacaacgtatcttttcttctgtacctacttcctacaatacaaggagggtccatccaaaggacctaaacctcgtaagtcccattcctattacaattcaagtttaattaacccaggaattcatgaccatttataagcatttccaaaactggtaaatacagaccactgccaatctgcagtatgtattcagtatttatgcaggctttttgtttttttaagttttggctttattttcatgttttaggaaaaacatagctagcctattaaaactgagctgtggacataattgcttaggatatttctaaaacgaatgtttcaggtaaaaaaaaaaagtgtggggaggcagatttaaaaaaaatatcatttaatggattaatggtgctgtggtttgaatattcccttcaaaactcatgttgaaatttaattgccattgtgatggtactgggagttgggaccaggtgtttaggtcctagggctcagctttcatgaatggacattatcacagcagtgggttcgcttgctcttctttctttctctggccttccaccatgttaagacacagcaggaaatttttcatggtaaaatgctggggtgaacacatttaggttaccgaaagcacttttggtaccctgaatacagcaaatattattaagactgcacattaaattattaggaaacattaacttagaaaatggttttctaataaaaatgctcccaacagcaacttaaaaactcatgaaacaaatcatttagaagtagaaactctcacaacatcaaatcattacaaaggcattgtgaaatgtctttagaaatatttacttacaatttgtaacatttggggctatcccgcgtatgaattgaaaacccttcactcaatcgagtatcagaagcaacaattgcaaaatcttctccagcaattgccagtatagtactgaggaaaaaagaaaaaaattaattctccagggtggtaatcctatccctacaaatagaagaatgctccatagtacataatgggataaaatactctagatgtcaacaaaaacatgattcaaatgggaagaggaaagatgagcgggaagagaatgaacgcctggctacgagttgtctgggaaaaaaaaattattaataagcctaaatcagggcaaagtctccttggcaggagttaacagaaaagccaatgaattatcatcaccaacacattaaatacttactcgcgcaaggtactactaatacagaacaactaaataccacatctgtgcccttgaggatcaggtatagacagtggtactacaacgcaagctctatgagtttagagaagatgagatttttttttcttgcttcatttctttatatccaagtccttatataacgcctatataatgcttatttctttatacccaatcccttatataatgacaaatagatggacaaacagtaaatttttccctctgtggctgtacaatttgacagcttatcaaagagacttacagtagaattccaaaagcagaccgcctgggttctaattctggctttcccgtttcgcagatatgagactgtgggtaagttacttctcaaagcgtcaatttcatcatatatacaacagagatcactgcagttgctacctcattagggtgttcaaaggatcaaatatgtaagcccttatagcagtccctgacatgtaactggtcctctagtaagtgttagctataagtgctatggcactggagtatgactaagcacctgggctctggaattacatgagacagagacccactcttgctacttactaggtatgtgatcttggacaaatcctccaaatgcaagttgatgataacagtacctgtgtcacaaggtgtgtatatatatttgggtgtgtatattttaatgtacaaggcttgactgataactataaccactgcttcaatgcaatagtggaaattaaaggcatggtgcctcacagacgtaagcactcaggaaacttaagccactatttttactgaggagggatttgtgctaaagctctcaagaagaaaaggatggcattccaggtaatataaacagcaagcaatggcaaacaggtaattattcaaatagtacatacattcaagcaactcattcaggcagccctttttgcataagcacatgtagtgacgttaaggtttatgtgatggacagggttcctactgtagaaaatcccaaatgccaagctaaagattttggaattttagcaagaaatcatgaaggtattctgagcaagaatgatctgtagttgtaactactcaagaggctgaggtgggaggactgcttgagcccaggtgttcaaggctgcagtgagctatgatcgtgcctgggcattagagtgagacctggtctttaaaaaaggaatgcaagagagagaaaagttccatttacaaagtggggttttaggaagactgctctgacaataacatagtatgtgaaatgggacagaaacactgttctaatactactaatgcaatagtaaggtagcagggtgaacagtaaatccaaaatcatcacaaacacacaaaatagacaaatttttatatctacgcaaatgttttag

SEQ ID NO: 519 - DNA, 22147 bp, Homo sapiens
gtttaggtgttgtcagcctgatgtgttggtcttttatctaacggtttttgggtttctgtggttttttgtttcatttgtgggtcttttttttttttttgagatggtcttgctttgtcacccaggttggagtgcagtgatgcaatcagggctcactgcagcctcaacctcctgggctcgggtgatccttccacctcagcctcctgagtagctggaactacaggttgtgtaccgccatgcccagataatttttgaatttttgtagagatgaggtctcactaatgttgtccaggctgggctcaagggatcctcccgcctcagccttccaaagtactgggattacaggtgtgagccactgcgtccagcctatttaatggcttttgaatagccgttgataattgcctggacctactacttccttaagggtgcaaaatggtgatttttttgaattatatcgttccctctgcatttagtagctggaatcctataaaggaatcttcctcatcgtctgtttgattaccctgaaatactattttcacagaaaagaagggaaaatgcctgttatcacctctaacagttttcagaacaatgagttagtgccctggcaagggccagtgacagggcaggagggggtggagagcgtgtttcctgggctgcctggtgaactctcacgtctgtcaattgcaggcttgctttttcatgcccaacttgtctatctttgcccagaggcggcctcaggttgacctctgtagtcctttgacacaagccttgggtcttgggcaccttccttacttacagctaccacgatgctgcaggctccagcccctccctggcatttcctgttgcggacccggcccaaccatctccccagggtgcactcagtcggtgtgaatatggtgtttagagaccccagtctggtcaccaggggtggggcttgctcctgggatttcgttactgctagggctttggaagagacagagccaggaaataagttttttttttttttttttgccaattttaaaaaaataaagtatgaggctgggcacggtggctcatgcctgtaatcccagcactttgggaggctgaggcgggcagatcacttgagctcaggagtttgagaccagcctggccaacatggtgaaacccagtctctactaaaaatacaaaaatcggctgggtgtgatggcgcacgcctgtaatcccagctacttcagaggctaaagcaggaggatccctcgaacccaggagttcaagactgcagtgagctatgattgtgccactgcactctagcctgggtgacagagaccctgtctcaaaaaaacaaacaaacaaaaaacctctgtggactccgggtgataatgacatgtcaatgtggattcatcaggtgttaacagctgtaccccctggtgggggatgttgataacgggggagactggagtggggcgaggacatacgggaaatctctgtaatcttcctctaattttgctgtgaacctaaagctgctctaaaaatgtacatagatataaactggggccttcctttccctctgccctgccccagccctcccccacctccttcctctccctgctgcctcccctctgccctcccctttcctccttagccactgtaaatgacactgcagcaaaggtctgaggcaaatgcctttgccctggggcgccccagccacctgcaggccccttatttcctgtggccgagctcctcctcccaccctccagtcctttccccagcctccctcgcccactaggcctcctgaattgctggcaccggctgtggtcgacagacagagggacagacgtggctctgcaggtccactcggtccctggcaccggccgcaggggtggcagaacgggagtgtggttggtgtgggaagcacaggccccagtgtctcctgggggactgttgggtgggaaggctctggctgccctcaccctgttcccatcactgcagagggctgtgcggtggctggagctgccactgagtgtctcggtgagggtgacctcacactggctgagcttaaaggccccatctgaagactttgttcgtggtgttctttcacttctcagagcctttcctggctccaggattaatacctgttcacagaaaatacgagtcgcctcctcctccacaacctcacacgaccttctcccttccctcccactggcctctttccctccccttctgtcactctgcctgggcatgccccagggcctcggctgggccctttgtttccacagggaaacctacatggttgggctagatgcctccgcacccccccacccacaccccctgagcctctagtcctccctcccaggacacatcaggctggatggtgacacttccacacccttgagtgggactgccttgtgctgctctgggattcgcacccagcttggactacccgctccacgggccccaggaaaagctcgtacagataaggtcagccacatgagtggagggcctgcagcatgctgccctttctgtcccagaagtcacgtgctcggtcccctctgaagcccctttggggacctaggggacaagcagggcatggagacatggagacaaagtatgcccttttctctgacagtgacaccaagccctgtgaacaaaccagaaggcagggcactgtgcaccctgcccggccccaccatcccccttaccacccgccaccttgccacctgcctctgctcccaggtaagtggtaacctgcacaggtgcactgtgggtttggggaaaactggatctccctgcacctgagggggtagaggggagggagtgcctgagagctcatgaacaagcatgtgaccttggatccagctccataaatacccgaggcccagggggagggccacccagaggctgatgctcaccatggggcgcctgcaactggttgtgttgggcctcacctgctgctgggcagtggcgagtgccgcgaaggtaagagcccagcagaggggcaggtcctgctgctctctcgctcaatcagatctggaaacttcgggccaggctgagaaagagcccagcacagccccgcagcagatcccgggcactcacgctcatttctatggggacaggtgccaggtagaacacaggatgcccaattccatttgaatttcagataaactgccaagaactgctgtgtaagtatgtcccatgcaatatttgaaacaaatttctatgggccgggcgcagtggctcacacctgcaatcccaccagtttgggaggccgaggtgggtggatcacttgaggtcaggagttggagaccagcctggccaacatggtgaaaccccgtctctactaaaaatacaaatattaatcgggcgtggtggtgggtgcctgtaatcccagctactcgggaggctgaggcaggagaaccgcttgaagctgggaggtggagattgcggtgagctgagatcacgctactgcactccagcctgggtgacagggcgagactctgtctcaaaaaatagaaaaagaaaaaaatgaaacatactaaaaaacaattcactgtttacctgaaattcaaatgtaactgggcctcttgaatttacatttgctaatcctggtgattccacctctctgttgttcccattttacagaaggggaaacgggcccaggggcagggagtgtggagagcaggcagacgggtggagagaagcaggcaggcagtttgcccagcatggcacagctgctgcctcctattcctgtgcaggaagctgaaagccgagctactccacacccgggtccgggtccctccagaaagagagccggcaggcaggagctctctcgaggcatccataaattctaccctctctgcctgtgaaggagaagccacagaaaccccaagccccacaggaagccggtgtcggtgcccggcccagtccctgcccccagcaggagtcacacaggggaccccagatcccaaccacgctgttctgccgcctgcggtgtctcaggccctggggactcctgtctccacctctgctgcctgctctccacactccctggccctgggaccgggaggtttgggcagtggtcctgggctcctgactcaaaggagaggtcaccttcttcttgggcgagctcttcttggggtgctgagaggccttcggcaggtcatcacgacccctccccatttccccaccctgaggccctctggccagtctcaattgcacagggatcacgccactggcacaaggagacacagatgcctcgcaggggatgcccacgatgcctgcatgtgttgcttctggttcctttcctccagttccaaccgccgcactctcccacaccagtgtgacagggggcccatcaccctagacttcagagggctgctgggaccctggctgggcctgggggtgtagggccaccctgcccttccccacctggaacctggcacaggtgacagccagcaagcaatgacctggtcccaccatgcaccacgggaagagggagctgctgcccaagatggacaggaggtggcactggggcagacagctgcttctcaacagggtgacttcaagcccaaaagctgcccagcctcagttccgtcagggacagagggtggatgagcaccaacctccaggcccctcgtgggggtggacagcttggtgcacagaggccattttcatggcacagggaagcgtggcgggggtgggaggtgtggtccctagggggttctttaccagcagggggctcaggaactgtggggacttgggcatggggccatcgactttgtgcccagccagctaggccctgtgcagggagatgggaggagggaaaagcaggccccacccctcagaaaggaggaaggttggtgtgaaacatcccgggtacactgagcattgggtacactcctcccgggagctggacaggcctcccatgtgatggcaaacaggccgacaggagacacggctgttgctcgtcttccacatggggaaactgaggatcggagtcaaagctgggcggccatagccagaacccaaacctccatcccacctcttggccggcttccctagtgggaacactggttgaaccagtttcctctaagattctgggagcaggacacccccagggataaggagaggaacaggaatcctaaagccctgagcattgcagggcagggggtgctgcctgggtctcctgtgcagagctgtcctgctttgaagctgtctttgcctctgggcacgcggagtcggcttgccttgccccctccggattcaggccgatggggcttgagcccccctgaccctgcccgtgtctccctcgcagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaaggtgggagtgggtggtgccggactggccctgcggcggggcgggtgagggcggctgccttcctcatgccaactcctgccacctgcagggaccctgaaggccaagaacttcaagaagagatgcctgcaggccaccatcacccaggacagcacctacggggatgaagactgcctgtacctcaacatttgggtgccccagggcaggaagcaaggtctgcctcccctctactccccaagggaccctcccatgcagccactgccccgggtctactcctggcttgagtctgggggctgcaaagctgaacttccatgaaatcccacagaggcggggaggggagcgcccactgccgttgcccagcctggggcagggcagcgccttggagcacctccctgtcttggccccaggcacctgctgcacagggacaggggaccggctggagacagggccaggcggggcgtctggggtcaccagccgctcccccatctcagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtgcgtgggtgccttcggccctgaggtggggcgaccagcatgctgagcccagcagggagattttcctcagcacccctcaccccaaacaaccagtggcggttcacagaaagacccggaagctggagtagaatcatgagatgcaggaggcccttggtagctgtagtaaaataaaagatgctgcagaggccgggagagatggctcacgcctgtaatcccagcactttaggaggcccacacaggtgggtcacttgagcgcagaagttcaagaccagcctgaaaatcactgggagacccccatctctacacaaaaattaaaaattagctggggactgggcgcggcggctcacccctgtaatcccagcacgttgggagcccaaggtgggtagatcacctgaggtcaggagtttgagaccagcctgactaaaatggagaaacctcttctctactaaaaatacaaaattagccaggcgtggtggcgcttgcctgtaatcccagctactcgggaggctgaggcaggagaatcgcttgaactcaggaggcggaggttgcggtgagccgagatcatgccactgcactccagcctggagaacaagagtaaaactctgtctcaaaaaaaaaaaaaaaaaaaaaaatagccaggcgtggtatctcatgcctctgtcctcagctacctgggaggcagaggtggaaggatcgcttgagcccaggggttcaaagctgcagtgagccgtggtcgtgccactgcactccagcctgggcgacagagtgaggccccatctcaaaaataagaggctgtgggacagacagacaggcagacaggctgaggctcagagagaaaccaggagagcagagctgagtgagagacagagaacaataccttgaggcagagacagctgtggacacagaagtggcaggacacagacaggagggactggggcaggggcaggagaggtgcatgggcctgaccatcctgcccccgacaaacaccaccccctccagcaccacaccaacccaacctcctggggacccaccccatacagcaccgcacccgactcagcctcctggggacccacccactccagcaaccaacgtgacctagtctcctggggacccaccccctccagcaccctacccgacccagcttcttagggacccaccatttgccaactggggctctgccatggccccaactctgttgagggcatttccaccccacctatgctgatctcccctcctggaggccaggcctgggccactggtctctagcaccccctcccctgccctgcccccaggtaactatggccttcgggatcagcacatggccattgcttgggtgaagaggaatatcgcggccttcgggggggaccccaacaacatcacgctcttcggggagtctgctggaggtgccagcgtctctctgcaggtctcgggatccctgtggggagggcctgccccacaggttgagaggaagctcaaacgggaaggggagggtgggaggaggagcgtggagctggggctgtggtgctggggtgtccttgtcccagcgtggggtgggcagagtggggagcggccttggtgacgggatttctgggtcccgtagaccctctccccctacaacaagggcctcatccggcgagccatcagccagagcggcgtggccctgagtccctgggtcatccagaaaaacccactcttctgggccaaaaaggtaaacggaggagggcagggctgggcggggtgggggctgtccacatttccgttctttatcctggaccccatccttgccttcaaatggttctgagccctgagctccggcctcacctacctgctggccttggttctgcccccaggtggctgagaaggtgggttgccctgtgggtgatgccgccaggatggcccagtgtctgaaggttactgatccccgagccctgacgctggcctataaggtgccgctggcaggcctggagtgtgagtagctgctcgggttggcccatggggtctcgaggtgggggttgaggggggtactgccagggagtactccggaggagagaggaaggtgccagagctgcggtcttgtcctgtcaccaactagctggtgtctcccctcgaaggccccagctgtaagggagagggggtgccgtttcttctttttttttgagatggagtctcactgttgcccaggctggagtgcagtgtcacgatctcagctcactgcaacctccacctcctgggttcaagtgattctctgactcaacctcccatgtagctgggactacaggcacatgccaccatgcccagataatttttctgtgtgtttagtagggatggagtttcatcgtgttagctaggatgatctcggtcttgggacctcatgatctgcccacctcggcctcccaaagtgctggaattacaggcgtgagccactgtgcccggccccttctttattcttatctcccatgagttacagactcccctttgagaagctgatgaacatttggggccccctcccccacctcatgcattcatatgcagtcatttgcatataattttagggagactcatagacctcagaccaagagcctttgtgctagatgaccgttcattcattcgttcattcattcagcaaacatttactgaaccgtagcactggggcccagcctccagctccactattctgtaccccgggaaggcctggggacccattccacaaacacctctgcatgtcagccttaccagcttgctacgctaaggctgtccctcactcattcttctatggcaacatgccatgaagccaagtcatctgcacgtttacctgacatgagctcaactgcacgggctggacaagcccaaacaaagcaacccccacggccccgctagaagcaaaacctgctgtgctgggcccagtgacagccaggccccgcctgcctcagcagccactgggtcctctaggggcccgtccaggggtctggagtacaatgcagacctcccaccatttttggctgatggactggaacccagccctgagagagggagctccttctccatcagttccctcagtggcttctaagtttcctccttcctgcttcaggcccagcaaagagagagaggagagggaggggctgccgctgaagaggacagatctggccctagacagtgactctcagcctggggacgtgtggcagggcctggagacatctgtgattgtcacagctggggagggggtgctcctggcacctcgtgggtcgaggccggggatgctctaaacatcctacagggcacaggatgcccctgatggtgcagaatcaaccctgccccaagtgtccatagatcagagaagggaggacatagccaattccagccctgagaggcaaggggcggctcaggggaaactgggaggtacaagaacctgctaacctgctggctctcccacccagaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggagtaagcagggggcacaggactcaggggcgacccgtgcgggagggccgccgggaaagcactggcgagggggccagcctggaggaggaaggcattgagtggaggactgggagtgaggaagttagcaccggtcggggtgagtatgcacacaccttcctgttggcacaggctgagtgtcagtgcctacttgattcccccagggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagtgaggatctgggcagcgggtggctcctgggggccttcctggggtgctgcaccttccagccgaggcctcgctgtgggtggctctcaggtgtctgggttgtctgggaaagtggtgcttgagtccccacctgtgcctgcctgatccactttgctgaggcctggcaagacttgagggcctctttttacctcccagcctacagggctttacaaaccctatgatcctctgccctgctcagccctgcaccccatggtccttcccactggagagttcttgagctaccttccatcccccatgctgtgtgcactgagagaacactggacaatagtttctatccactgactcttatgggcctcaactttgcccataatttcagcccaccaccacattaaaaatcttcatgtaataatagccaattataataaaaaataaggccagacacagtagctcatgcctgtaatcccagcacattgggaggtcaaggtgggaggatcacttgaggtcaggagtctgagactagtctggccaacatggcaaaaccccatctctactaaaaatacaaaaattatccaggcatggtggtgcatgcctataatcctagctactcaggaggctgaggtagcagaattgattgacccagggaggtggaggttgcagtgagccgagattacgccactgcactccagcaggggcaacagagtgagactgtgtctcgaataaataagtaaataaataataaaaataaaaaataagttaggaatacgaaaaagataggaagataaaagtatacctagaagtctaggatgaaagctttgcagcaactaagcagtacatttagctgtgagcctcctttcagtcaaggcaaaaagggaaacagttgagggcctataccttgtccaatctaattgaagaatgcacattcacttggagagcaaaatatttcttgatactgaattctagaaggaaggtgcctcacaatgttttgtggaggtgaagtataaattcagctgaaattgtggaacccatgaatccatgaatttggttctcagctttcccttccctgggtgtaagaagccccatctcttcatgtgaattccccagacacttccctgcccactgcccgggacctccctccaagtccggtctctgggctgatcggtccccagtgagcaccctgcctacttgggtggtctctcccctccaggagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacagggtaagacgtgggttgagtgcagggcggagggccacagccgagaagggcctcccaccacgaggccttgttccctcatttgccagtggagggactttgggcaagtcacttaacctccccctgcatcggaatccatgtgtgtttgaggatgagagttactggcagagccccaagcccatgcacgtgcacagccagtgcccagtatgcagtgaggggcatggtgcccagggccagctcagagggcggggatggctcaggcgtgcaggtggagagcagggcttcagccccctgggagtccccagcccctgcacagcctcttctcactctgcagggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgtcggtgtctttctttgctcccaaggctaagctgcaggatctgcctggcaattgcaggcttgctttttcatgcccagctcatcttatctttggccagaggcggcctcaggttgacctctgtagtcctttgactcaacccttgggtcttgggcaccttccttacttgcagccaccatgatggtgcaggctccagcccctccctggcatttcctgccatggacccggcccaaccatctccgcagggtgcactccttcgtcggtgtgaatatggtgtttagagaccccaatctggtcaccaggggtggtgcttgctcctgggatttcgttactgctagggctttggaagagacagagccaggaaataagtatttttttttaaccagtaaaaaaaaaaaaaagtatgaggccgggcacagtggctcacacctgtagtcccagcactttgggaggctgaggcaggaggatcacttgaggtcaggagttggagactagcctggccaacatggtgaaaccccatctgtactaaaaatacaaaaaattagccaggtgtggtagtgcgcacctgaggtcccagctgaggcaggagaatcacttgagctcgggaggtagaggctgcagtgagccgagatcgcaccactgcacttgagcctgggcaacagagcaaggcaccatctcaaataataataaaagtatgaattcatacaggtatttcccagttgtaagactgtcaggttttacttctctcattttacacttgtttctttctccgcctatgctgaaagtctgggttcgacagcaccaacataattgtttatgttctttttcctataacatacatatgctagttttgaaatataagatataggccgggtgcagtggctcacgcctgtaatcccagcgctttgggaggccaaggcaggcggatcacgaggtcaggagatcgagaccatcctggctaacacgatgaaaccccgtctctactaaaaaaatacaaaaaaagttagccaggcacggtggcgggcacctgtagtcccagctactcgggaggctgaggcaggagaatggtgggaacctgggaggcagagcttgcagtgagctgagatcacgccactgcactccaggctgggcgacagagcgagactccgtctcaaaaaaaaaaaaagaaatataagatattgcaataaatcatatgagttacatttaaagtacatgaatttaaataaattataaattatataaagtaatatatgataaaatattaagactactaaggatcatttaagatcgttttgctcattctccttaaattatcccacagaataaacaattgtgcctctaggtcccttaagtaactctgtggttacttaattggtagattaagccatctaccgatacacagttagaagtttggggtttttttaatcatgcagatgtagacactgaccaaagacttcttgttttttcctttgagactgagtttcgctcttatcacccaggctagggtgcaatggcatgatcttagctcactgcaacctctgcctcctgggttcaagctattctcctgcctcaggttcctgagtagctgggcctacaggcgtgcgccactacgttcggctgattttttttgacttttagtagagacagagtttcaccattttggccaggctgatcttgaactcttgacctcaggtgatctgcccgcctcagcctcccaatgtgctgggattacaggcatgagccactgtgctcagcccctacctaggacttttaagcggatgtttctctgcctgaaaacaaagtttaagtgttccttttagagcaacctgtaaacagtaactgtagaccctgatatttattgtgccatgaacttctcatccatagttttgctgagtgaaggtattgatgggaaatgtgaaattcagagaggcaggcacgggcccaggccacacagctggggagcggcagcattggttgggacctgtgttggatttgcaattctgccttgtgtgatgtaacctggacttcattaaaattaaaaatttctgctctgcaaagacactgttaggaaaacaaagacaagccacagactgggaaaacattagcaaaagacatccgataaagcactgttatccaaaaatatacaaagagcttttaacactcaataaataaaaaaaaaacctgattccacaatgggtcaaaggcagacacctcaccagagaagctatacaggtggcaaataagcatctgaaaagttaacctaggttgggtgcagtggctcacacctggaatcccatcacatgcggcggccaaggcaggaggatctcttgaggctagttaattcaagaccagcctggacagcagagtaagaccccatctgtatttttttcaaaaagatatccacatcatatgttgtcaggaaaacgcaaatttaaacagtgagctaccactgcatacctgtaagaatggccaaaatccagaaaattggccaaacaccaaatgctgatgaggacgtggagcaaccagaactctcattcagtgctgttgggaataacaaacggtacagccactttggaagacagtttggcagtttcccaaaacataatgcctatttcttccatgtgatccagcactctgattccttaagatttactcaacctgcaaacagatgtttatagctgtaaaccaaagataaaactccaagcccggcagctgactgaatggaacgccctcttggccagggaaacccaaagggacctgaaggttcaggccatgatgggcagtaggggtcggacatgcctcatcatactctcttccctttggaattcaggcacagctgaccagctttaaaacagagatcttaagactgacagaacagactctgtagaaataagatataaaattccaacctgactgaagtatagcatcacatgacagatagcaggtcatgaaacaaattgaaatattttaccccaaaatgtatttctttgacgtattttggaatggccctgcacagctgtctcttgtggaggaaatttgcattctgtagagaatctccttcccttaccaggtcatttctgaagagtccagcaccctttagaggtctgagaggaaacatttgccatctattgtctctaagggaagccatctatgagatttcatctacataacaaaaatcttggaccaggcacggtggctcatgcctgcaatcccagcactttgggaggccgaggtgggcagatcacctgaggtcgggagtttgagaccagcctgacgaacatggagaaacccaaactctactaaaaatacaaaaatttagctgggcgtggtggcgcatgcctgtaatcccagctattcagagggtggaggtaggagaattgcttgaacctgggaggtggagattgcagtgagcagagatcatgccattgcactccagcctgagcaacaagagtgaaactctgtctcaaaaaaaaaaaaaaaaaaaagaaagagaaagagagaaagaaaagaaaagaaagaaagaaagagaaccttggtcttcacaactttttaacttaaccaagatcctcctttgtattgattccagggtttttgataataactctttcaaccaattgctaattagaaaatctttgaattcacctgtgatttttaagccatcccaaaccctctcacattactgatttatgtcttatgtccccctgaaatgtataaaaccaagctgtaactcaactgcctggggcacatgttctcaggaactcttgacaccatgcctctggttacagtcaatcatatttggctcaggataaatctcgtcaaatattttacagtttgggttttttggtcaacatagcagatgtttatagtagctttatccatcattgccacaacctggaggtaaccaagaagtccttcagcaggtgaatggatacaatacatccagacaatggaatctttttcaggtctaatgttgcgggacgcagaggactagagagaccagtacaggtgaatacaggaggatatttattttaaggtatgcaccagctcagtggattcacatccaaaaaggtgagccttgaacaaagacagagtggggtttttataagcaggcttacaaaagaaaaacaaaggcagtcaatcatagagtgtataacttgtggtcttgcctagctggtggccttgtagctgtgtcaaaagaaaaacaagaactggctaaatacaaatatttgcaagacatagtcatgcttaagaggccagggaaaggagtaacagtaaaggaatttgtctttctctctttttttcctcagccttgctctggaggtggggggctgtctggagctcattcctttggccttggctttttggacagcgttatcttataactgtcctcgaagtgagctgctaagcagaggaaaacttgtttctttttctttttaaccctcactacatttttccccacttcaagtccttttataaaagaagtttaatagaaggcctcactattacttaattctgcgtcaagagacaagttttcttctttgggcaaaggttgatatttatgcagagccgtcagctgagtggtagtttgcctagctactattgcctctatagctgattgaatgcttctagcaaggagaggtaagagacaaaggagtattaggcaacttcctagtacagccagaactactgctattaaagtcttgaaccctctgaaaaatgaaaaccagtctccaaagagagaatctggagaccaccctttccaagtttgaactggaacatgggcgaattttctcattcttgcagttattcctataattgcctttccattgtcatcaatttccaggcagcaattagttcgattgaactttccacatcctcctccttcctgggcgaggaggcagtctaaagctaatctattttgatagatagcattcctcatttttgtagattgctgggctaatagatctaaagcccttgctgtttaattagtgatgatctcaagcactatctataacctcatgatgcagttaagcatgtaaataggagaccagtaaccccatgagccatcgtcccccaccaggtagctggcccatagtagtgaattattctctcagggggccattcatcatctttccagtcccctatggctgtgtctttctttacgctccttctatatctttctctcttctcatcatagacaggatactctaaggcttctccttgtcttagagggattaagaagaaagacggcctaattgttccaagtacacaggcccctgtccatttggctggtagctgtcggtaggcccgtggcccacagatccgatagagaccagagggtgcttgccaggtatttggagcttcaagctgataccaggtgtggtttagagcagagaaacgggagaatggatttggatgaggtggtttgggactatctttgccgcgccataaagtttttcctaattttttaacatgtttctgttccaaacatgttaattcccctactgggtctgtagaagtttttccctagcaagcaatacagtatttcccgataatagaagtttttaagagccagacgcttgaacttgtgggagtcagtttgcaggaagggtcagtcagagtaaagttattttgaggcattaactcttttgcttcccaaggccattggtctcccatgtttgtccctccacaaacataacatgaggagatgcctaggctgccagcaatgttttcagccatctgagcaaataggtttttggctaaagggggaggctcggcaacttttgatttatgtgctcatagaatgacttaaagactcggaattgctgctgggatgacttcttggtttgagtcctctttatgatatataaatttactttagctttttgactgctgctttgtaatgccatggagtaacctgtagtccatataggtagatccggctctaagatagtaagatttacaggattgcaagtgcttgtcttacagtccggttttgctggcgctttgatgagcaagattggctttagcctcagtgatgatcggtcagtgaactgtgttgtgcggttccagcaagctattgctagggccttggaggggcaaacagggtatgcacatacaattttgtactggcagtttgtacagtaccctgtaggaccagagattgtgagataggttgggttcacggatgttaactgacaaatatcaaagtatatggctatagccccccctggggggtagaggcttggctttgatttataagacttcctttctttgactcagtatgaacctcaaaccaagtcctaggtaaagacttagaaggtcatagcatatataaggctggccatttcctgggtcacaaattgaataggtgatccgattgtaagtacaagttcctaggtgagtccctgtacactcctaataagtatagaataatagagtcctagttatactgtttcctgaccctgtagtgtgtgtacaatggggacactttctaagggtacttattttaacatggtcaaggggggtgataacagcaaaacaatgtacagcgtattcatatccagcaaggacagaagagggccttgcctgggggaggagattgagcacagcaacggaacaatagtaaaacagttagtattataaggaagactactagtcctaagatttctaaccacatttacttgcttgacgagtcctcaagcttcggccgtgcgtagactagtcagcttcgggtgtgtgactagagcggggcttgtctccttaagcttcagccgtgcgttgactggtcagcctcacgagtgaccagagcagggtgatcgtcctcagcagcagcttgttgtcttctcaggatcagctgggttggatgatctgtgtcctgctggctggtccactcgtcctgagctgccggtttcagccgactgtggtggatccaagacataacacctgcaactttaacagcaacgggagtggacaagatgacagtacagggcccaccccatatgggtcctagagaagttggattccactttttaacccaaacagagtctccagatttaaaggggcacactggtctatcaggcttacaggcatcctttcttgtacccagccatggacctcttgcatggctattcctaaagcctgcatttgctttcttaaggttaattcctctagttcctggagatcacctttaatttgacctatgatttggggttggccaactgaacaaaacctcatagggtaaatactcagtttgtttggtgggggtgcacctgtctcggaggaggaccataggcaaaacctgaacttatctcagatgagcttcctggcaatatttcttcagtagctgcttgagtgtccacttcatgcgttccacttttcctcaactatgcagccaataggctgtgtgtaacttccattttatttttaacagtcttgttaaatctcgtactatttcagctacaaatgccggcccattgtctgactgtaaagatagaggcagtccaaacctggggataatatcttttaacagtactttagtcatttgtcgtgctttttctgtcctggtggggaaagcttcaacctatcctgaaaaagatgcaaataaacactagaatataccgatagcttctggcacggggcatttcgtttaagtctataaggaagttttcacaaggcatggctccttctcctgttctgtttcccagaggaggggttccttttctcctctttttgtaacttcatataatagctcagccatcagcgagaaatctggaatccagatacggcagaatcctgctgccttcaacttctaatgtgaccacagactcctggaggcccagtgagaaggagcccggtctgtcctagtcctcacatccttcagctcctgccagcccaatcagattagtatctggttcctctaaggtatggcagcccttggccaatggcctctttgtctcacggccttggccatttccctcattgccttctggacattcatccttccagtgcccccttttttttttttttttttttttttttttgcatctctcacattgatccctctctagccttggtcagctcttaaatccttgtctaacttgacctcttccacgtccacatctgcgtccacatcctctcacatggctaatttctctttctataagggctgctgccaacagatccgcctttttcttaagcctttcatctgcttccttttcccttccttagttctcctgctcctgcagtcggctggcagggctgggcaaggacaaacctgaatataaaattcagtgtgtctgctgcccaccagtcctttatgcttggagaagagagagatgtttctctttttcctctcttctatctattaaacctccgctcctaaagtcctcgtgtttgtccctgtcctaaattttcctggtgcatgacgacaaaccccgggtatgtagaccagacaatgtagccgcttcaagggatttgagtgaggaaggaatgaatcaatggagcccaggggggttttagagcattcaaactattcaggatgatactatggggaccaagggagagctttccccttctccctctgaaggaccactgaaaaatcactgacagattgtctcataggagaaaagcatacatatttgtttaatgcgtatacacgggagcctttgaaatggagacccaacttctcaacagagtacagagcttagataccatcttgaggttccacaaagaatgtgggctcagagcatggccaaaactaggttaggggctgggcgcagtggctcacaactgtcatcccagcactttgggaggctgaggcgggcagatcacttgagctcaggagttcgagaccagcctggccaacatggcgaaactccctctctactaaaaatacaaaaattagccgggtgtgatggcgggcgcctgtaatcccagctacttgagaggctaaagcaggaggatcccttgagcccaggagttcaagactgcagtgagctgttattgtgccactgccctctagcctgggtgatagtgagaccctgtctcaaaacaaacaaaaaaacccctaaatctgtggactctgggtgattatgacatgtcaatgtaggttcataaagtataacagctgtaccccctggtgggggatgttgataatgggggagactgggttggggcgaggacatacgggaaatctctgtaaccttcttctaattttgctgtgaacctaaatctgctctaaaaatgtatatatataaaaagtggggccttcctttccctctcccctgccccagccctctcccccacctccttcctctccctgctgcctcccctctgccctcccctttcctccttagccactgtaaatgacactgcagtgaatatcctggagcacaaagggcatgtc

SEQ ID NO: 520 - DNA, 22234 bp, Homo sapiens
agacccttttccaaaaatatattcaattgtcttaagatttattatttcaaaagtgatacatagaattctatctttgaggaagatgggataggtgttttttctgtactcctcccactaagaacaactaaaatccctgggcaatacacataaaagaaagaagataagactctgaaaggtgtagagaagaaggcagactggctagggaacctcagattccaagggaagatatggaggtgagttctaaagattttctttccccatcgtatattccagacttggaaataaagaagccagcaacccataaataccaatggtaaccaaccaaaagagaccacaaaagcctgctctttagcgaaaggaccaggaaagggacagcgcagcaaaaaagaaaactttaacaataaatcctataaactaacaaaacaacaagaaaaaactggccctacccacaccagcataagttgaatggggagtctagagctccatctttgccagtatggatcaagtcatcccagcctcctgctaggttggtatcagagacgaccgagcagagaactgggaattttcatccccacagggtagttcaaaccctcctccacctcatggtatcagtagaaaccacatagaaagtctagacatccccacacctggcagtaataacctctcccctccctgcagctgccatcaccaccaccacctccctgctgtagtggaatcagaggaggacaagtagagagttagggcttatgccattgtccagtgataatgaggccaccctggcctcagtgttagtggaagccacataaggagctagaactcctatacctgcccagcagtaatgagagaccctttcttgggtattaatggaggccaagagggaaacccggacttttacttccactaggaagtagcaaagcagcactcccttctctcccccactggaatagggtcaaaggaaaccagttgaaacaaagtttaaataaaatcccaagtctcatggtatcaaaagcatccaggtttggcaaaaatcattcatcacactaaaaaccagaaagataaacaaagagtgaggagaaaacctaatcaacagattacaacaccaagatgacaaagatgttagaattatgacaaagattttaaaggagcatcagaaaagtgcttcaacaagcgattatgaacatgcttgaaacaaatgagataagtctcagcaacgaatggtaaagtcacagcaaaaaaatcgaagacagaactaaatgaacgttttagaaatgaaaaatgtaaaaactaaaatataaagcttcgtgaataggctcaacagtaaaacggaagagatagaggaaaaatcatcaatgtttttagatagaacaatcaaaaattatttaatctgaatgaaagagaaaaaaagactgaggaaatgaatgcatagagcaccaggggcatatggtactatagcaaaagatggagcattcaagtaatcaaagactcagaaagagaaaagaaaggggtaggctgaaaaaaaatactcagagaatagctgaaaactttccaaatttggaaagagatataaccccacagatttaaaaagctgaatgaatcccaaacaggaaaacccaaagaactccacaccaccacatcataattaaatttctgaaaacaaaaagcaaagaaaaaatcttgaaagcagccagagaaaaatgacaccctaccactagaggaaaaacaactggaatgacagcaaccttctcatcagaaaccaggaagccaggaagaagtggcacaatatttttctaatgctgaatgaaaagagctgtcaacccaaaattctatacaaagggaaatattctttaagaatgagaaggagaaacaatacattctcagatgaatcaaagctaagaataagccgggtgcagtgactcatgcctgtaatcccaacacttctggaggccaaggtgggaggatcatttgagcctaggagtataagacgagcctggacaacagagtgagaccctgttctctatttttaaaaaagagctaagaatatatcaagcataactcacctaaaagaatggctaaatgaagttctctaaatagaagggaaacaaaagaaagaacttgtaacatcaggaaggaagaacacaggaagtgaaattatggataaatatgatagactttccttctcttgagtttctaaattatgtttaacagttgaagtgaaaactataacatggtctattatagctctaaatatatgtagaggaaatatttaatgcaagtatattataaatgggggaagataacaagacaaagggaagtaaggtttttatattttacttgaacttataaaataacactggtagactgtggcaagttacatacatataatgcaatacctagagcaaccactaaaaaagctatacaaagaaatatgctcaaaaacactaaagatatgccaaaatgaaattctaaaaagtgttcaagtaacccacaagaaggtaaggaacagaaaattgagaaatgaaaaagaacagaaaacaaaaactaagtggtaaactcgaggcctaacatatttataattgcaataaatgcaaatagtctagaaacaccagttaagagacagaaattggtagagtgaactaaaaataagacacaatatgccatctacaagaaactcacctcgaatataataaaataagcatattgaaaataaaaagatcaaaaatagatactatgcaaacattaatcaaaagaaagcaggaatggctatattaatatcagataaagccgacatcacagcaaagtagattaccagaaacaggaacattacataatgatgaaagggtcaatctaccaagaatacatagcagtcctaaatgcttatatacacaacagaactgcaacacatgtgaaacacagagaaacggacaaatcacaattatagttggagacttcaatacctcctctcagcaatttatagaactagacagaaaatcagcaaggatataaaagaactcgacaccatcaatcaacattatctaattaacatttatgggacattccccccaacaacaacaggatgtacattcttttcaagtgcccacaggatatgcatcaaaaatcatatcctggggcataaacaaacctcaacaaatttttttaaattgaaaacatgcagagtgtattgtccaaccagaacagaaccaaattagaaataaataacaaaaaccggtaaatctccaaacacttagaaactaaacaaaatacttctaaataatccaatggttaaagaagtcttagggaaataaaagatacattgaaatgaatatcaaagaaaatacaacatatcaaaatttacaacacacagctaaagcagtgctgagaggcaaatttataatactaagtatatacattagaaaagagggaaagtgtcaattcaataatcttagcttctaccccaaaaatctagaaaaagagtaaaataaacccaaagcaagcagaagaaaggaagtaatagcaaaaataaatgaaactaaacacaaaacaatagaaaaaaacacagtaaagcaaagagctatttctttggaaaggtcaataaaattgacaaccctctagaattaaaccctctgacaattaaaaagaaagtgaagacacaaattaccaatatcaagaatgaatgtagggataccactgcagacctgcagacaccaaaaggataataaggaaacactataaacaactccacatgcataaatttcagagataaaataggctaatttgttaagaaacacaaagtattacaactcacccaatatgacacatattatttaaataatcctaaaactattaaggaaattgaatttataattttttgatttccaaggaagaagtctccaggcccagatagcttcataatataattctaccaaacatttaaaaataggattaacatcaactctatgcaatttcttctataaaatagaagagcattacattctgatctactttatgaagtgtttacagtatgtatataataaattacatattgtactatatatttatagtattactctgataacaaaaccaaagatagtacaaaaaattagaactgtagaccaatatatttcatgaatataaatgtaaaaacccttgaaatattagcaaataaatttcagcaatatataaaatgaattatatgccatgatcaagttgggtttatttcatggatgcaaagctggttcagtatattttttaaaaaaatcatagtaatccacatgtcaataggctaaagaagaaaaattatatgattatataaatggatgcagaaaaagcatttcacaaaatccaacatccatttatgattaaaaccctcaaaaaatgggactagaagggaacttcctcaatttgatttttttaaaaggtagtatctacaaaattgatgagtatctacttaatggtgaaggattgctttctcccaaaaaaaggaacaagtcaaggatatctgttcttagcactcctattcaacatagagccaaaagttacacccatgaaaagcacaaaaaaaagaaataaaatgcatccatattgggaaagaaataaataaaactatccctatgcagatgacatgattgtcaatacagaaaatcccaagcaatctacacagagataaaaaaaattcctggaataactaagttcagcaacatctagaaaggacaaaaggaaaacacacaaaaatcacctgtatttctatatattaccaatgaacatatggatactgaaactaaaaatataacaccatttataattgatcaaaaaatgaaattcttagatataaatctaaaaatcatgtacaagagttgtataacacacacacacgaagaaattgatctaaataaatggagaaacatattgtgttcataaattgaaatactcaacatagtagagacatcctttctctccagattgatatatagggtgaatacaattcctttcaaaatctcagcaagatttttcatagatatagacaagatcattccaaaatgtacatggaaagggaaagaaactggaatagctaaagtaatttttagaaagaataaagtgggaagaatctatccagtttcaagatttacacagctacagtaatcaaaactgtgtggtgttggcagaagaataaacacacaggccaagaacacagaacacagaaatacacccacagtgatatactcaactgaattttcacaaagatgcaagaacaatttgatggaggaaagatagtcttttcattttaacaaatggtgctggagtaagtggatattcatagaggagaaaaaagcactttaatctaagtctggtatctcatacaaaaaattaactcaaaatagatggcaaactaaatgtaaaacataaaactttagaaaaaaaaaaacttcaggatctagagctaggcaaaaagctctaaaacttgacaccaaatcatgatctataagagaaaaatgaatgaattcgacttcatcaaaattaaaagattttgatctgtgaaagacgtcattaagaggataaaacacaacgtagaagtctgagcaagatggcctaatagaaccctctagcaagcatccccctacaggaacaccaaattgaacaactacccatgcaagaaagcaccttcgcaagaaccaaaataacccagcccaccaaggcagttcctcaaggagccagcagaaattgcagcattcctgtgcttagggtacaccccagtgctgatacacctgcagtgaccacaagcttagatcacaacactcaatccccttttaatatgtggaaagccttctcaagaagggcaggtacaaataaatccagattacaaagattggaatacttaattcttcaatgcccaaacattgatgagtggccacaagcatcaacaacatccaagaaaacatgacttcactaaataaactaaattagacaccagtgaccaatcccacagtgatgaagatatcatctttcaaacagggaatcagaatcaccaccttgaggaagctcagcaacatagataaaaagataacagagaaggaattgagaattctttcagaaaattcaacaaaaagattgaaataatttgttttaaatcaagcaaaaattctggagctaaaaaattcaactgataaactgaaaaatgcatcagaatcaacagcaaattgaccaagctgaagaaagaatcagtgagtttgagtcaggctacatgaaaacagacagtcagagaagagaaaagaataaaaaagaagcacacctacaagatctagaaaatagcctcaaaacagcaaatctaagagttattacccttaaagaggacagacaaagagagacagagagaaatatcagggtagaaagttcattcaaagaaatgacagaaatttccaagcctggagacatgaatatccaagtacaagaaggtcataggacaccaaaaagattcaacctaaataagactatctcaaggtatacaataatgaaacccttaaagaacaaggataaagaatcctaaaagtagtaagagaaaataagcaaataacatagaaaggatctctggtatatctggcagcagacatcttcatggaaatctcacaggccaagagagtggaatgacattcaaagtgccaaagaaaaaagaaagtctaacctagaatatcatatctagcagaattattcttcaaacatgaaggagaaatactttcatagaaaaacaaaagctgagggatttcaccaacaccagacccaccttacaagaaatctaaagaaagctattcaatctgaaaaaaagggatgttaatgaaaaagaagtaatttgaagatataaaaattactcgtaaaagtacacagaaaaataaatacactaacactgtagttgctctaacagtatagttgcactaacagtgtcatataaaccacttgtatctttcataggaagactaaaagacaaatctatcaaaaataattacaactacattttaatagatacacagtataaaaagataaataaagagatcaaaaagtgaaagcagggggtagggaggagatggagttcaagtgtagtgttttaattttatctttgctttgcttttctttgtaatcacagttgtcaccattgtcaccatttttaaattggttaataaatgctatttgcaagcttcacggtaatggcaaagcaaaaacctgtaagagatacacacacaaaaaaaaaggaaattaagacatactgtcagagggaatcacttttacacaaagaaagacaggaaggaaagaggaccaacaaaacaaccagaaaacaaacaaaatggcagtagtaagttcttacctatcaataacaacactgaaatttaaatggactgaattctccaatcaaaagacatacagtggctgaatggagtttttaaaacacccaactacatgctgcctgcaagaaactcatatcacctataaaggcacacatagactgaaaaagatattctatgcaaatggaaaccaaaaaagcaggagaagctacagttatcagataaaatagatttcaagacaaaaactgtaaaagagacaaaggaggtcattatacaatgataagggggtcaattcaacaaaagcatataacaattataaatatatatgtacccaacactggagcacccggatttataaagaaaatattactggagccaaagagagatggacctcaatacaatatctgggaatttcaacacgccactttcagtattggacagatgaccccaatagaaaatcaaagaaacactggacttaatctgtactgcacaccaaaaggacctaacagacatttacagaacattttatccaactgctgcagaatacccattcttctcctcagcatatggaacattctcaaggacagaccatatgttaggccacaaaacaagtctcaaaaattttttaaaaaatgaaatcatatcaactactttttccaaccacagtggaataaaactagaaatcaataacaaaggaaactttggaaactgtacaaacacatggaaattttaaaatatgctcctaaccgaccatgaggtcaatgaagaaattaagagaatataaaaatgtattgaaacaaatgaaatacaacattccaaaaccaatggaatacagcaaaagcagtactaggagtgctagtttatagcaataaatgcctccgtcaaaaaataagaaaaacttcaaataaacaatctaacaatgcatccttgaagaactagaaaagcaagagcaaaccaaactcaaaaaccagtagaagaagtgaaagatcagagcagaagtgaatgaaattgagactttaaaaaaatacaaaagaacaaaatgaaaagttggttttttgaaaagataaacaaaattgacaaacctttagccagattaagaaaaaagatctttcctgtaggagtagctaaaaaggaaaaaagagagaagaaccaaacaaataaaaccagagatgaaaagggaggcattacaactgataccacaggacaactatgcatcaataaattggaaaacctagaagaaatggataaattcttagacatacaacctgtcaagattgaaacctgaagagatccaaaacctgaatagaccaataacaagtaatgagatagaaagctttttactactgcttctatcaaagaaaagcccaggacctaaaggcttcactgctgaattctaccaaacatttaaagaactatgatgcctgtaatcccagcactttggaaggccaaggtgggtagatcacttgagcccaggagttcaagaaccagcctgggcaacatggtgaaaccccatctctacaaaaactcaaaaattaatcagacacggtggtgtgcacctgtagtcatagcacccaggaagctgaggcaggaggattgcttgagcctgggaggcagaggttgcagatcacaccaagatcacacccctgcactccagcctaggtgatagagtaagaccctgcctccaaataaataaataaatacacacatacatactattcatactattctaaaaaattgggctaaaaaattgagcagaaggtaatacttccaaacccatactatgaggccagtattacttggatatcaaacccagacaaagatacaacagaaaaaagaaaactacaggccagtatctctgatgaatatagatgcaaaaatcctcagtgaaataccagcaaactgaattcaatagcacattaaaaaagtattcatcatgatcatgatcatgtgggattcatcccagggatgcaaggatagttaaacatatgcaaaaaataatgtgatatatcacattaagagaatcaaagacaaaaccacatgcttttaattgatttttttaaatatttaattttatttcaagtttggtgatacatgtgcaggacgtgcaggtttgttatataggtaaacatgtgccatggtggtttgctgcacctatcaacccattacctaggtattaagccccccatgcattagcattttatcctgatgctctccctccccccgcctcctccctgacaggccccagtgtatgttgttcccctccctgtgtccacgtgttctcattgttcagctccaacttatgagtgagaacatgcagtgcttgacattctgtttctgtgttagtttgctaaggataatggcttccagctctatccatgtccctggaaaaaacatgatctttcctttttatggctgtgtagtattccatggtgcatatgtaccacattttctttatccagactatcattgatgggcatttaggttggctccatgtctttgccattgtgaatagtgctgcaataaacatacacgtgaatgtatctttataatagaatgatttatattcctttgggtatatacccagtaatgaaattcctgggtcaaatggtcatatgataattttgatcgatgctgaaaaagcactcaaaattcaacatcccttcatttttaaaatactcaacaaattgggtatagaaggaacatacctcaaaatcataaagccacatatgacaaacccacagctaggatcatactgaatgggaaaactgaaagccttttctctaagatctggaacaagacaacgatgcccactttcaccatttttattcaacatggtgctggaagccctacccagaacaactagatgagagaaagaaataaagggtatccaaattggaaagaaagaagtcaaattatcattccttgcagacgatatagtcttatatttagaaaaacctaaagactccacaccaaaaatctattgaaactgaaaaataaattcagtaaagttgcaggatataaaaatcaacatacaaaaatcagtatcatttctatatgctaacagtaaacaatctgaaaaagaaaccaagaagctactcccatttacaatagctacaaataaaatacctaggaataaacttaaccaaaaaagtgaatgatgtccacaatgaaaactataaaatattaatgaaagaaattgaagagcacacaaaaaatggagacgttccatgttcatggactggaagaatcaatagtgttaaaatgtccatggtacccaaagcagtctacagattcaatgcaatccctatcaaaataccaatgacattcttcacagaaataaaaaaaaattctaaaatgtatatggaatcacaaatgacccagaacagccaatgccatcctaagcaaaaaagagcaaaactgaaggaattatgtaacctgacttcaaattatactacagagctatagtaaccaaaacagcatggtactggcataagaacatacacattgaccaacggaacagaatagaaaacccagaaataagtccatgcatttatagtcaactcattttcaacaaaggtgcaaagaacatacactagggacagtctcatcaataaatagtgtggggaaaactggatatccatacacgaaagaatgaaactagaccactatctcttgccatatgtagaaatccagtaaagatggattaagaacttaaatataagatctgaaactatgaaactactagaagaaaacattgggaacatgttctagaacattggtctgggcaaaggtttcttgggaagacctcaaaatcaggcaaccgaaacaaaaatggacaaatgagatcacatctcgctaaaaagctttgcacagcaaaggaaataatcaacaaagtgaagagacaactcacagaataggagaagatatttacaaactacccatctgacaggtattaactgctagaatagataagaagctcaaacaactcaatagggaaaaaaattcaatttttttggacaaaaaatccaaacaggcatttcttttgttctctttgtttttatttggctcagaaggtactgaatagagatttcttaaaagaaaacaaacaaggccggccacggtggctcaagactgtaatcccagcactttgggaggctgaggtgggcagatcacctgaggttgggagttcaagaccagcttgaccaacacggaaaaaccccatctctactaaaaatacaaaattagccaggcatggtggtgcatgcctgtaattccagctactcgggaggctgaagcaggaaatcacttgaacccagaagcagacgttgtggcgaactgaggtcatgccattgcactccagcctgggcaacaagagtgaaactccatctcaaaaaaaaaaaagacaaatggccaacaggtatgtgaaaaaaatattcagcatcactaatcagagaaacacaaattaaaactacaatgagatatcatctcaccccatcaaaatggcttgcatcaaaaagacaagtaataactgttgctggtgaggatgtgtagaaaggggaaccctcatacaccattggtgggaatgcaaactcctacagccactatggagaacagtatggaggttcctcaaaaaactacaaatagaactaccatatgatccagcaatcccaccgctagatacatatccaaaagacaggaaaacagtatatcgaagagatatctgcactcccatgtttattgcaaccctattgacaacagctaacatatggaatcaacctaagtatccatcaacagatgaatggataaagaaaatgtggtacatatacacaatggaacattattcaatcatgaaaaagaataaaatctttcataaaaaagaataaaatcctatcatttacgaagaataaaatccttcataaaaaataataaaatcctgtcatttgcaacaacatggatggaactagaggacattaagtgaaataagccaggcacagaaagacaaatattatatgttctcattcacacttgggagtgaaaaaaaaaaattgaacccatggaaatagagtagaatggttggttactagaagccgggaagggtagcagggaggggttgggtgagtggggattgttagtgggtacaaaaatacagttagaataattaagatctggtacttagtaatacaataggatgaccatagtcgataagttactgtacatttttaaataactgaaagtggccgggtgcagtggctcatgcctgtaatcccagcactttgggaggtcaaagtgggtggatcacatgaggccaggagtttgagaccagcctggccaacatggtgaaatcctatctctactaaaaatacaaaaaaaaaaaaaaattagctgggtgtggtggcgggcacgtgctactcgggaggctgaggcaggagaatcgcttgatactggaaggtagaggttgcagggagctgagatcgtgccattgcactccagcctgggcaacgagagcaaaactccatctcaaaaataaaaaaaataaataaaaaactgaaagtgaaattgagatgttcctaacacaaagaaatgatcaacgcttgaggtgatgaataccccaattaccatgatttataacacaacatgtgcctctatcaaaacatcacatgtactccacatatataactattatgtacccataataattaaaaataaagaactttttaaaatacaaggtacaaactggaagaaaatagtttcaggccacacatctgacaaagcaccagtgtctagaatatatcaaatattctcaaaactcagtggaaaaataaacaacgcactcaattagaaaatggccagaagacttacacagatatttcatcaaacaagatattcagatgccaaatgagcacaagatgttcaacatcactagccatgagggtcatgtaaattaaaaccatactaagataccctacacacccatcagaatggctgaaataaaaaattatgacaataccaaagactggtaagtgtgtggaaaagctgaatcactcatacattgctgatgggaacataaaatggcagtttctttaaaaactaagcatgcaactactatatgacccattaattgcactcatatgtttttatttctctggaataaatgcctatgttcacacattgtctacacaaatgtttgtagcagttttattcctaataaccagaaacaatcggttgttctttgacaggtaaatggctaaactgtgatgtatccataccacggaatactgctcagcaacaataaggaataaactaccaatacatgcagcaacctggatgaatctccaaagaactatgcttagtgaaaagagccaattccaaaaggttacctacagtatgattaatttataacatttttgagatgacaaaattaaaagaacagggggaagattagtggttgccaaggggttaagaaagggatgggagtcggaggaagtgtgtgcaactatagaagggcaacaagaggaattcttgtggtgatggaagtgttctgtatcttgactgtagcaatgtcaatatctggttgtgatactgtactaaagttttgcaaaatgttaccaagggggaaaactaggtaaaagaatgcatgcaatctatgttatttcttacaactgcatgtgaatttataattacctcaagataaaaatttttttaaaaagagaaggccaggcatggtggctcatgcctgtaatccctgcactttgggaagccgaagcgggaggatcccttgagctcaggagttcaaggccagcctgggcaacatagcgagacctcgttctctactaaaaatcaaaaattagccaggtgcctgtagtcccagctactcaggaggctgaggcaagaggatgactcaagccagggagtcaaggctgcagtgagctatgattgcaccactgctctccaacctaggtgacagagtgagacctgatctcaaaaaaaaaaaaaaaagaaagaaagaaagaaaagaaaagaaaaataagtggtacatactcatcatagaaaattttcaaaatgtagattaggaagatctaatttggttattatacaaatagactaatagatatgacattaatatatttaggggcttttcaagtatattgactactttttatcacaataaaaatatatagttgattatattttttcccctacacatttgctcagagcctcctgagaggctctaaaggattacacagggatcatatgctcatggatggctgcctctgagccaaaccctagcacattgtggaattggtttcttcctgagtaccaatttggaacaattaattataatggtcatctcaagtactgtgctacaagaattatgaggcaatctctgaacccaaatcagaacactgtgattgactagcagtgtccatcagcagcatggggttcaggggtacagtgtcacctctgctggctggaagaaatgtttttaaaccaaccttgcaaactgcaagggacactattaataaaaccctctgtgtaaaggttcttgaaaaatcactcagtcttctgtcatatccaaatattatgttgcattttttatctagcaactattatatatggttgatttttctttttttagtccactaaattgtacatgtaaagaccaaacagcttcagatttttacagcgattagttctccatgcccagcctagaacacaatacttcttactctgctgagagaatgatcaaccaacaagcattatttaatgccgtgtatcagattatatattaggcaagcatttaatcgccaataaagtcattcagtctataaatctgaacactgctatatgccaacattaaatgggaatatgaggtatctgtactctgaaaactcagtctattgggaggatactgataactatgaaacaattataatagataagtgctcttctaggggcagacagaatgctgtaaggaacccctaacatatgactgtaaactggacttggggatcaggaagtcttcctggaagaggtagcatctcaagtgatacccaaagatcaagagggaagggagaacaatgaggcaaggtgagaagtatcccaatcaagaagtctcaaataccagagtccccggtaatcccagcactttgggaggccaaggtgggcagattacttgaggccaggagtttgagaccagcgtggccaacatggtgaaatgccgtctgtactaaaaatacaaaaattacccgggcatgggggcgcacgcttgtagtcccagctactctggaggctgaggcacgagaatcacttgaacctgggaggcggaggttgcagtgagccaagatctcgccactgcactccagcctgggcaacaaagtgagactctgtctcaaaggaaacaaacaaacaaacaaacagagtccaaaagagtcgaggttaggctgaaaagatatgcaagaactcaagtcattaagaccagaagtcatattctagaatttgaataatttcctgattgaaacattttaaactggagagtaaagattaccttaggatagggaacaagatgagaaacagttactgttgttagtagactgttgcaataatcaggtaactaatgacaattgcctgcacaagggcagaaggtagggaggcagagaaaatgaaatgttaccagaaattctaacttgatggttaaggattaaactaaagtacattcacatacatgccagcatcctaaagcctaatacttacacccattgctggtagtcttgtttctgccccattatctggagaccagaattcacccacacacgtatggaggctggcaaacatcacaaccacctccaggagatggtttgctgaggggccagtaaactagtgttgtggttgccttgagagaaatctagggaggttcacaacaactcccacactatagtagaaagctcttcaagagaggacaaactcacttttcagcagagaaacttgacctcatatgccattaagggtaggtgagtttgtcccacaaaataatgctgctatgtgccctaatgaaccatcgtttctagaaaaaaaagaaaaaatgattactaagagctgcacccaaagtaatgaggctagaatcaagctccctcccccttcatcagcactagcatgactgctggcatgtcgtacccaagttgggactcaaggtcacaactttttgtatccactcagagccactggcccaaagcacaagtctactcacaagagaaccaagctgtgactgctccaatgctaccagcttcctggatccagaatcacctaacagcagaaactcagcaagaaaaccaagatgtagggagaagatacaagcggctggagaagagcaaagccttaaaatggagatgagagaggagaagggagggataaagttttgaagtaggagaaaacaaaaagaacaagtcccctgctgagagcacaggagggtggagtaaaaagagattgagaagacagctactaaatggcttaagtggagattaacaggatctgccaaacaacagcaaggacctggctgagaacaaacagcatgagtaggaatgggtccagtcaacaaggttgtgggaattttctaacaactagagacacagaatttagaagagtcaaactatttttggctaataaagtgaagctggattgtagaatctcccttcctaattttaaaatctataaaatctaacaaagataaaattcaccagcagcagcctaatgggcatttcctcataccataaacattgaaaagtagcagccaaaacaattctcactgctatcaaatttgtagagacatggactgcagagtcatcaactttccctctagcaagtggtagagggtgaggggagaaagaatgaatggtggccgggcacggtggctcacgcctgaatcccaacactttgggaggccgagacaggaggattgcttgagctcaggagtttgtgaccagcctttacaaagatagggagaccccttctttacaaaaaataaacttttaaaagtttgtttcttgcaacaaactgaactaagaagtattaaaaacactgtacgtttatttaaaccattacttttcataattcattgagtcttattagaggtcaacatcttcattctgttaccttactgggtacattcactgatgttacataaaacttcatgtaaaattaaataagaattaaaagtacagctaagaacagtgatgatctgtatgagaggatttaccattgtgtaccctagtccctaatatggtcattttttgtttcatgggcctctcaaccttaaattcatttttattttagagagaataaaggcactcctctgagctcttgcccaccacgtgcccagtcgctgcgtcatcggtgtgtgttgacccagtggtacctgtccagccggtgcatagcaggcctgtaacacttaggatgcttctgcgagccatggtaagtgtttcccaggaggccaacacggccgtccaccacattctttttgcgggggatttgtaaccaagattgaaagggctgtttcaagttttcaacctggaaaaaaaaagtataaagatctctaataagctagctgtaaggactaaatatgaacccataattcaaaagtcaggcacttcaaaagcatagggagcacaaatgaatagaattgaaagtgcataaccatctttgaaaaaaatttctagcacttggcgggaacataaatcactttatactgtacctttttaaaaagttaattaattcaactaaaaactttttaatatgcttattcaagtttatgtttattcttgaattgtccctcttccatccctacctcaccactgccaacccaatccaaaactgcatgttcatgatctctggggccacagcctagaaatcttcattttaaacacctaagatgatggatacagatgttttacagatcacactttgaaaagacattgctgtaaaagaatatagctgattacaggtctgatccccaaatggaagaagacctttctaaaaataaaaatagaattaagggcaaatactgtaaatcctcactcaacaacctcgataggttattggaaactaattttaagctaaatgacatatagcaggtctttgaataacatagtttggttataagactgaggaaaaaaatggctttgtcatacatcattttacttaaagtcactgtttccaagaaactatcaatgacacacatagtttaaaaaactagggacaaaacatttgccagaaatatgtcaaggggttaaaatcgttctggcatataaagaacctacaataatacattagaacttcaaataatgaatggctgaataagagaaaatttgtagggcagtaggtgctaaaacatttgggcacatggaaagttttaatgtttaatttcactaatactgtattatatatgcatatcatgttaatcaaattatctgttttttaaatgagaatagccaattctagaaaaaaatggcaaagttggcacttttacatacagctggtgagactacaaataaatacaactttctacatggtgtttcggctgcatattaaaaaccagtaaaatgttcatactctgcgacccagtagttctgtgcttgagaatcaaatctcaagaaacaacctaaaattcaggcatcactatacgagttaccagcttttaaaaaaatattacaaccatgtggaaacagcctagaatatctgccaataataagttacaaaggaggcaaatgaatattaaaattttaattgctttaacatttaatacataggtgattaagagaacatacaaacaaatatatacatatagtgttaacaaattctctctagatcagtgtttttcaaattgtgggtcatgaaatcaatttagatacttgaaatcaaatgaatttaattggaagtattgggagcattgggagcattgctcctagtaaagataagcactgtttcatgaaactttttaaatgtaaatatacatattttgaatgggttatggtttaaaaagaagaaaaaaatagctgagaaaaactgctctagtggcagaatttataggcctttgacctttcctatatccaaattttctataaatgccgtggtattttcaattgacagaaaaaaaaatcccactaatcttaatctttgattctgtaggaatttaagtggaaggaaacctgtgtatcttcaaatactgtatgaagaaataggacaataaaagattatgtggatcctaaaagctcagccaagtgtagggaatacattgtgcagtgaaggagacagaaaaagttttgccaaaatattaagagtctggcttttaaaaatctacagttttgttctttccatgtttttttgcttctttgttttcataatgagtgcattctttttagaattagatagaaaaaaagtatagaaaagaactggaacactcttgacctgataaatactcttcggattgctgactttaggaatgacacgaggttccttgctacaactttcttcatcgcaggaagtgccagaggaaacgtctgatgaggctctactaacggcataactgatttgttgatatagttcccattcctcccatctgcctttaaaagaagcaactgtaaatggatggtttttctcaccatacctaagtaggaaaagaaatttaagtgctaattagcgattcaactttctacaagatctccaatctttcctggagacaatatgctaacttattttaaaagaaattgccttaaaaaattgaaggacattatgaccttcacctactacactgttataaattaggatattctataagagctattttggttaattgttcagaaaaaaacaaagactagtttcttttgattcagttaatgaactgaattgtcccatggtagataactctccttcctttctgatgttgcctataacacttatctgttatcaacctacagtttgtaatagatactgttaccaatctatagtttgtaataaggtgcagtgattaaagccacatttcaaatattttgcaaaatcattgtgctttccacctcacccactttgaatagaagtctgcattgtctaacagaagtttgcatctaaaatcttaaccaagaagtatccctgctgccaactcaaggctttggggcatcatctttcatgaaggtatgtaaagttgtctaacttaaggtttccaggtatcacacagcacacaaactatgagattactcacctacagcatacttcaaagggatctacccatatggtcatctccttcggaagtcccaggtgagaaaaatctacattactttccacacatgccctttctagaatgggatctttattctgattgttgtttatcctgatgcacctttttaaaaagcgaagggaaacgaagacatgatgacagacactttagcaggagaatcacattatgcacatactgttccaatacacatagctcccacctcatcccctcagcctccttcccctcagcctcctccaccctccactcttacaagtaagacatcatcaacttttgatacagtggctcagaatgtatgttgcatcactaagtcacaaaattagttatctttcatggcaaagacaagttagaaattgtttaatctacctcacataaggggctttgctctgttgtttccagccacagtgtcatctactatgtctcctcctttcaattccacgttcaaacaaataaactcgagcccataaaacttttgttacttatatgcagaaaacaagatcactccattttcctaggagctggctggttgcttggtgattgcttccctttgccatcccacatactagctctcacctgaaggcttgccctttagaagggcaatcagagtgccagtgacttctgtatgtttcaaacaagatcgtcatcagcttttctgcaaagtcttctatttgctgtttacttagtttatcatgttttttcaccaatcttgtgacaaagaaaactgttgttgcaatttcatctctcatgattcaagaaaaatagataaggaggtctgaatcattaaaaggaagcaagaagaaatagaaagaaatggtttaacttattatcaatatttaactgccatttggaaattttacataccttaaagttaaaactgagaaaatctgctagaaagaagtccttagtaaactaggtaagtacatgaacactatcaatcaacataacagccaagaacagcaattcctcaaatagcccagttttaaaggttttcaaaggaaaaaaaaaagtctttttaaaattttaaagcacttaagtaataaatgaaacatcactacaacttaaaaaagatcctgatatgggacagtaattacctcaagcatcactttttaaagatatattaacaaagagcaaaatatttcaggagagagtaattccaaaatgtggctccaagttgcatgctttaggaataatcaaacacattatacttgccaacaaaagctctttagcccctaagaaaagtgggcgagacttagaagaccaaccgcactatcccttatgtttccaactctcacccacacctgttcgtgagttcgaggctgaagtttatataagcctgggccctaaaggctgatggatgtttcaccttacacaggtgctgcctattgaaatgatcatacagctttttcatatgccaatctggtctccatccgattgctccttggcataagtggagtgggttctctatttgaagtgtttaaaattttcaaactggatctatattttctattttgctattataatcttatcttttataacacagagtgagaatcaagtgttctccttccatatcctaatatcgtacattccaatgatgtcatctctaacttagctgacaacatattaaggaattttg

SEQ ID NO: 521 - DNA, 23065 bp, Homo sapiens
aatttccatcaatgacacatgattacagtgtcataactcatgtccatattgtccaacaccctaagagagtaacagtttctcacactggtacagacgtctgggtcctcacactggtacagacgtctgggcttcactaagcactactcccttgacttgatcagctcccattttacagatgaaagcctgaaactggaaagatgaagcaacttgcccaagaacttagcgttactgagggtcacagtgaggacctgacttcaggccccaagaccaaaattgcctctttaccgccctgcctctagagtaatagaggtggagacattctgggtgttagaagagtggaatctggtgcttacgcttcgacagagcccactcttactgaagcagccgtatctccagcccatcaaggagatgaggatagctgcagtgagtacctgcaggagagagaagaatgttgagatggggaaatcgactttgccggctgtttctaggtgctgcccacagctgttagagtggctggcagctcacatgaacgcagtcctgttgactctgactctggggacccacatttgtatgacgagcctgatctaacgctgtggatgttaactttcacacccgacctgcctggtcccaagctaggcttcctgtctcttagagcttctacagacccaagatcagcttgttagaataaacttttctgcaaggaatcaaaacactcttcccatgccaccttcctgctccccgccggggtctctttgagagttcacgttcagggaaccccggacacttaccatgaggcctcctccccagagcccagttcccagcatggcatgcctgccaaggaggcccctcaacaggtaggtgacatcccagttaggaaggaggagtgccacgttggccccagcagcaaacagggctgcagtcccaaggctcagtcccaggatacgggagcaagtccgtgagcttgcctgcgtgcagggagaggacaccatcctggaacagatagaaagggagtcgcagcagctctgctgtggggggatggggaagggaactccagcagcatatcatgggtgagggaaacagactacagaaaccgccaccttccagggtcagaccaatgagagccaagcaacctgcttaaaaactctgctccttaggaatcttccccagtgactaggatttaattgtttccttttctgctaacccctgttcacacatacatagtttgcattccatcatattttgtttatgcctctattacagccagtgattatttctgacaaaaagaaatgtttaaaggtgtcttcatgatgtccattgtctccacttctattcaacgttgtactggtcctggccagtgcaatacgaaaataaaaggaagcaaaagccacacagataggaaagaaagaagtaatattgtcggccaggcatggtggctcaggcctgtaatcccagcactttgggaggctgaggcaggcggatcacgaggtcaggagttcaagaccagcctggccaacatggtgaaaccccgtctctactaaaaatacaaaaattagctgggcacggtggtgggtgcctgtaatcccagctactggggagactgaggcaggagaattgcttgaacccgggaggcagaggttgcagtgagctgagatcatgccactgcactccagcctgggtgacacagcaagactccatcttaaaaaaaaaaaaaagtaacattgttattattcacagataatgtgatcacattatgtagaaaatcctaaagtttattagaattaacaggtgagtttagcaacgtcatagaataaaagattaatatacaaaaattatattgtatttctatatacaagcaatgacaaattgaggattgaaattaaaatatatcatttacaatagcataaaaatataatacatatggatgaatttaacaaaatatttgcaagacctatatagtaagaattgcaaagcattgctgagaaaattaatggagacctaaataaatggagacatataccatgttcctgaaccagaagactcaaaatagttaacatgttctccctaaattgatgcaaagatttaaagcaatatcagtcaaaatcctaggagagttttgttatagaaattgacaaactgaatctaaatttatatggaaatgcaaagcaattgtgaagattagccaaagcaattctgaaaaacaaacaaagctggagaacttacgccatgtgatttcaagacttacaaagctacagtaattgaagacactgaagccacgcgtaaggaaacacatatggactactggaacaggctggagctcagaaacagacccggtccaggaaaaatgattttttttttttcttgagacggagtctcgctctgttgctcaggctggagtgcagtggcgcgatctcagctcactgcaacctctgcctcccaggttcaagcgattctcctgcctcagcctcccaagtagctgggattacaggtgcccgccaccatgcccggtaattttttgtatttttagtagagacggggtttcaccgtgttagccaggacggtcttgatctcctgacctcgtgatccgcctgtctcgggctcccaaagtgctgggattacaggcatgagccaccgcgcccggccaataaatgattttttaagaagatgacaattcagcgggaaaaagtctcttccacaaatggtgccggaacaatgcacatgcaaaacaaaactgccttcactattacttcacaacatattcaaaaattcacttgaaatggagcatgggtctaaaagctttataaaatttctagaataaaacaaaggagaaaaacactgggaccttgggttagataaaggtttcttactaaaatgcaaaaagtacaatccacaaaacatgattaatcagactgcttaaaaatttaaatgtcagctgggtgcttgcctataatcccagctactcggaggttgaggcaggaaaatcgcttgaacccaggaggcagaggctgcagtgagctgagatcgcgccactgcacttcagcctgggcgacaagagcaagcgactccatctaaaaaaaaaaaatcatgctaaaagaaataagccagacactaaaggacaaatattgtatgattccacttatatgaaatattcaaaataacaactttatagagaaagaaagtagactggaggttatcagggactgtggggagggaggagagaatggggagttattgtttaatggttacagaggttttcaggttttgttttgtgttgttttgttttttttttttgagacagagtcttgctctgtcagccaggctggagtgcagtggcgcaatctcagctcactgcaacctctgcctcctgggctcaagcaattctcctgcctcagcctcccaagtagctgggactacaggcatgtgccaccacgcctggctaatttttgtatttttagtagagacagggtttcactatgttggccaggctggtcttgaactcctgacctcaggtgatctgcccgcctcggcctcccaccgcgcgcggtggttttggggtttttttagagatgcagtctcactatgttaccccagctggtcttcaactcctggactcaaatgatcctccagcccgtgcctccagagtagctatgaccagatctgggccactgcccacggtttaagggttacagactttctgtttggggtgaagaaaagttttggaaatagataatggtaatggttgcacatcattgcaaatgtaattaatgtcactgaattatacactttaaaatggttaaaatgacaaatctgatgttactttaccacaataaaaaatcaattaaaaaatttgtgattactcaaatccttatcagtaatcaataggtgaatcaagacaaattgtgttatccatacaaatgagttctattaggtaataaaatgcgtaaatttctgctacatataacatggatgaatctcaaaagcattgtgttaagtggaagaagccagaaacaaaagactactcacatgtttctatatatacgaaattctagaaaaggcaaaacttttaacggagagcagatgagcggttgccatgggctgagaatgggaaagaggattagtatggggcatgggaagctttctgaaggggtggaagcattctgtgtctagattctggtggtgaatacataactgtacatattgacaaaactcattaaactttgcacttaaaataggtgaattttattgaattttaactatatatcaataaagctaattacaattaaaatgtcatatctagataaattataaaatgcctcttccactccttatgttcctctcttttatattttcattgatatgtgaacttcttgttttttagaaaaatatgaattaaggccgggcacggtgacttacacctgtaatcccagcactttgggaggccaaggcaggtggatcgcctgatgtcaggagtttgagataagcctggtcaacatggtgaaaccgtgtctctattaaaaaatacaaaaaaattgctggacgtggtggcaggcacctgtaatcccagctactcgggtggctgaggcagcagaatcgcttgagcccaggaggcagaagttgcagtgagcagagatcgtgccattgcactccagcccaggaaacaagagtgaagctctatctaaaaaaaaaatatatatatatacatatatatatgaattaaaataggactagtaatatttgggcagactcatgtcaatgtggatctgaaaaaagtcagcgtcatgacatccccaggaagtggcctgttcccactgtgcagttcagttacacgtctgtctccccttaaggctcgctatttatttatttatttaatttatttatttattttttattgaaaaaaatttatttttagccgggtgcagtggctcacgcctgtaatcccagcactttgggaggccaaagccggcagatcacctgaggtcaggagttcaagaccagcctggccatcatgacgaaaccccatctctactaaaaatacaaaactagccgggcgtggtggcgcatgcctgtaatcccagctactcggaaggctgaggcaggagaatcacttgaacccgggaggtggaggttgcagtgagccgagattacgccactgcactccagcctggacaacaagagtgaaactccgtctcagaagaaaaaaaaatgtaatagaggtgaggtctccttatgtggcccaggctggtctcaaactccttggctcaagggccctcccacttcagacacctaaagtgctaggatgacaggcgtgagccactgcacttggccacttgaggctcttgacacgcctataacacactgctttgcacctaatcagaaaatatgtgtatagaggccaggcacggtggctcacgcctgtaaccccagcactttgggaggctgaggtgggtggatcacgaggtcaggagtttccgaccaacctggccaacatggtgaaaccccgtctctactaaaaatacaaaaaaattagctgggcatggtggcgggtgcctgtggtcccagctactcgggaggctgaggcagtagaatggcgtgaacctggggggctgagatcacgccagtgcactccagcctgggcaagagagtgagattcggtctcaaaaaaaaaaaattaactgcgtggtggtgtgcgcctgtaatccaagctactcaggagcttgaggcaggagaatcgcttgagcccgagaggcagaggtggcagtgagcccagatcacgccactgcactccagcctgggtgacagagcaaaagagagagagagagaggagggagagagggagggagggagggaggaaggaagaaaggaaaggaaggaaggaaagaggaaggggaaggggaagggaagaaaaaaaatatatatatatataaaagatatggatcagaggctctatatatatgcacacacacatatatatcatatacatataatgtataatgtgcgtatatatgtgtgtacgtacacacacacacacacacaatagtcccccatatctgcaggggatatgttccaagagctccagcggatacctgaaaccacagatcataccaaactctgtatattcagatgcttctccacttatgatggggtcgaactcctataaacccgttgtaagtcaaaatatcctaagttcaaaaggcatttaatgctggcaacacagtagactgtccctgactcacaatggttcaacttacaattttttttttttttttttttttgagacagggtcttgctctgtcacccaggctggagtgcagtagcacaatcattgttcactgcagccctgatctgggctcaagtgatcctcccacctcagtctctcggatagctgagaccgcaggcatgcgccaccatacctggctaatgttttagttctatagagacagggtctcactatgttgcccaagctgatctcaaactcctggcctcaagtgatcctctcacctccacctcccaaaatgttgggattacaggcgtaagccaccacgcccagtcccaatttacttttgactttgtgatggtgcaaaagcaatgagtattcagtagaaaccgtaatcccatcataaagggtaaggagttcactgatgatggagttaggtccctagaaacctgtcgtaaagttggaaacttagaagtcaaaccactataagtagaggactgtctgtactatgctttttcctatacatacatatctgtaataaagtttaatttataaatcaggcatagtaagaagttcgcaacaataataataaaatagaacagttataacaacatactgtaatgaaagttatgtgaatgtggtctttctcattgaaaatattttatgtaagttttttgaactgcagttgaccacagatagctaaaactttggaaagcaaagcttcagttaaggggggattactttacatcacacataaataatgaaatatttcacagcatgaagaattaaacattgggggagggccagggctgaaaaactatctgtaggtaccgcgctcactacctgagtgacgggaatcactcataccctaacctcaacatcacacaatagacacggaacaagcctgtatatgtatccccggatctaaaataaaagttgaaattatatttttaaaatttgcattaaaggccaggtgcagtagttcacgcctataatcccagcactgtgggaggccgaggcgggtggatcacttgaggtcaggagttcaagacagcctggccaacctggcgaaacctcatctctactaaaaatacaaaacttagctgggaatggtggtgtgcgcctgtaatcccagctactcaggaggctgaggcagaagaatcacttgaacctgggaggcagaggttgcagtgagccaagatcgcaccactgcactccagcctggaccacagatcgagactccgtctcaaaaaaaaaaaattgcattaaaaaagaattaaacataatgtgtaaaatatatttgtaacttgtgtgagataattaacacccatgtaaacacaaccaatatcaaacatacgtcattacccatcacatcactgacactcaggtgtgccctctccaatcctgccttctttctggattccttcctaggaactactatcctatatttcatcttcaacatatccttttaaaaacagttttacgacttaggaactcagaattgttttagaaacttgtttagtcgggtgttttccatttttcaagactgtagcttttcttttctttttctttttttttttgagatggagtcttgctctgtctcccaggctggagctcagaaacagacccggtccaggataaataatttttttttttcttgagacagagtctcactctgtcgctcaggctggagtgcagtggcgcgatctcagctcactgcaacctccgcctccccggttcaagcgattgttctgcctcagactccccagtagctgggactacagctgcacaccaccatgcccggctaatttttgtatttttagtaaagacagggtttcaccatgttggccaggctggtcttgaactcctggtctcaagtgatcctcctgcctcggtttcccaaagtgctggaattacaggtgtgagccaccaaacccggccagactgtagcttatggtaaagaagacaaggggaggggtgccctgggagggtgggggtaggagagaggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggatgccctgagaaggtgggggttaggagaagggaggggtgcactgggagggtgggggtaggagagggaagggatgccctgagaaggtgggggttggagaggggaggggtgctctgggagggtgggggtaggagaggggagaggtgccctgggagggtggccagaggacaggggaggagtgcacagggagagtgggggtaggagaggggagggatgcacggggagggtggaggtagcagaggggaggggtgcatggggagggtgggggcaggagagggcaggggtgcttggggaggggttgtaggaaagaggaggggtgcactgggagggtgggggtaggagaggggaggggtgcactgggagggtgtgggtaggagaggggaggggtgccctgggagggtgtgggtaggagaggggaggggtgccctgggagggtgggggtaggagaggggaggggtgccctgggagggtgggggtaggagagaggtggggtgccctgagagggtgggcgtaggatatgaagcaacagtgactcctaccccaggggcccaagggtcctggggcagggtggggtcaggaatcgggagggatggggtgtctcttcccccatcaaccctctggctgacaggccaccggactcctcagtcacagcaaggaacctgtcctgctcctgggagcagggcgcctgtggagaacggccccctcacagcctgcccacactgctgcgatgtccccgcatgtctgcacatcctccctccgagacggtcccatcgtgcagtgcggggcttgcagtgtgtaattctgtgttgaggcaaattaaccacccagggtgttaacaactcacaactttaatccactgcccacccagatgtctgaccggggcccaaggaaagatgggtgtgtggttggcctttcaagcgggtgctctagatcatggggccaggagacgccgttgtgcaggaatgcatttagtgccttcaaatcacggcacctctgagaaagcaccgtctacacacttcagcaacatcaacccccctgacgatctcttctacagaaaacgttcccatcagaaaagtctgttttttttgtttttgtttttgttttgttttttgttttttttttgagacagagtttcactcttgttgcccaggctggagtgcaatggcgcggcctcagctcactgctacctccgcctcctgggttcaagtgattctcctgcctcagactcctgagtagctgggattacaggtgcacaccactacgcccggctaattttgtatttttagtagagatggggtttctccaggttagccacgctggtcttgaactcctgacctcaggtgattcacctaccttggcctcctaaagtgctgggattacaggtgtgagccacagcgcccagcccagaaaactcttaaaggggaaactaaaaatgatggacagcgagggaaaactaccagctggagcatggcttttggatgagtggaattcagagccctggctgtccgccaatcaaacactaaaagcacttgccgcactgcggcttcgtgtgaatttcacccctcctcctgactttattcccctagaaattataacatttggagaaacccttccaaaaatgtgaaccaggaggttagcaaagaggtggcctaatttgatatctgaagagacaagcaagatcagaaggtaaaaccttaaaaccaggctgctggggagttccttgttctgtcctgaggtcctagctaggtgagcacgtcatcggctagatgtccaggcaacaacagaagtgatcggctcaattccatggaggaagagaccgcacattctctacatctgtgtctctccctcgccacccagcaaggcttttctttcattcttccttcagtcggatatttattaagtgatcactacctgacagacacttggggggctagggatataacgatgaaaaagatgtaatccctttccttgaggagcttaaagtctagtggggacactgctgacgcaaaaagcaattctttttttttttttttttttttttttttgagacacagtctcgctcttgttgcccaggctggagtgcagcggcatgctcttggctcactgcaacctccgcctctcgggttcaagttattctcctgcctcagcctcccaagtagctggaattacaggcatgcaccacgcccggctaattttgtatttttagtagtgatgggttttcgccatgtgggtcaggctggccaaaaagtaattctaatcaagtgtggtaagaaatagagcagacatgagcagggcgggagagggcctctaccccagtaatgtcaggtgactatcaggtgatggccaggcggttgttacactgtctttctaaaataatattggtcacagccagcgttgggaaagacagtctcccaatagatagaaaatacctgaacttggtgatcagcagcttcctggtaagagctcaggaattgggcgagtgggctcaagcatctacactaagaagcaaaatggtggagtttagctggtgtgtgtgaccttcctctagtgctgctccgcgggtaagggaaaaacgcctcaagtgagcatgcgcacgacttcagtaaacacactgcgcatgcggcccctcccaagtgcctgtgcggcaggcaggcgccaagtcaagggtctaacagcacatttgggtgtctcaagtcacgcacttggcccttttccaagtgtactttacttcctttcattgctgctcaaaaactttttaataaaccttcactcctgctctcaaacttgcttcagcctctccctctgccttaaacccacttctgcccctcagccgaatctctcccccgagaaggcaaggattgagtttgctgcagactcgctggattcacagctggtaacagtaagtaccaggcaggggcatccaacttaaggtgtcatggaagcacatggaggaacctaatcctatctggcagaagcaaaacgaagcttcccggaggaagggctgcccatgcccaaacttgatggacgatgagatactaggcaggaagagtattctaggtgcaaaggccagaagttgacagactgaggcaacaggagaaggtaagtgaatggcgcaaagtcacacagacgccaagctgcagagccaggctcactggagtggaagcgtgcactctcatctgtgaggctaggctgttccctggccgtcacctcaccctttcatctctgcttacctgcatctggtgtcaagaatcagaatgggagagacagaacctggagaaaggctgcgtcttcagagtggggctccactcctccagctccagggctggacctgaaggttgtctttccaggactctttccaggagggccagggaggctctgtatatacgtagaggtcacccaggcgtgtgtgtgtgcgcgcccccacgcccctgcccacaggcctgcattgaaggcgcttccgctccccggagagccctgtcctgatgacccaccctctgctcattttcatgtgattctaaggcaggaaacgggagacatggcctcatgagctccgctgtcctgatgagtcactggatgcacccgtgagaaacacctcaccctccgctctccccaggcagcaacacttgccacaccccagctgttcctgtcctcatctgccaccccgcgaagaatttcggctctttgacagaacagcaccgagcagggcagccacccctttttcctcatcactctccttaccttgcccttggctgactcgatgtgttgcatggttcctgtactagacgtctaacttttttttttttttttttttgagacagggtctcactctgtcacccaggctggagtgcagtggcatgatctcggctcactgcaacctccgcctcccacactcaagcaatcctcccacctcagcctcctgagtagctgggattacaggcacctgccaccatgcccggctaatgtttgtatttttaatagagacggggttttgccattttggccaggctggtctcgaactgctgacctcaggtgttcgcctcagcctcccaaagtgctgagattacaggtgtgagccaccgcactcagcctcttgttcaagccccaggccactatcatcttgtaccatactctcaccaaattgctgaggattttgtggtgctctctgtgtgggagatccgtgaccctctatggacaagctcctattcaagattcagttcaaacattcccagtgaagtctgccaggatttctttactccgagttaggtacttctttctctatgctcccattgcattttaaacatctagatattatatacagtaaagtgcacaaatcttttcttttcttttttttttttttgagacggagtttcactcttgttcccaggctggagtgcagtggcacaatctcagctcactgcaacctctgcctcctggcttcaagcaattctcctgcctcagcctcccaagtagctgggattacaggcacgtgccaccacgcctggctaattttgtatttttagtagaaacacggtttctccatgttggtcaggctggtctcaaactcccgacctcaggcgatccacccgcctccgcctcccaaagtgctgggattacaggtgtgagccagcacgcccagcctaaagtgcacaaatcttaatgttaaagtctgatgaatttttacatgtataccctggtgaaccagcacagaaatcaagatacaggacattccaaatccccagaggtttcattgtgtcgcctgtcattcgtatcccttgtccccagtgttaactttcattttggctcttataataattgattaggttttagttgttcttgaatttcacataaatggaatcaaacagttttctttaaaaaaaaaaaaaaaaaaggcggttttgctgtgtcatccaggcgggagtgcagtggcacaatcatgactcactgcagccttttgccttcataggctcaagtgatcctcacacttcagcctcctgagtagctgggaccacaggcaagcgccaccacgccagctgattttttaatttcgtgtacagatggggtctcaccatgtagcccagtctggtctcgaactcctaggctcaagtgatcctcctgcctcggcctcccaaagtgctggattacaagcgtgcgccaccgcgcccagcccagtatggcttttgtgtgtggctttcttcactcaatattctatatgtaagattcatccatcatgtaatttatttttcttttattgctgagtattattacattggatattacaactttttctactcttaatggacatttatattttcaacttttgcctgttataaataatgctgctatgaatattcttctgcatgtcttttgaaggaactatgcactaatttttccagggaatattcttaggagtaggattgctatcatagggcaggtgaatatttaattttggcagatattgccaaacagattcccaaagtagtcctaatttacacacccaccagcagtgtgtgacagttccagtttctacacattctcacaaacatttttaattttaggcattgtggtgggtgtttagtgtaatctccttgtgtttgaatttgcatctccttgatgagtaagcaccttttcatatacgtattagccatttgaagatcctctttgagaagttcccgtccatggtttttgcccatttgttatgggttatctttttttctgttttctggttcattataattccaggtatgagacctttatcaggtaaatttattgtgaatgttttcccccagtttgtggtttgactttttactctctttattatgtcttattttattttattttattttattttattttattttattttattttattttattttattttattttattttattttttgagacagagtctagctctgttgccaggctagagtgcagtgccacgacgatcttggctcactgcaaccgccatctcccgggttcaagagattctcctgccttagcctgccgaatagctgggattacaggcatgggctgccacgctcagctaattttcgtatttttagtagagacagggtttcaccatgttggccaggatggtctcaatttcctgacctcgtgatccaccctcctcggcttcccaaagtgctgggattacaggcgtgagccaccccgcctgggcttacttgaagagaaagtactgattttaattaagctccatttatgcatcttcttttatggtcaatatttttgtgtctgcttaggaaatctttgcccacttcccactggagtgtgactcacttcttactccaccgctgtgaggtccttgcaggcagggactaactcttactctgctctgtatattctgagcctcacacagagcttggaacatggtagaagctcaagaatgacttgatgaatgaattaattcgtgcaatgcataattcatgcaacacagtctctgcacagagattttacttccagtgatgaaaacaaacgattactgaggaaacccctgatgcacatacatgagaagggatcgttatgactggctatcacagttccatttttaaaaataaaattggaactcttcattaattttcgtgtcatccttgcacgggaaccacgttaaactaatctgcatcgtcccaattttagtatatgtgttgtcaaagcaagcacagtttaagtcttctaaactgtttatgagctgctttctatataagaatttctgtttttttttttttttttttttttttgagacggaatcttgctctattgcccaggctggagtgcagtggcgcaatcttggctcactgcaacctccacccccaggttctaagcgattctcctgcctcagcctcctgagtagctgggattacaggtgcccaccaccatgcctggctaatttttgtatttttagtagagacggggttttgccatgttggccaggctggtctcgaactcctgacctcaagtgatccacccgccttggcctaccaaagtgctgggattacaggcgtgatccactgcacctggccagcaaaagagatttcgcatgcagtgtctgttagaacatctcatatttaggcaatcagaataactgaatggctgattgccgtatatcactcagattttttttttctctcgatatggggtctcgtactgtcacccgggctggagtgcaatggcacagtcttggctcactgaaacctctgcctcctggattcactcgattctcctgcctcagcctccccagtagctgggattacaggctcacactgccacacccagctaatttaattttttaattttctaatttttagtagagacagggtttcactatgttggccaggctgctctcgaactcctgaccttgtgttccgccttcctcggcctcccaaagtgctaggattacaggcgtgagccaccacgcctggcctagcactcagatttttagatgatatctccatgtccaacccaatggcttatgtagatatcattaaaatgttgcttgtgggacaaaggaaagtgctggaatttgtttttaatcccttaaagtgtcaaacttagtgtggggctggtgatggcagctgtgggtttttgctccttcgggtaaacttgtgatgattaattcaatgattatcttatggacaagacacttctttcttttttttttttttttgagacggagtctcgctctgtcgcccaggctggagtgcagtggcgcgatctcggctcactgcaagctccacctcccgggttcacgccattctcctgcctcagcctcccgagtagctgggactacagcgcccgccaccacaaccggctaatttttgtatttttagtaaagacggggtttcaccgtgttggccaggatgttctcgatctcctgacctcgtgatccgcccgcctcggcctcccaaagtgctgggattacaggcgtgagccgccgcgcccggctgaacaagacacttctttaagaaatcatgtacttgagataaacgggtctcgtaaggctagcgttgggactatctcttcatttccatgtggcgagcctcctagggcaacagaggcacggtcgctgccatgaaagcactgaagcttcacctctttgagacgtgttaataaccgcggagtgtggctctactggagatggagctacttgctgttactttgtcggtgatgctcctagggaggagcaaatgggagtctgaggacataaatgacgaacagggcctgggctgagaaaaccagtcatgccacaaaaggcttcctgaggctgaaagatttgggagacggccaggtgccagtgacccacacctgtaatcccagcacttcgggaggcagaggccggtggatcacttgaggctgtaaccgcccaaggggttcacttgcccgctgtctagacagagccgattcgtcatgacaggggaattgccatagagaaagagtaattcacgcacagccggctgtgcgggagaccgcagttttattattactcaaatcagtctctcccagcattcggggagcagagtttttaaggacagcttggtgggtgtggagagccagtgagccgggagtgctgattgatcagggatggaatcacagggagtcagctgtcttcttgcgctgagtcagttcctgggtcggggccacaagatcagatgagccagtttatccacctgggtggtgccagctgatccatcaagtgcagggtctgcaaagtatctcaagcgctgatcttaggagcagtgtagggagggtcagaatcttgtagcctccagctgcatggctcctaaaccatcatttctaatcttgtgactaatgttagtctagtcccccggcaagaaggaggtctgctttgggaaagggctgttaccgtctttgttttaaactataaattaagtttccccccaagttagttcagcctacgcccaggaatgaacaagggcagcttggaggttagacgcaagatggagtcggttaggttggatctctttcactgtctcagtcatcattttgcaaaggcggtttcaaggccaggaatttgagaccagcatgaccaacatggtgaaaccgtctttactaaagatacaaaaattagctgggcgtggtgtgcacaaccgtagtcccagctactggggaggctgaggtgggaggactgcttgagtacgagaggcggaggttgcggtgagccgagatcgcgccactgcactccagtctcggcaacagagtgagactctgtttaaaacaaaaaacaaaaacaaacaaaaaaagtcctggcgcggtggctcacgcctgtaatcccagcactttggaggcggaggcaggtggatcacgaggtcaggagatcgagaccatcctggctaacacggtgaaaccccatctctactaaaaatacaaaaaattagccgggcgtggtggcacgtgcctgtagtcccagctactcgggaggctcaggccggagaatggcgtgatgaacccgggaggcggaggttgcagtgagccgagatcacaccactgcactccagcctgggagaaagagtgagactccgtctcaaataaaaaaaacaaaaaataaagacttaggagaacaggctagacagatgttccattctggggtatatttggggatctggaggtggtatttgagcaagaaatagaggaagttgatgaaatagaattcactggcagaagagaagatgatacagccagacaaccaggccagctgttttctagtgttccccagatgagagcgacaggactaatcagcctcctgtgggtgggctctaaactcaactgaaagctgacaagagagcacattcccttaattggagggagaaaaaaagggaagatattgaaagagctgccttttataccagaccactgaagaggaagttagggttttctcattagtatataaaaatcgtaaacttccacccacccaaagtagatttctgcctccaacattgcactgaaactgttcttggtctccagtgatttcgtgtctctgatgaacgctacactgtcctctttacttgactctagacatagttagccacaggatccttcttgaacattcttactcttggctcccttgacaccccactctggtgtttttttgtttcttttttttgagacagagttttgctcttgtccctcaggctggagtctggagtccagtgtcaccatcttggctcactgcaacctccacctcccgggttcaagcaattctcctgcctcagcctcccgagtacctggaattacaagcaaccgtgccaccacacccggctaatttttgtgtttttagtagaggcggggtttcaccatattggccgggctggtctagaactcctgagctcaagtgatctgcccaccttggcctcccaaggtgctgggattacaggcgtgagccactgcgcccggctgagatttctcctttaaatagaacgttgtggagtttacttttaggctgagacctaaaggataaaagaaagtgatccgtgctaagacgaggagaactcaagcagaagacatgcctcggctgtggagcaggaaggtgtttgatgttggggtttgagagaaggccagtcagctggcaggcagggggcaaagggggtggcatgaagcaaggagcttgggcattctgagtggaaggagaagccagtatgcggagaatgggtcggaagagagtaagagcagagactactgcagtggtcacgataaaaagcaggtcacttggaccagagtaatggcaatagactgaaaagtagggttaccttttatgcattttggaggcagaagttaaaggacttgctgttggattagagatgggggaataagcaaaagaaaatgacttaagtttctggcaggttcataggtagtggtgtcactgcaggtctgggtggggaggcgtcatcttagatgtaagtgtgatacttccaactataggcgcagtgtaaaaagtcggacatgtgagtctgaagcttggaggagagacgggctggagttggagatgtgagaaatcattggcattatacatggcggttggtactatcagaatgagatcacagagggagagttagagggccaggtcctggggatcaccaccataaagacccaatcaaggaggtgcaggcagtgagaagaaacaccaggcagggcgcagtggctcacatctgtgatcccagcactgtgggaggccgaggcaggtgaatcacttgaggtcaggaattcgagaccagcctggccaacatggtgaaaccccgtctctactaaaaacacaaaaattagccgggcgtggtggcgggcacctgtagtcccagctactcgggaggctgaggcaggagaattgcttgaacctgggaggcggagcttccagtgagctgtgatcaaatcactgcactccagcctgggcaacagagcgagactctgtctcaaaattaaaaaaataaagaattctctactggctccttttctattttttttttttcattctattagaatcagatctgtttttccatgtatgtttatcgtctgtttccaactagaaagtaagttccttgagggcagaggctgtatctgttttgctccccatcacatacatccctattatttggcacatgaggctggagcatggggatgagaaatggttccacaagaaaagggggggcacaaacccatcactgtagaactgtgagctaagcagcagtccctttttttttttttttttttttttttttgagatggagtcactctgtcacccaggctggatgctatctcggctcactgcaccctccacttcccaggttcaagcaagtctcctgcctcagcctcccgagtagatgggattataggcactgccaccacgcccggcttttttcttttttttttttttgagacagagtttcactcttgtcgcccaggctgcagtgcagtggcacgatctcggctcactgcaacctctgcctcctgggttcaagcgattctcctgtctcagcctcccaagtagctgggattacaggcggccgccaccacacccagctaatgtttgtatttttagtagagacggggtttcaccatgttggccaggctggtctcgaactcctgacctcaggtgatccgcccatctcagcctcccaaagggctgggattacatgcatgagccactgcatccagcagcaataacaatttctgtcataccatataatcgtatctcctttttgcccattaatttagtaattatctttccttcaattaagctaagtccttaattaaccattagtaattactgctggtctgaaagaacagacactgaatattcgcccaagtatgtcaaacacagaatcatacttacctaacaagcctagcttacccaatgtttctgtaacaactggactaatatttacagagtgtttaccatgaatgtttgacataccacaaagagcagaaaaaaggctagcaaacgttacacataacaacgggactacaaagtaacctttgtcaatcaatagtaactgacctaaatgagaacgtgagggggcaagcttttggaatctcaattgtattactgaaagtaatatccagagtcttatcttgtaaaaacaacaacacaaaaaaaactaatactgaaaagtttttgtttttatttccaagatcaaatattacaacaggacatttacatgtatttataaaaaaatgcagcagttgaatgtatagatcagaggtttccttgagtttggtccctctctcagcacagtgagctgatgtcttcaaaagacttatcgtcccactcccttccctcccccaccccattgtccccccaccctccccgtttcaagttgcagtattaatataaagcaactgggtacaacacagcaagagtattcacaatttggtacagaccaaaccagaggatccccaactgacagcaagatcctccttctggaaattattacctatagactaggtagatctataggtagatcacacccagttatctaagatttccctggttttagagcaagtggaagttccattgagtcttagccagtagttacaactctgcgttacctaatggcatgtttttctcctcttacaagtttaattttctaccgcctccatgtgtcttcaaatttaaggctttcccaagcacctttattatgacttactagatatacaggagggtctctaatgtgtcttgaacaaaaaaatttagtggatggtccagctgccccttgctcaacaatcccaaagacttcttcccaccactgagaagagctgcagaaatcaacggtatctcctagcaccattggagaaaaggcccagaaaacagaattcgatgtgcattttagggagcacttgccagaaacattacaacaggagcactgtctctgttatcttcttggattcaatcacaaatttagagtacagatgaaatttagagcctgtcctgcattaagaatgcaaatctcagtaagaccacccccacacacactttgtccagaataagttgagccacaaacatcccagggaatctctaaatactgttaggaactgctttagaaaacactttaaagcaaataccccaagttgacttcactcaagcccccaacccaccctcatcatccctatccccctagaaatttcattccttgattaacttctctgagtaagatgtaaagtgaggtttggaaaatgacatgaaacatgaaacatgtttaaaaacacaatcaatgaagacatgccagaactggacatcccaggtgacttcaaatgcattgttcaagccgaactcatacaaagcatgcacagagcctgcacagacactgctgagagtttccagggaacaatcaatacctactcgaaaaaggactttcctgaagggcaaacaaaacaaaacaaaacaaaacaaaacaaacaaaacaaaaagtaacactggatgtttagaatttgttaacaacaacaacaacaaaaaaccattctggaaaaaaagattatcagaggagtgaagaaaaccgtgtctaacagattcatgccaaagcttggatggaagcccctcaaagtctaagtatcgtgttagcatcaactggtactcatttctctatatctaagactagaagattctctcacagctttactgtttcctggcaagtgttttcaacagcctttccagctgaagggacgaacccaggaaagtaacaaggcccaagaccccacatgggtcagataagcagcccctactagaagcttgctactcgttaactgaaaagtggaggccacgcactactttcactctctctagcaggtgaaaggggattttctgatggcaacagtcactccgtgtaaggtttaacttacagggcaataagttatcaaaaagttattgttaaaagcatatgattagtgtcataaacatatttatatttggaattacaccatttgatatctccattaagaatgcaaagctttgagaaaagcatactgtaaaatcatgttgctgcaaacagcaaggcatccagctgagtgtaagcagtctaatgtcatcaaactgaaatggaccctcgtgacgggcactatggaaccagctacctagatagagagaaaaaaggagaatggcagggaacggttc

SEQ ID NO: 522 - DNA, 23245 bp, Homo sapiens
ccattttcttttccctaaaacctcttcctaaagaaaatgatcaggtaataaaccccttgacccctccccacacccctcctcccaatacccaattaccccccaaagcaaagggagaaattaagagagagaaaaaaatccaagggcaacattgtctaaactcccagaaagagagatggcagcgtccgggccaggccgggcgggctggataacgcacgggtggtagtggtatttacacagagggaaccagcagagactgtaaacatttttaggggttcaggggaaggtcttttcctcgtgaaaggaggagggtctctgtggctgactggcagagaggcagccctcagggctcccccacaccctccttagagggggcccttgggggaggcagtgagttttaaggctgggagcccaggaatcagggatatcctacctctagctgagggtggaggggagtgagagccagcttccaagaaacccctaatgtggggaagaggctggggtgagggtgagctgggagtgtgtggcaggcccctgcggctctcctggggcctgcacgggtagaacaggcccactgttgggggaggcaagtacaaacgctgggtacagaaggcctgtcacaggagcccagcagaaggcagataccccggagccttcgagcctgttcctcgctccctcacaaaggccaaaagggcatctaggaggaaatgggcccttggagccagggaagcatagccatggcccttcagagaggcaggggggtgggaggggccggtgtcttgtgcccccgggggccacgaagcagcgtttgccccagaacccagtcaaggcccagggcaggtgtgcggagagggccggggccagtcgtgggaagagggtgtgaggcgccccttcctctgggatctccagacctgtgaaggaagaaacatgggtgaagcatggggaagagacccccgatgcggatcacgggctctgggggaggggagggggctggggtgagtgacagcatctaggatggggctgcctgaggaaggcagatcatcaggcctcagtccaaacggacccatctgcccccacccccagccatgagagcagggatagaggagacaggagggagggggcaaaccatacaggaaaccaaacggtattaggaaggaaatagatagcccatgagaaaaataaagactggagggggagagaggcaaagagatgacaacagacaggcaggcagagaaatcgagagagagacagagaagggggtgcgtgtaagagacagacacctggaaaaagaaagggaacacccgcagagaaggccagggcagagcccaggtcacggctcagggatggagtctcatggggtgagaccacccccggcccccagttagtgctctcattcctttttggaaaggaacacagaaagcaagagaaatgcacagaacacagaccacagtcaccaaccactgtagaccaagcacgtcccgcgagctgcccccggccctgaccttgggcttgggggtgcttccctccgcggcccctccccaaagaacaaacaatcggctccaaagacaacacgctcgttccatgcaacttacaggggcccggagcaggggtccggggatgggggcttcggccgacaatggacacgggccctgggctgggggggcccccagggttgggggagttaagcagccaggattggggggaaaggggagaaacagaaaatgtgggtatttttcttgggttgtgttttctcaagggtttggtccaaaggagattaaacagtgcgaaagtaaccaaggctcacagctctgtggccatgaggttgaggtggtggccagcaatggggtggaggagacctaagtaaacttcacaggcggcgcgacatttcaacctcttccacctaaaccagagcaactcccaagaggcctgaaaatgggctcccccagtctgtcctgtgcactctgctgccccatgggtctgctgctacatgggaaaaatcacctgaagtccagggaaaccagggctgatgtcctcacttctcaggacaacagagattctaggagccaaggattctagggccctctggcaccctcagccaaccccttaatcctccagtcctgttcccctaattccactctaacccgaaggaaaaccagaaagagacacacacagacatggacactgaccagacaaacgagaccagatattgtggaaggtccagggagtggacacatatatacaaagacttggctctttctggggtcacggagggtgtgtgtgtgtgagagagagagagagagagagagtgactcagattattgaaaaacagctgagggagctgccccagccccctgcttcaagtgcccagggtcaagggtggggtgggcatccctgagggtggtggaggacaggggttgggggtgtagtccaatcgagggccctggctgcagtgtgtgaagctggggagggaggccacaacggagcgggacccacctgggggccctcagtagggccggttggcatccttaggccgctttagctggactttgaggcgcttcatgccgatctggaagccattcatggcctggatggcagcctgggcactggccggattgtcgaaactcacaaagcctggggtgagaggggcataaggcccggcccagccccacctcgctcttccgtgcttaggagacctctggcactaccctgtgtctcccaagtgtcccaaatgcctagaaagctgcctgccacatagcagcattccttaggaatttgttgattgatgggttgaatggatgaatccagtccagccactccaactaccacattcttcccagcattctgtgccagtgaccccttcctctgcctggatagctctgagcctgccctttgaaaacggccacttccagaccctaaatggcttctgaagcagagaagaacattccctttctcccctgaggaagactttcaaagatgtgaaggcagctaaaaccgactccccaagcccaccttttgcaaaccaaacatccccagaccataagcctatttcagacctcatgggacatgaatttggccagtttttaagagaaacgctgaaggaagaagagatgggccgaggcagcagctgggtgtggcatgttgggtgtgtcaaaatggctcttttgtactcttggataatcagtatttcaaatactgggtccactgtgaccataaatgccttcaaatatattagaccttgtcctgatttggagtatggcaaaaaatgtgccatatcatattcttaccaaaacatttgctttgattggtggctcggtcaacaaagactttggctgagatgacgtggccaaaggggacaaacatctggaggatctctgagtcagtgaactcctggggcaggtggtagatgaagatgttgcagccatcagggcctgggtggcgacagagacagaagaaagagctcagtgactgggaggcacacaccccagaagcaaatgtcccagggaaagcagatcctgggagtgccctccagtcccagtccttgacagtgtgggccaagtctccggccactccctccccacttgctttcatcctgacacgtgggcaagagctgggctcagcgcggggtgacagggagtccccaagcccataacgagggcattcctgtctcccaaggccccagccagcaccttctctttgctgctgctgctgttgctgctgctgctgctgctgctgctgttgaggtggtggtgggggctgctgggcgaccagggctggaggctgcgggaacgcaggtgcaaccaggctgtaggctgctgggtaggctgctggggtggggagaagagagaggctgatggggcttccctgacttcttgagccctcccagccaaccctgtctcccttcccctagcccaggccagtggcacctgcagggctgagaggtggtcagggaaggagctgcctcagacccctgggtgtgctgcccttaaagacccctccccacagttgggcttgtcagtaaagcctgaagagggtgattggcagggagccaagaagcccagacccagttactgggcctcttttcctcctgccacctctcccacctgagcaggggccctggctagggcgcctcacctgtgtagtgctgcatccccgcgtaggcctgctgcagggggtccacgggggccgcggggctctgggctggggagagcagcacagactatgagcgtggacctggcacacagtgggggccctcagtgcctctctgggcctctgggccgaggccaggcaggtggggagcagagcttctctgggcatggggtgtgaagtgagaaggcagaaatgcacaaagcagtgggaagaggggaaagagcccagcgttaggaagacttgggtctgactgtcttgcaaccctggacaggtcgcttcactgctctacacctcagcttcctggccgagcccaacaggaaggatcatccccgcccaggatggcagggcaggaggaagcacctgtacccccaaagctgggagggaaggtgtgtcctgcctccctaatgggagtggtggtttagatggttgctgggacggagtgggcaggcagagagtcccacctgggtaggggtgaaccccgttgggatacagagcatcaggggcaggctgcccagtgggctgggtgggcaccgggctgtagccgttgacgcccagggcagccggaatggcagagacaggcgtggcagcgatggcaggaggggtgctggttcctggggaggagaaagcgacagggagagagcagaggagcagacacacacacaggcagagaaccagtcagcaagtctgtgggcagaggggaggaagcaggcctctctgacccctgagtccctcccagaccccgaggcttccctgagcaatgccctgtgcccctccctacccctaccatgcttagctcccttgcccggccttgcccaggccatacctgaggatggggtgatgggggtggcgatgaggccattggcattgatggcagccatgtgctgcatctgcacggcagccatggtggccatggggctgaggtaggcactgtgagccgctaccagggccgcctgctgctgcatcagctggggggaggggagaggagagtggggcaggccccctgtgcccaagcctggctccctcccagcccggggccttggcatcgggagggtgggggcaagatacagggggtcaggagggctggcccggcatcaggggcagtgctcacggcctgggtgtaggcgctgtaggctccaaactggagggcgatggggctgaacatgcccaactgggtggccacctgctgcatgcggcggagacctcgctccttctcagtgtcagcaaacttcaccaccaggctggacgaggcaccctgggcacgggcccacacacaggtcagaggtgcagggtcagggtctctcctccccaaagccctcaggacctggtctccattccacccccatggcatggcttggcctctctgagagggcggccaccattttgcgtatgaaagatggggagatattaatcccactctctccctatgctaggatgtgcaagaggctagaagaaaaaatgaggaatgtgaaggcacatgcttggaaagtgaaaagcctactggaatgaaaagggcatcattggctactctgtgaggactctgaactggaaatcatccccaccctgggttgccacagcaaatgtttaatctcaggctagtcttcccttgtagctgccctgcgtgccttaccacgactcctgcccccacaccccagtcctcatggtgtgcctcaaatcttaatactagtctgagctgaataaaaaccaaattggagcatttgcaaggatgatggtagaatcctagaatctcaaagctggaaggggcatagggtcattggacacagttctctacccaatgctgtgtcccctccaccaaggccccgtgaaatgtctgcccagcctttgctggagagctgtgagttatgggaagtgcacagccttctgagtcagccagttccaatttagaggtgggctctagactggtcactgacctaacgctgctgtgcaggggcagggaagaggggtgcacgtggggcctctaagcaagtgtcctggcgccccagcaaatgagggtagggggatatgggaaggctggagaagagacgggggtgaagggagggctggggaatggagggagaaggagagggatgtgagggaatttggctgaaggtggatggggaataggggaggagtggggaggtggggaagtgccatttgaaatgtgagggtgtccctaagcagtttggttcttctgccaggacattcctttccaataaattcaaatagcccatcctgagtggactgcttctctgggccagggcctggcaggtgggcagggtgggaaggagaggcccgggggcaggggagtggggctcactggcagggtccggctgctgtgaagggtgttgatggccgcctgggcctcagcgtgggtctggaacttcacgaaggcgcagcctggagaggttgagatggaggaggagaggggtaagcacccatccctgcgggaccccgcggtggaacccgatgcctagggagtcttgggggtggaacaggaaggggaagggcccggtggggaagggggaagtgggtggactacctttgctggtgccatctggcccccggagcacagtgcactcgtcgatggtcccgaagggctcaaacatcttccggacgtcctcatctgtctgctgcttccctagcatccccacaaagagcttccggtcttctgggtggtagggcacaggaggagggcatgttcagggcctcctggctgccttcccagcccttcttccgcccttccctggagctcctaacactacttctgctacccttagggtccaatggctgtaggggctgatggttggggaatggggtatagttgcagagggtgctcatcccagctctgagggactcgcactccaccctgggcctcagttttgccatctgtacccgccccagatctcacccgctctggccacactgactcctatctcaccgcagctgggaactcttcagaatcatcaggctttctccctcaagaaaggctacccctcgacaactccaggccctgggcctgggggtgggaggagagggacagagtccaaaggcacagaacctacctcctcggctctcgctgtcggctggcttgacctggatcggcctgttcatctgaaggagagaagagaaggcagctgctggggacctcctctgaacacccaagagccctcccaggccaggccctgcagagagactagaggggcaagccccaggccctctaagtttctgatgggaaggaagggacagggcctaatactgttcaggatgaaggcctgaggggatcagaggcacagagagagaggatgtagagggagaggctcatgggcacagctccaggctcaggttgggctcctgatgacttggccagggatgggtgctgctgtcctgagtgggagaagggggcctgcacataggacccggggcctgagagagagcccgaccaaggagttatttaataagaattgcctcaattctacaaagtgggcgcaacagaggccactctgaagaagccccaaggaggactctagactgagggagaccccacaaaggcccagacttccttctgacctctagaggtgtgtctgcctctctttctgcccccctataccccttgaccccagggggaaggcactcgggcagcacaaagggagcagatgcccagtctccgtggcaacgggagaatgcgcaccatggcaaccgcccactcagcctgatttatccgtccccgtcgccctggcgaccgtggtgacgtcatcacttctgctgctccacacacccagagaaggagtggggtggggggtggttaacagggtatgctgggggtggaggatttggtgggggctgggaggtgggggaggggcccagaaaaccttcctgattctggagggaggcttgcagagcaggccctgcaggggccatcccatcccttctcctgcctccctcctccagagcaaatccttggtgcctggagggctctaaaggaggagttgctgtcccgtgctccttcgcaatttaccctgtgcacggaagtcctccagagctctaacctctccccgacccctgcagtatctccctttgttcagtcttcagtggaaatggagaaattcctagttccactctccatgttcttgtctggtgagaggacttggaaattactcctgcaggttgattttcttaaccagggtggggagtattataggaactggagaaagaggagaaggacttagtatttagtgtctgaaaatattttgctcttgaggactctgacagctggaaccacacctggttgccccactcatctgatggtggggcagtagttccagtgaccagaaaaattaaacctcaatttacattctgagggtgaggctagaggtaccctcaggaaaggtactggactgggagtcaggagacctggatttgaggactagccctgccctgccacttactagctgggcgaccttggacaagccactagtcccctctggacctcaacttccttatctgtaaaacaagggggtgggccaggcgatgtctaatcaggttccggtcagctccaggctccagcatgtggagatcctgtgtgtggcatcacttagcgccgagaagtgcagaagtcacagttgcccctgccccttctcaccctggatcctcacccaggtgtcgcatcatgccagtcagtctggccgactccaccagttaggtattcccggcctcggaccaaacctaagccccacctcaactgatactcctttcccagggccccacccccgccccccaaatctctggatctgagagcagctggtgaggagggagggtaacagtcatacaaatcctccagccaatctgcccccagctttatcacccgccaatctgggattatcccatcggaggctcaatctccttaggcatgtgtgtgcgggtgcgcatgcgcaagcaaagcgtgtcgtgggggcagatgctcagggtgcatgggctttcacctccttctctcctgtgctctagccaaagcactcaggaaattccctcacaggcacctccgcagccaggcacccacccctacacccacgccaaaagaagcagaatcagaaccagggttgggggattcttacgcttggcgctagcccccttcccagcaggcctggggatttgctgttctagatggagatgggaacctgggacccagagagaaaggatgcagttccctcctggcataggctcccaggcacaaaaatagcatctcgagaaatacccacggctgatgtggattcgcacaaagagacacacaagtgtacagaccacagcaaggaccgtgctgacggtaggctccccctacaccctcacagacaggacccttggcgctccagtgtccccttcccagcctccttcttcgtggcctggcacttcctgtggggagctcaggcttcgttagctcagctcagacacacctgccccctcccctgagtccagctgtgccctgtttacctggcaaccaggcgcagcacctttcctccctagttactacccaccaggtgacaagccctccctcgggcctcccaaagaaggagtggctatttataccccaacccagtatagccgagcccctccaccacggtcacttttaaggccttcatctttctcgccaatagcaaaaactccacttccaagaagacctcacagttctcacaaaatctaattcttttgagggtacagcctggggtcctgccactcctggctccacacttgttcccggcgtcccagaccactcacaggttctctccgtggggccagaatccaccttcctgactgcagaccgacagggaaggcccatgtcccccaagtgggattttggttcagggtgaagggggaagagctggacagagggcaacccccactccaccacctccatgatgccacaccctgctcagaggacaaattcagggacctgtggcagagccactcctgggaactcttaggggagagaaaaggaaatggggctcaacagctataggcccagcccccattctttctctttccctctgcagcccaaaatatcaccctagtatggtagcaccttctagatttttggggtgacagagatggggagcaaggagagggggctaaatgtctgatttttttaaaaaaacctgcagtaggaaggcatggagattaaacagtaggaagaacagttatgcaggagctgacacactgcacacacatgcgtgtgcatgcacacacactcatgcatgcacacacacactgcatgcacacacacgtgcaaacacacactgaggggagaatgcaggtagcaggagaagacttagggaagacaaagggtcacagacatctgctccccacaactgccctgggtctgttccttcaaaccccttggatgggggtccctcttggaggatggaaccctcatttcctactggaagctgtgtcaggtccctctggattctgtcccctgggacaagggctaaagtggagaattcagcgtcacctagaagctctggagaagggctagacaatcattaaccaggcgcccttcttcctcacccccaccctgggctggacttcctcaagaagggcaggtggtgcctctccacacccaggatggagctctgcctgagctgccaggcagctggaggggcacagacctagggtggacacctgcagctggtacacatgacctttggggctcatgcccatccccaggctgtctctcatccatgtctccactccagtcctctttatctaccttttcctctgaccccctctcatttctgcaggggctctgagatagggagacaacagaaaaagacaaacagcgatggagatgaaaactgttgatttgtgaggggcctccacagagaaaaacagggaaggcaagttgggactggatggggaccaagcttcccagggatacgtgtgcccaaaccccacacatctggcctgtcaagagctcacatgcctgtgtgcacaaacacacgctcgccttgggtcctgcagctcacacacgtgcatggcccttaactctggctgtgacaggcaatgcctattcttgacactgactgggataagatctttggtgggcgtgggggtttgggtggatttgccgcagttggctttgctttcctagcagtactcaaaggttgaggccatggaagggcttgggacaatcagcaaggctggctgggaagaagacacaaagagataggaccttgcaggagaggggccacctctgaggccacccctgcctccctgggcatacctggtggcatcaggcctgatcctctacaatgtctgtccctgcccttgcctgctacttccaggcctacctccagcccagacctgcccaggcctgcccaggccctgctctaccctgatgctctgtggctctgttcctgggactcttcctgggagacagaagggagatgagagctcaagaaccagcaccgagatgccaatctagccggcaccagctgcctgttctctgggcactcctccctcatctcacagccacccagcctgcctttccagagtgacaaaagagtgcctgggtgccccctgctcaccctgatccacacttggtgtccagagacttttccccacaccttccaaccagcgagtcctccctctagtgttgccccatgggcagcttgggaagtggggaaggggctgcatctgctcctggtaaaagtcatgtttacgccactaatcgctgctttccttctctccaggtaacaagaaatgcatgcatctacagcaagaaagatggatgctacagagagagagggggacttcctggtgatgagaggaggtggaaattatgctcagtgtcaggagggtggtgagcctcctgccacttctatggcccttctcagtcccctggccctgcaaagggcaggactcacccctggaagcgtcttctgttcgtgcagggcgctctgggccttcagggctgaatcccgggcacagtatgtcaggaaggcacatcctgaggaggggcaggggcagagaaacacggcggggggtgagtcctccatctcccctctctgaaaggctcccttccaaagactgacgactgggaagctttcccttcttgtcatcttctgcctgctggggtagagaggtgtctccaaggggtagactctctgccccagaagtggggcagacacctggaggcctaaatactggtggtgatgggagagggaggacacttgggctgtcaggagatgggctttgtgtagggagagaaggaccatgtgaccgccagacaagtaagagtagtgtggctttctctcctgctgagctgttctcctttcccctctctccctcacctccacctccctccatcttgatcaccatcatccctctcttctcccattttccctatttcctcatctctccccacctccaccataggcaggtggaggacggagagtgaaatagagaagggaagggaagaacagttagttagccggaagtgcctcttccctgtgccaggtggagggggagctggtgtggcccctgggatccccggtgtgtggagctctccaagtgctgaccctgaccgcccccacttagccgcacagcccttggataggcctgaggagcaccctcccttctcccccactctcttaactttctaagcctcccacactttccagatctttaccaatctccagccttcatgccctgcttcctagtccctctctttagtcctggagctgccctgcccagtccagctccacgctttccacattgaacacctgaccctgtgtcctgacccccatcccaatattatctgaggctgctcagattctcagtcttgctgcacacgcacacacacacacacccctacccagctgcttatctcccaaaccagctctcttgtccctccattctttcttgagttcatcccatgacatcaacacacccatatgtctgggatccacatctttgcagccgtcttgacaactcttcagccaaaagaggccctccttagtccttcaccggggtttcctgatcactctagctgagttctttttcagctcctccatccactttcctcaggcctgaactcttctccttccacatcagcccttcccagccgctccacccctccagcctggcttaacttcccccagcctcccagcccaccccgaagcctcttcagcctgcccgacccctcacccttgtgcagcccggtgtacttgtccttgatgacagtcagctcaaagatccgaccaaactgttcgaagatgggcttcaggtccttctcctccagatgcctcgggatctgccccacaaacagcttgatggcatccggctccttcattgaggcggcccaggaggaggggccgaggggagcagggagaggcccaaaggccaaggggagctgcccagcaaggagataagtggtggggcccgggggcccagctggggctggctttccctttggcccccaaccacgctgctaagcagaggggcggctcttcacacaaaggaggcccagggagttgagtgctaggggtcaggggtctaggcagacgctgtcatgccaccagggggcatcgcctaaacaaacgatctccctcccagagatctggcaaatgtcccaggatgggggtgagtatggccaagacctggagggttaggtggtagccgggggtgctagggcttagagggctgggaactgggagttgagatgagagctggaggcggggaaagggcctgaggagggtgatggggaggagactgaggggttaaggggcctgctatggttgccagcagcgtcagtaaggggggcccactcctgatgtggggcaggtgaatctctcgttggcttccctgggaggacacctcccctgtggcggatccttctgctgggtccgaagatccctgatgccagatgcttgatctctgatggcggcagggctccaggggtcccttttgccctgccgccccccttcaggtcctcccctcagcccccctcccacccccaccccagtccccgggcctgggctgctgccggctgctcccgccgctggggctgcctgctttcccggtcacctgggtcccggagctctgctctccggccgcgctctcctcaacaaaaacctcccccctccacacccccctccccactcccacctcctttcccctgacatcagtgatgtcagtctcaggggtcgaatacaaattctctaccctggagagggacgcacaatccaggcacgagccacgccctctttctatctccatcctccctgactcccttcccgcccccagaagagcagctggtcctgttgataataacccttcccccatcttactccccagtcaggagttgggcaaagcactaagatggagaatttatagaggaaccctaaagtggggtccattgttccgggggctggagctgtccccggtgctggaagactcagcagatggggggtggcggggaaagaggggagcccggcatctggggagccccaagagtagagagtcaaggaaagaaatcaggggaaagaaaaatgagaaaggacggttgcataggctgaagggaaaggagatatagatggagagggaagcaggtcgcagagtctgggggaaaaagaaaaaatgcagagaggaaaaatggaaagggacgtggagaaggaggagcaggatgagaagaatgcagaaagagaactgtatattttccagaaaaggaaccaagaaaaacgatagctttctggcatttgccgatgcccccttctctccctctggggggtttgtgtgtataagtgcgtgggcagggaggccgcggaggcggcgccgcgggcgctctcacttgtaagctccttgaagaccaggacaccgtttaattcagcatcttactgttcacagtgtctagcaccctgtcttgctcatgcgtagcaggagcttaacaaacactccatgcaaacaacctctgacaacagtggattcctgattccttcagtgggaagaaccacagctgtcaagcttccccttaggatgcagaaacccaattactctttcctttgcttctttcttcagttgggttctttgagttggactcaaattgagccaggtagcacagaagagcaggggaggcacattcggggaccattgctcccctgaccatggatacttctatggatgattggcaggctccacgatctggagggagcgtgacccctccatgcactgggcccactcagagcacgccctcagtgcagggattatctgtggacatcaaaccttgtcagtggtggtagcccttgctttctgtcagtgctcagcaacgggggctctcctggggctctgggcttttgtagagcaccctgtcttcctgtcattcccttcttctcccccggggtagggctgctgtttccacagaggcactcgtgtctctaaactgtgtcccagctgagtcccaggggcctccattcctgagctatcacggcaggcaggcttctcttctggaagggaaataatagtaacagccagtgcttacatggctcttacagtgtcccaggctttgtgccaagtgctttatatttactaactcctaaaccctcaccacccccctatgatgtagattttgtcatctccaaatagagaggaggtaaccaagacacagagctgaaataacttgcctaaagccatgcagctagaaagaggtctagctgagactggagcctgggcagtctggctcctgagtccacgcatttaactcccacatcaaacattcctcttgagaatgggagcagtggtgaagtctggcctttcttcctcttctgtctccatttaagccctggatgagagagagtctttctttttactgcttgattctgtggaccacctcccatccttccttagcctgtttttttgttgtggcctggagccacgctctggcaggtgcttgcatttgagtgaatgtgtatgtgtgtagacttgattacacttcatcacatggatgcccgggtcccccaagtagggtcccctaagatggggtggcagtggggggaggtgctagaggactcagtggtgggtgctcagaagaagcgaatgacggcagagccagggaatcaagaagggcacacacatcttgaaagtaactttccactcacctaccccacccccactgctcctttccttgccttctaatctgatcttggtatttatggagatgctaaacagatcatgtcctctgaggatggagaaggggaagaccctatggccctgttgatctcattactctatgtcttctcagcagatctgccgccctgctgctcattcaggcttggggctaatcatattaattgaaatattaaacattcacaaaaatgaattaaaatgaactcccctcactcctcctcccagtcagtaattggggagacagctgcagacagcaaaatgcgtccagtcctttgcttagtttgtggtccccaaaggtgtcagtctgagagaagaggcagggtttagaggagaagagttgtaccactcatcagactctccttgctgagtgacggtgaacacatctctggtgttctttcaggccatgggatgggagtcctgtgaggtaaaggcaggggagccctgagactcagatgcctattctggaaagtttctctctaggagagagagaggcttccaggatactttctctgcccaccacccccaagctcaccctcttttttattcctctgcagtcaaagctaggctgccctacataaaaagattattgaatttataaagggagagctctgatcctggctttagattcttaggaaatgagaaatgctggataattgggatatttttcagaaagggcaaaatgtggtggtatgtgtgggcagagtggctagtcatgaagtacttactggcttccctgattgaatacagagtgaagacatctgcagcagaatttatgagagtgcacaaagaattgattctataaccttcctgccctcaagtggcttccacctcaagtggaaggtaagacaggccaacacaatacataatagtgagtactgagacgctgttaaaaaaacaaaaagtagcccctctcatacatgggcatttgggtcataggatgtgatcagtgaagaaaggcttgattgattatcaaagcacaagaagatcacagattggcagacggagggtatcaatcatttcctacttggaggtggggaggtagagaacactgtgcatgcctgtgtgtgtttgagtgtgtaggtttgctggtccaggctctggcattgtctaatataatacaagccacatatatggtttaaaaatgtctagtagccatatataaaagcaaaaagaaacaagagaaattacttttaataataaatgttatttaacctgatatatccaaaatactatttcaacatgtaaatcaattacatgttattaatgagatttttttcataccaagccttcaaaatcctgtgtgtattttatatttgctgcacatttaacacctacagccacttttcaagtgttcaagagccacaggtggcttgtggtgactgtactggctggcacagctctggaggtgccaccaccagcttctctggagggagtatggggagaaaagacagatcttggccaagaggaaccattatctctggttaacctcttgctcctgccgggaaaaaaaaaatcacttctgacagatggcagcttatctctctctcactctattaactctctctcttaaaaaaagacaatcaaccaaaatgatcactaaccaagatggggttcctgggaagtggcttgtagcccactacctaatttacttcttgtggttttccctggcttgggaactgccaacactttcacttcttttcctcagtctttgctggaaaggacagaagcagaccaatgataacccctccacggccagggcctaatgctgagcttgtttctcatggtattttcttgctccttagggcagttgttcacaaatctgaaaagacagcctcccttttttctcctgcttctcagaaggcctctgctgagcacgatctctgtgggggtaggagctcggcatgtgtgtattgacagacaggctcatgccctttctcgtggctattttcagctctctggctttatgtttcactttctcttcttaattagatactagaagaacaaatcttgaagaccaaattccctttctcctcccgtattcagttgggagtggaataaaataatttagaatttatgaggagcccagggtgaagagaaagttaatctacacaaaaaagtcagtccaagagggggaaattctggcagaatgtcccccaggtcctttccagcatctttagtcggacagaacgttccttcctttgcagaactcagctcactctatgttctggggtgcttccacgttgtttgaagaatccacggctccagtgtcgaatgtgtaccggacagagggacgggttggcttctgggacagtggaaagggaagaagcttgggttctctttccccagtactaggcttcctctagcttctgtccaagtgagggagtctggaagcagattcggggagaccttttttcctgttttactctagagctaacaaaaaaaccctgaagttgggtggggtcaaaaagggctcattccacatacaattaagtccagaaatcagtcccccaatccgggaaaggcgatcctttagagacccaccccccaagcccccgccccggagctcacccctcagttccctcagcccctagcccctgcttcgctgaaggggccgggcttgggggcagggcggggccgggggcggggcctcgccggctcgcggccggtcgccttgacgaccgcagcaagatggagacgctgccaggcttgctgcagcggcccgaccccggggcgcttagcgcagcgcagctggagcagctgcgaaaattcaaggtgggtgcgcccgcgcccccatccagcgtccaccaaagtgtagctgccccaggactggggccccagactgggaagagagccgccgagagaaggggagcgggagcctgttccctgataaagtggggagggcgcaggggagacccccggcggacctctaggcgtctgatcccagcacagagcgcgacgggcatctgagagtgcaggaagaactaactcagggactcggccagagaaatgggccgaaattactgccagacacatccgaccttagtaaaggcccctcatcctgaacaagcggcagaatgatattttatctgtaagaagatgggtggcttaaactttcaagcatcctggggaaagacttgggttaaatgcgcacgccgtttcccgcagcccttcacatctccagggctgaaccctgaatctgtctcctaatggaagtgaccctttgttcttgccccccagattcagactcggattgctaacgaaaagtacctaaggacccacaaagaagtagagtggctcataagtggtttcttcaggtaggtggttttccaggctctgggatttgtggcacgcagggttttcttcgttatctctagaggtttccttcagttatctctaaattcttaaaaatatgtctattcatttactttaaccataaggataaatacataccttatgacacttggaagagggaatttggcgttgcgaaacccaacagccatccactgggtgtagaacactattctcaaccataggagcttaacaaaatcactagttgaacttaaaacaaaaatcagttgtctggttggcccttccctacttgaaaacattactgtagaaaaattccaagggttggaagccactcttttcttggggaagagaagacaatttaccagcgtatcctggaatatgttctttccttcccccaccctcctttcagcctggcatttgcttgaatggaaacatatcctaatgggatgaagaaggagaattaaaaaaataaatcacggagcatcagtggatgaaaacaatagagctatctcaaatgctgtttggttatagacaaatagacaaggtttaaataattataatggcacccatctccaggcattgtgctgttcccctacattagcacttaccacactgtattgtaattgagctgtcaatcttctgttactggtccaaagctccgagcttgtggagtgtgtttgtgttctcagtgcccacgcagtgtgtggcatcttggaacacttttgctgatcctcccagcacctccacaaaagacaggtgattgtcatttttattttataagtgagaaaatttaagcttagaaaggtgaagtaccttcccaaagttgctgaaccaggattcaaacccctggttttcccactgtattgtgctgtaagcagtcggtccccatttcccctctggactgtgtgcttatagccagaggtgggccctcccttgtcttctcaaaagttggcgaggtcaggcaaggtggctcatgcctgtaatcccagcactttgggaggccgaggcgggtggatcacctgaggtcgggagttcgagaccagcctgaccaacatggtgaaaccccgtctctactaaaaatacaaaattagccaggcgtggtggcacatgcctgtaatcccagctacttgagaggctgaggcaggagaatcgcttgaacccaggaggcaaaggttgcagtgagctgggattgctccattgcactctagcctgggcaacaagagcaaaactccatcgcaaacaaacaaaaaaaagttggccaggcagatgcgttggctcacgcctgtgatcccagcactttgggaggctgagaggggtggatcacttgaggccaggagttcgagacctgcctggccaacatgaggaaaccctgtctctactaaaaatacaaaaattagtcaggcgtggtggcacgtgcctgtaatcccagctacctgggagactgaggcaggagaatcgcttaaacctgggaggcagaggttgcagtgagccgagattgcgccactgcactccagcctgggcgacagagcaagattctatctcatgaaataaaaattaaaaaaactcactattcatattatagacgtttctccaagtggcaacaaattctcagagggcagataggggaaggaaacagagaaaactgaaacctatccagttatgaaggttggccagggataagccttgggcaaaagagagtttagggatcctctgtcaatatcagacctgaggatcaggccgtcaccttttgcaacttttcttctaaagggaaataagatgatatcgttcctatcctggggagcttgctctccaagttagtagtagttccagcagagagattggggatagaagttaaaagctgaaactaaatcaacatttgcattgctcacaaacaacaggattagaatgcttggggttgatgaataagaatgagttgtttcagtcacctgtcagagatggccttgattctctctttgtccaggaacagtttccaggagcagcctgggtatctgagactggctgctgtgggaacagccccagatacttcctttcctttcttaccatgttcctgtcaaggccaggtaggccaccaggtttttctttttgctgtccctaaagctactctacctgaaattcttctgacctcttttcctgggtggagcttgcagagggtttagtgtttgaagttttagggtttacttttgtttgtttggtgtcattgttccctttgattggtaccgggatgaaccagaatcagcttctgtccctgctggccacctcacatggtccttcctatgagaaaagaagaagggagaagtgagggcagagtcctgagcaccgtgcctgtccttgtctgttctgcagatatctgctgttgatacattccaagccaaaagaagctctgaagggttctttctgggaagcaaactccccacttgggttttttagatcctaatgatttatggccattcagccacaattctccagcctatattggtaaatacagcgtaccaaactcttaacaccttgagttttggacctgaaaaatggaaagagtaggaatctgacttattttaaggtacacagaaacctcaggttttgtgctgcagatatgatagatagccaggtatgaaattgtagaaagtattttttttttttttgagacggagtctcgctctgtcgcttaggctggagtgcagtggtgcgatctcagctcactgcaacctccgcctcccgtattcacgccattctcctgcctcagcctcctgagtagctaggactataggcacccgccaccacgcccggctaattattttgcatttttttttttttagtagagacggggtttcactgcgttagccaggatggtcttgatctcctgacctcatgatccacctgcctgggcctcccaaagtgctgggattacaggcatgagccaccgcacctcgccttttttttttttttttttttggagacgaagtctcccactgtcatctgggctggagtgcagtggcgcaatatcggctcactgcagcctccacctcctgagttcaagctattctcctgcctccacctcccaagtagctgggattacaggtgcctgccaccaggcccggctaattttttgtatttttagtagagatggggtttcactatgttggccaggctggtctcaaactcctgtcctcgtgatctgcctgcctcggcctcccaaagtgctgggattacaaatacagcagtaatcatgtccttccttggctggaaaaatcttcagtagttccacaacgttgcttttttgggtttgtttttaaaaattctattgaaatatactgaaaagtgacatatcctaagctggatgaactgtcagagggtgaaaatacacatggtactattgttcagatgaagaaatagaaccttaccaacacctcacatcctttgtgcccctcccagtcactccccttaaaacagtagccagtatcctgacttctactagcacggatttattgtgcgcttttgtattttatatgaatggaattttacactatgtgctcttttgtgcctgtttccttttgctcagtcgtatcttgtagatcctccattctcactgctgtataatattccagcatgt

SEQ ID NO: 523 - DNA, 23255 bp, Homo sapiens
cttttcactctggttcacatcagtcctctgagaatcttagttcacaaaaatgtctgacttcagcccaaaagagtaaagataacgtagaggctttggaataagaagtgcatgcatttaaatctcaacaacctcacttaccaaatgcataaccttgggttaagtcacttaatctgtttctttaactataaaagggaagtgatccctatgtcatatggttgttctgaggatgaaatcagataaggagaggagagccctttaaaaaggtcagtttcccttggaccaacaactctgatgcccatctcataccttcatgcctcattatagaccctgatcggggcaccatcctaccttcagtaccaggcactcagacgcaaatccttcacaggagatgcacacatccatcctgggccatgacaggcagccctggctgagcactggacttgtcctcccacaccctcctggacttgctcctgtgatctaaccacacataccacctccccacgtggctctatctgcccccatgtccccagtccatccctgtaggcttgacactatggtaccaggctccgcacaggccatggggccctggaggtgttctctggctttatcagcccatgagcagctcttgtggaaggaaccagcaagaaagcaaactcagtccatgctttcctcacagtcactccaagtctcagaaaagcaaagcaaaatgagggcctcccacagacagccggctggtgggaaagggtggtatctcttacatatctcagagggaggtaacacgcccaaaaaaagtgaccagcacaaggtacagatcctctctaaagctgtggctgcagccttagggacactcgagccaggggacagagccaagatatgcattaaacaattcacagagctgaccggaccaggattcaatggaatagagaaggtactgaccaatcagggcccctggcagggcctctcccccacaactcccagccaagccacaccacctcagctccagagccaccaactctgttaacctctgctggatcccggatggagaggccccatgctgcctcctgactcccagacctcagaaattcaaaggtcaagaaaaaagtgccagatatgctggcccctctctcaggagataccaactgttctgctatcctcattgggaacacacaatgccccatgtcatgtgtgtagaacccaggctggtgagcaaggaggaaaagaaccagatgagggacaaaaataggaaaatcagcagggaagcaccaatcccaattctggaaacatcagaggccagagagataactgcatgaccacgagcaaaaccaacctcccctttacttcccaccctggttttcccaatctaaccaaggacagggctattcgtgggagtggggatcacgaagagccatgcccagggacacactgcacatatgagggctgagactcccaagcacagccagcagctacgtctggctccagccctacagccagggctggccagactctagccaacacttcttgagggacttggctcactccttttagtctccccagctgcacccaagtcgatatctctccactccaacaccccctgccatccctcactgcagtactgctggagggctgagacctgtcagggtccttgaaggaagagacatcagattcttccaaacagccctgggttcctcaggctgttcacagccaacctagagactcacctcaaatggacagaggagaagaagaaataacaggaagcagaattggccaatcttccctggatagcaacgggagcagcatggggaagaggaaccccccacccccaccgaaacatatgagcagagagaggcgaccactgtgtggccagaggtaggatcccataggtacctccgaaaattacccaacataattccttttatctttagagcccagaccaatctgctgttggctaattccaactggctttactggccaagaatgctgtagtcatctactcgataggagagagacttcctagtgatgtgtgggcaccgagagtctgctttgtgaattgtatcaatgatgccactgacctccctgattctgcaggccgtcatcatttttcatttttaatcaccattgctattactgtgatcggcagcaagtgaggcagaagaaaagcatttctttgtcaacttcctagagatgctttgcaatggcttactggaccagggattttgttttttaaggcaaaggtaatgaaggcctagaggaagaaagtggctcattcaaagaaaccccaaaattagggagagtcccaaagctcactgctcagcccagtccaaactccagaccaccaacctagactaagccccctcaaggcaaaatgtatctagagttaagacaggccatccactgagactacacaggggagagaatccccaggcaccaggaaggctcccaggattaccgaggggttaaacccagaacctcctgctggatgctggagccaaagagagtttctattactgtgggaggcccaaatgctctgccaactgccacacccagcaacactacccagctatctcccacacgtccgcacagcccgaccacttcagctgcccattctgcccccaaccctgtgctggttactaaccccacacagaaaagccagaaggagaagaatgcaaaaaagagaacaatcgtttgggagattctgaatggagacgtctgaggattccccggcggaataaggaaaatggtgttcgtgggaaggaaggaggatgggggaaggctggagggagcagcccacactggacttacctgggaggcagagagcggttaaatcctatttccttgctgcatccagtttccagtaagcagcctggtgatgattcactgacaagactggggtcatgtcgcatcagtcagcacttgtggtcacaaaaccacaaaaattggtggctcaacagcacctatgagaggaaagaggggaatatccaacccaccctgccctgaaccagccaacacaacatgctcacccaccaccaaaactcctccagaggacagctgagccctctctgcccaactggagccagatctccagaaaccccaaatgggtaaggatgaagagtagacacagacccaggatgccagtcactgtgtttgccctcatatatcctaaagaaaatcaaagggaggaggaagtggtggaggaaggcagggaatgcaagaggtccgaaagaaggaagagagaggtcaaaagacatccttaggcaaagcatggcaaacaggaaaccaggaagagaaagcggaggcagggctcaactgtaccctcagccatgtcacatgcccctagcttctctccctctaagctcaatatccatcgcagagctattagcccttcctggccctcatcccacatcagcaccttcatctagcacgacctttcaatctatcagcatctgcaatacaggaggaaagtaagcagccctgaaccagacagacagacacacacacacacacacacacacacacacacacacacacacacaccccttcccagaataaaaggcccttggagatggctcatgctctctaggttctggttctctgatagaagtgctccactcccacaggggagggcagacacgtctgataagaattgcttagcacaatgctatatatagtctaggttcctaccagcctggagatgtggagctagaacttggcagagaaccatgctaggtgctggcaaggaccatcctcccactgccagccaatggggagcctcacttcccggctgggggccgtgagggcacacagggtccttccaggcagcccattaacactccacactgagggacacaggctgttggctccattttagggaaaatcaacttctcccaaatgtgagggggatgtgtgggggctgaacagcaaattctagcttctctgcagctatccagtagcatgagaaaatcaatctagtcctctcttctggaggactaagggtggggtgtgtgggagaagaatggagaaggcatagcaggtggctgggctcaataaacatctacccatttctgatgttcgaagaaataaaggaatgtaaaagaatgcagatgaatacttactgcagagagcggggctgccaggcatctcctttttttgttccaaatacatgcaagtgagccactctatccggcagtatgacggctgtctccggcacactggcaccatcctcagctgagcctgagtcgccaagaggttgtcacccactcacagagcaagctgcactctcctgagtcctctatgaggaagaagagaaaggaagataggtgggctcagctcacagagccaaccaagcaatgaatccagcagatcccaaccaggggcccatctgggttagtatgtggctctgggatgatgacccttagctgttgcccgccatccaatgaaagacgcaagacaatgttgggcaaaatgacatgggacctatgtcctggagaaaggccagtaacagaagatgcagggtctgatgaaggagggtctgtttaccacctctttcagaaaatgaacctgagagaccacagagctgcctgaagcccgaaatccaggctcttatcatatacacagcttgggacaaagaaaatgagacacgaaaggttccaacgtccatatacatacaatctttttaggtcaagctgctctctactcgggtgcaaaacatgacatgaagcggctgtgtctgcctttgcactctgagtggggatggctggctcccaccccctgccctgcttaactctctcatgtgacctcggtcacatctccctgccctgctctggctcccaaggcccaggagccactcctaccagagatcccaaatgagtcaccctgggaggtccttggagagaagaggaggtgctcagtgacaaatgtcactgctagcatcatccgcgggaaagcatgagactgaaaaatagtacccagtgaaaggagggagggggctgcggccaagttgtccctcatcctcataagcaattgtttgtccctctgccccacgctccagcagagggggtagagaagagaaaggggaggacggtttgtccgcattcagtggcagtggaggtgcatcttctctctcggtcgcaagaaggtggggtggggtggggcggggcggggcggggcggggcggggcggggcggggcggggcggggcgggacgggacgggacggggcgggacggggcggggcagggcggggggatcacgcgcctatagcgcaaagctgcggtatggagaaaagcctagaacccacagccgccatgatgacgcaaacaaaattaaaagggtcaagaactcaaggcccactgtttcacctaagaagaaaaggaagaagatgaaggggagaagagaagctctgatttgggtcaatatggaaaggggaggctgacgcaggctgcccaagagccagcctttagcttagtgacggtgatgcggatccgccatcttgaagcgccgcccggcagaggactctcaagacgccacagccccaccacggccacttctcccaaggtacaggtgcgcccgcattcactgaggtcggcctggcccacccctaccccaagaagcgaatcgcccttcattcaaggcaatgaccagcaagactatcacaaagagaaccacggtgaaaaatcccaaagggctttctgggccctgggaagatgtctgtcatctgggactagtgggaagaactcaaaaagtgaccctatttgccaagctcatctaataacacatacagctgttattttcttttcagactctaaaatgcaagggttcccagagccctgctgagttacctggtgtcgctcccatcctgatgcccgggcggtggccgccttctctgtccagccctccctgaaaatgaccccaggctaaggatcagctcagagccccgagctgtttttgtagctttcatgttgacagaacatcctggccactctgctgagagctccatctcccggctcccgatacactgagtcatcttccaaagaggaaaaaaaacaacaaagcagccgtcaccagggtccccattgccgtcgactgacgactcactggctgtcgtcacactctgctccgcggcccccgaattggtaacgaggggcttcagggtgcccagctcccctcccgtgggactcagcagcgtcagggaagcaggcagccactgctgagattcagaaagaagggaaactaacctggcatcaaaaggctcccaggaaagctcactgaccctccctctgccgtcaccagcccccaccactcagatgccatggcatgttcctgatgcagaagtaaaggggtatttatggcaggtgggggacagtacaccttgcaggcttgaagggcgtaacgcctaggttacctcctctgcgcccctgctgtgataccacttagggcacaggagctcctgtctcccccatttcttctctagccccctgctatgctcccattttaagtccctgataaaccactgggtagggatgggaacctatttgctgccaatatattaggcatttctgtataacagttgtagtagctccatctcactgaaaacttaaatcatatgacttgtctaaagtcactcagctaagaagaaggatcacaatgaaaacctaggtctgttcaagtccagtgtctctgctccctgctctctaattctggagcttattctggctttgaagatgctgtatcccactccacctctccctcctcttgtacgaggaaggcaaccaggataactgagtcagttaatccatcaatttcagctacaagaaaaaagccatcatcttgagtgaacctgaccacaaaggaagaggagaaagttaatgacagtgtcaaggaacagctgagggacccagaccatggacacaagattgaccacccaaactccctcagagcattagggacttacaaaattccttaaatagacaaattttggggatctacttcataacagccatcttgtaaacaccagtaattcagagaggaaaaatgtaaaggctttggaagaccagggctctagtcatgaccaggccacttactagacatgggatgctccccacagggctgtggaaaggagtaaatgaagtaactgcagggaaagtgtataacatggtatctgtcaaacagaaggcaccaaataggtatttgttttccttctcctttctctagcctccctcctggagctcccaatctgataggtgacataagacttatacacaaataatcataacacaacaaaagtaccataaaaagggacagactgtatggaagtttggctgaaagggcaggggtggttatgagaactgcttcttgccaaggaaatcaggagaggtccacggagaaagtgagactgccacaggtggatgcagaggagaagaggcatggaaaacatcactggtgaaaacagataggaaaaggaagttgcctggttttgttggaacctatggtccaccaaaagaaactgagagaggtaagactgtacaggaaacctaaggccagttacggccagcattgagcatcacgctaaagggaaggaattttactctgggaattatgagaaaccattttaagtttctgagcaagaaagacaagatggccgctgcacgcagaagggcctggagagagggggaacgggcagcggggagcctcacaagaggactacagctggaaccatggcactggcagggggcatggaggagaaagagaagaaaaacagtaagcaggcaggaccatccgaacagatcctcaaagctgccatggacctcacttccctgtccccacagggaggctgctggagacagagcctatttggggaacacaaaccacgggtctgacacgtctgagatgagctgccgagcctctgcctccactctcattcagacactcagcttttccgaactactccaagcaccaggctgatgaggacatgggaaacccacgctctggcaaagccgggcccaggtgttgaacccctacccagacgccttccacctgaatccccacccaggactgtgtccaagggtgggactaggcggctctgcccctagagccaccttcattgcggcagccaccactgtgcctgcctctgctgtgcttttgcccccccttcccctcctccgtcatagcccccgccccccgcccactctgcggaactggcacagcaggacagaaaaaccaacgccaccatgtcggagaccagcagaaatggctccaaaatggcagctcatcagaggagtccagaaagatcataaacccacccagggaaaagaggggaagccagtgacaaggggagtaaactgtcaaaactacctcccaaccaagcccccgataatcatcacatcttttccttcagaaacatcctctcaaaaatcagatgggacatgagtgaaagaagggtgccaccccctccaccagagaggccctaggggccataggtggtatggggcactcagaaggatgttctgtagcctcttccccaagatgaggctagaaaaccaccacttttgtcctcaagcttggctcctgccagtaactagacaagagttagccctcccagggattgcagtccttcactgctacccagtcagaccctccccagctctatgggccctggggagcaagaaggtagggttgcaaggaagggccgagaaggcgcgtgccatgccctcagttatgtaataagaagggcggtgctcgtcctaggccagagacccagggcgcactgcgcttccagatgcgcagtcacgggtgggggccactgcgcatggcgcagggcttggtaaaccccctccccacaaacgtgagacctgcgacaaagacaggttagagagccgggaccctgatttttcgaggcctccctcccccaaccaaaggcggacagcctgctgccctagttttattctgattctcctcattccctagactgacaaacctttctaacccggggcctccaaacctcccgtctcccactgacttttctggaaatcccaccagatgcggagtttcgagcaatttcctggggtcagtcccccatcctcacctttccaagcaccacgtagtagtagcttccagaaggtagatctttcccatactgggctcagctcacaactggctcttgagggcctctggacagccccggacgtcaatgcaaatctgttgtccccagggagtagcccagagtcagcaggaagcccagggtggtggcagtatcagcagcagcagctctgccctaccttgcccatgcgtttccaggggagccaagaattattttgccgcaacactgaggtgtggctgattggaaaattcccttttccaacaccaaactacagaataaatattttcttccaatttggtcaaccctctgcatacccatctccctagcattcttccctctaaataaaaagttttgggagccctgagctcttcctccttatagtgcgtgaaattttaaaaggcataggaagaggcttcaactgggcagtcaaaagcaggcatagacacaggagcctacgcacacccctaaagagattttagaaagctgctgggcttctccccgctcccctttaagcaagtgaaatgcaaattcagatttgataccctgccctgagccaatcaaaaaaagcttttcacctgccattggcccacccaccaatcagaggaagtgtctggagggagagccctcccctggccaatggaaggccagctcagtcacttagttaatgatgcagcagtacagggaaggccatcacatgtgaactggaagggagccaacatggagacacagagagcgcaaggtaaacaactttccaacgccaaaaggatgacatttaatctctaaatgctagcttcccttcttagctcatccttaacccctctcagctggccacagagaccccaggagcctcactacctgtccccatagagctcctaaccagatgcaacagtgactgcgtcaccattccccacttttcccaactacgcagtgacaaacctaccagctttaccccacttctcccagcccacaccccaccctggccactcggctccccaccagcctcagaatcccagggccagacctttcaataaggcaacccctgggaaaaaactgtccctctgtcttcctttcggcacttctcactcccttaccttccacataagacctgcacggacagacagatggacgctgacacccaaacaacttggagaaccagtctgtctgtccactagaaggaaatagggtaaaagctgggaggtcaggtgggaagcaggggatggttcactcctctcacctctaccctggtcaggcttgagcagctgacactagggaaaagaaattaaagtgggaaaaaaccctccctcagagaaataaatagcaaaaatcgagaaagaaggtgagaaagacagagcacccacatacacagagacagcgcccctgatcccagcaaatacatacgtgggggaagaagggggttacgccatcaagtcctgaagcccgtcggaccacccatcgccgcctgcgcagacccaaatcttggtcccgccgtaaggtgccgcagtcccgaatgttccagaatttggtcccatcaaaccctccaccgtcgccccacaacctcttgctcccacccctgccccccaccaccaccccacctcctccccacgggaaccgcccgtgccaccttgcgtgtcatctcctagcctaggctacccagaggcctctggccctgacagatctctgaacgctcagcaagtgagctggcagaacctggtgcccggtgttgctatgacttgtttcttgatttctctctctctctctgctgcagcacggctgttgctagcagacctatcgacggagcttgcttgctcgctcgctctctcactctctctctctctctctctctctctctctctctcagctctgtgacgcagatctaaattctccagtctgctccttgtgttgcaagagcagaactgcagcttttcccctggagagccggagggcagtgccaaggctggtcaaacaaggcaaaaaaagttgggcctacactctgcttccttggccacacttttcagctcacaccctcccacctcacccctcctgcacctcactgctctggggcatagaggtccctgtcctttcaggctcactccttccctgaggccttctcaggcataagagtagcttaactctttgagtggcagcccccagtgcccagacagggctgccctgtactaaatgttgcaacatgttttcttgagccatatgggcttctccagccctgagaaaaaatgttcctcaccctgaccactgtcccattaactctttgtgccacagacaagtccaggattacagtcatagctgatttctgttgttttttgcctttttggccaaaaaccaggacctttttctccctggaatttcttaaggacaaaaagcgtaattaaaacattgcctgcctaccccacacatgagatccttctatcagggcaggaatttgaaaaaccaaattgaactgcagcctgaagaatccagagtaaaaccagtctggatatccatccttcctgggctcaaaattttagggcctaggtaaatacgttcaattacttttcaagtaattggccacacagtctcagagatttgggttgctgagtcatttgttcccaagaagatctgacaacatgaaaaacagcaaaacagagcaacagccaagcctggacctgaagtggccaatgactgggttctcctctccagcatgggcagtcaagcaagatgagcatccacgagccgacccccaacccctccacaatgttcatgcatggatgtccacactcctggaaactcttccaggaaggggtggtccaccaatgatctagagatggagtggggttgtttttggatactcacaggtctccactacagcaagcaaagagcccccaacattttcctgcccctccccccagacgcaaaaatgcttccaagaacaactgagatactaaatcactagaccctacatacccagatagaccaagggagtgttgggttcccacactgctacatccaaagaatgcagaaaggttcccgacaaccagttgtaccatatgagcctagacttgaccagaagtgagtgagatattcaggtcctgggtcaggtaacttatgaagtctatgacatcaagaaccttgcaacttccaggaagatgaatgagaatgcgaggccaggcagctaccttatcccatatctgcttcccaggcagccttcttcaagcaactactctgggccaaagtttcatccggcagaaagaaggaccacttggaagacaagcatggcactacacagttttaaaagaagaccagagtatctgtgccaggctcccagcaggggggaaagtgcttcaaattcacaccttctgggctccaaggttgagcatgccaataaagaagttacctactggtctgatgaccaaaggaacgtggccttgatggcactaaagcaagtcccccagaaaggtcctctggttacttaaatcccatttgccatagtttccttctccatggaagaaaaacatgcctaagttcatgtcaggacattcctgatttatccaagagcccaggatcaaataaacaaagggctctgagctctgccagggagcctcctccttcaggaggcagaactagagggaagtaggcttggtacagagctggcccatcaccccatgaacttggtgagtgacgtggctgctcactgccatggcgatggggatgttacgggtgggtggaagtgagagaagaggcaaataagtcatgagagacgaagcgaaagcgaggcagggtcacaggaggaacctacaaagccacagaatttgtacagaggccgactgtagtctatgaccgcagcaaaactaagctgagtccctgcaaagataagtccccatctcaggggtgcggcatgaaccaactatgactcgcaaaaacctatgacaacactacgttcagcaaggctttgtttcctttcattttccctctaaatcttttccttcccatgaccccgttggtacggctttgatgactggaagaacactagggttttcggttttgctccggtttgaataaaatgacacagacatacatggagtggttttaaagagtggagaatttaataggcaagaaagaaggaagaggcttttcctgtacagagacagaggggggctttaagccgaaagagggaaccttgagtgcggtggaaaacagccagttatatgaggaggctggaggaggcaggattaaaacagtcattttaggtacctctgcccaattctaggtcttccttctattaacctgattctacaaggcaccaagaacaaaaaaacccgaatgggatgaccaggaagcagaaatgaattcagttccaaaaacatgggaggatgtttacttagcaagcacgctcgagcctacaaggaagcagttttacagggtgctgcatgcagtgtttgatttcagggggtaaagataacttcagagtggggaaaaggtgctggctccttctactcaccctcagaggcttggggaggccaggccagcacaaacttgaaaaggcaaggcttcagctcaagcccaacaggttgccggctctctttggctcctcggcagctaccggactcaggaactaaacaaactctccagacttcatgagcattccgtggcctccgactgatctgggtcaaaacttcgaaatgccaaagacaaagaatttttttctttaaaggggaatgagctgaactttgacccgcccttgttcagggtgtggaatgcaagcactgtgtaccggccacaaactccagttcggcaggcaacagccagaaaagcagtcttcatgccggcttcatgccggcctccctgtcctgtttcctctttagggccaactcgacggggtctaggtctttacctcgctctccagacagggaagctgtgcagaggacacattccaatctctgttatctagagctagagtggatgttctagataaatctggcagcgatctggtctcaggtggaactgacaggcccagtccacagcaagatggcatttctgttcactccctgggagctggtggacaacaggcgcttggttaccacctgaggtaaatcatttattaagtacctactaagtgctaagccaagatacagcacaggaaaagcatcagaaacagtccatcatggagaacacacacattccagctgaggctaagtattcccaaatttgcattgctgatatttaaaacatctgcttactttaaaagctgagatccacttttgcaatgaaataatatcaaacatactgcttggttcccaggctagctcacaaaagcccattttatccactccaggaagtcatcaactccagtgtcttcaggggccatgcaggtaatgaaggagtacagtggcctggggaggggatgtgcccagtggaaggaccgtgccactcctgatgggccaccctcctggctctgcctgctggggaccatctgggaacagagacccaaagagtccagatcatccaggttttcagggcaaggcggaaaactagctttatgttaaactcctgattttttttttaacactgtccagatattttaatggtcagaacatacctatagagcttccagtttgttctcctggttgtaatgtgtctaaaatacaatacgtttgtaataaaaaaaaaaaaaaaaaagagcaagcattgccagagtgaggaattaaataaaataaagaacatacccaaagaggaaaactttacctcacacatctgccatttgaggaaaataataagcatagaggaaaatgaggaaaatttaaaacttccctgagggctgcaggtggagaggtgtatcgaaatgacttccaagtatacgtgatttaactgaagtagtaataatatgtgtgcatcctgacctgccagctaggcagaaaagtcatgctgatatactggctctgtctcccagttgagagcgcttctctggacatccacaaaacgtccatccagggctttggtgataagattggaagggcttatcataatccagctgcccattcaagacacagtaccctccacaaacaccaccgtgaccaagtcatggtctagccccaacttgattcaataactcccaccacacctttggagggttcagacaagtggaacacaactgagatgaaatctctctgcagggaaatattagccttcaggtctccactctgcctctggagccccagagaacaagcctactcccccaaagacttggagacactttaggatggtttttacaaccagaagtttttaggctaaacaagaaggtacaaaaagggaaattaaaaaggaagggcggggggaagaagccagagagaaatattctcgaaataactgatcaaaagttaacaagccaaaggaaaagaggaagagacacaggcattcatgagacaggagcctcttgtggccaaaccaatagcaagtgaagaagcacatgggaaaggaagggcccacagtccatacacaaaagaaaatgccaagagccaccagatcagacagttcccaaggccagccaccaggctgtgccagtgatccaggacatactggttagaaccttgcactgggagaagaaaactgcatacaactcacaattgttcagtatggaacttttttctgtccagggggaagggtttcttttactgatggatttgttggagttatttatatattctggatatgaatccacttgccaggtataggtactgagtatatcttctcctctctgcttggcttcactctcttttattgatgtcatttgataatcagaagctcctcattttaatgacatccaacttatcagtcttctcccttagagttagtgctttctgtgtcttctttaagaaatgtatggctaccccaaagttataaagatattctatgctatcttgtagatgaagttttgttttaattttcacatttagattgatgatcgctttggaatttatttttgtatatgatcaagattcatttctttcctgtggatatccagttgaaccagcactgtttattaaaataaccatccattccccactgcccagcagtgccttcttcatcataaatcaggtgtccagatacatataggtctgtttctgagctccctgttccatttctttggtagaaataagacaaacaaataggtctgctattacggtgtagatcactaattgtaaatctggtcattttaacatgtttacaagtaaggtttaggaaaatacactgaggggccaattgtgagaagccagcttgatgtggacatgcatagtctgagaagagaactccagcctgggcttctgagaatgaataggatgagcaagaactggtaaagaaatagcatcactagctaaggaaggggacagcaagaagaaaagcacagaaaaataaaaatcagccttatttttttgtggagagcaacatagtgattaagagtacagactcacacagtttaggagacagcttgcatccaaatcccctaatactatttagctgtgtcaccttgggcaagttaccttggcctttctggcctcagtttcctaatcagcaaaatgggggtaatcttcctcattgagctataagattaaatgggttaactaatgcatatcttttagtacagagcttaccactgcaagcattcattcaaaaaatgctgtgtgctatcatcatcattagtgacaccatggagaacagctggactgtcagagcaatcttgccattcaaccaacatttatagagtacttaactaccaaacaaaaatattacatttagtggttaaaaactctaactctaaaatgagatagatttgaatctgaattctagtgcagcctcttgactaattatataaacttgaacaacttacttaacctttctaagtttctagtttcagcttcatctatacttcattgggattttcttggagaggatgtgagatacagaagtaatgcagcacaaggcccaacacagaataagtgctcaattaatcccagctatcactatgatgatgagaatgacaacaatggtgacataaagattttgcatttggtataagaaaaagcctaccaacacctcaaaagacttagaatacctagcattctcagatcttccatccaagtactaaccagacacaaccatacctagcttcatattgacgagataagtagacaagatcaagtgtgttcaagtggtaggcccaagacagataaggagcttagagaaaaaaaggttgcagaagccaagtaaaagctaaattactgggatagttcaacacctggtaaggaagagatgaatttctaacatcaagcaacttcaagaagaaacaaaaatacagaaatctaagtatatataatcacaaaaagtatgagaatgtgctcgatgttggggtggggacagaaatggtactcatagagtagaagtctgatggcattcatggggaaaaggctcctaaggagcagtgccattaatagttgcagaccaacagcagtgatcatggtgtggtcagacctcagccatgaagaccacactgtgccagtctcctggaggaactaccccagagccactgaggagctttcccccaacccaagagaccatgacacttccacccatgtcactgagctgaagcgaaacaaggcccagcagtgacaacgaacactccaaggacacaatgcagtgccaggtgccaagtgaaaatccgagaggcaagggctggggacagcctgtgctggagggtaggttctggcagaggtgaaatgcagacacacactcagaatgccgccacagacagggagccggagccaggcggcagagagtgagtgacctggcagacgctggccaagaacacagggctccccgaccctcagggtaaaggaagacaagcaaaggccaagttgagtgctgaattcacagcacaaatggaagtgaaccccagcaccaacagggactcccgtgtgaaatacgcccaagggctgcacagagaggggcatgtttgcatgggggaaggtcaggcctgcaacagcagatattgtgactaggatgctctgtttgtaagtagatgctttttcctggacagacacagtcagtctgtctctcaggccagaaatccaggctccaaaatgtcctgcccaagctggctcccatcacctcttgggaaagtgaaacaggccaaaacatctatcttgtcttaggccgctaatcattaaatctaagctcccaccccagagggctcacaactcagccataagcaaaacccagactggcaatagcactggcacctgctatcctgactatgggctggggctgagtgaatgtggccactctgctaaccactggtcacagctcctgctgcctaaaatacaggaggacaaagtcttcttgggactgagggagtaacccaatgtgcctcttggctggctgctcaaaatcttggccctgccaatggatggaaataatttccagagagacagagtgtggttgggccatgtgagagggacttgaggagaacattactccattcctcaacagcggaacctgtagcctgtgccaggccagacatggccgggattgaggggtcttggccagactccctccaggcacaggttggtgccctcagacgctgctgctgctcttgtgggcaggaggagatgtctctagggtaggaagaacctaggcctctgatgatttatgggtctgtgctgacctctgtgtgaccacatgggtttagcaccatgtgacttaaaaatggagtcgctttcctgcctcacaacaaacttctgctctacttaactgagtcagatctagacagcaggaatcataaacacaagtggggcaggggattccccaaacacttctgacttgaactttcatttccatactgccttatcccccaagcaggggcacgtccgtacctgcagcctaggacagaggagaaaagagaccagggccattatgcatggcctgggtgcaggtccgagctttcagcaaagtgccagctttgccaggagcagggacaaaacttccagggccgagactctcattcaggggtgggagaggagctggggactgtctaaaacataacagttaatatttgggatacgttttcataatgtgaaaccataccaaaagtaaagttccacaaaacctttgatgatgtgaatacttcctctgcactgggaggggatgttgaccagaatctttgggggtgggaggcagtcctgtggttgatttatttactgaaggtaggtgttggaattacactcttttagagggttcagctctctgaaaccccctgggaccactggacagccattattctcaggctaggatttgacataggcctccgaggccaatgttctttctccaaaagcagcacagcaacaacagctctgccttaaaagacagaagattacacttagaagatttctccaacgccacatactttggaggtgagaggagtaccccatcactctccctctgaaaacttcaaaaccttcagaggccagggtgaatatttagaaagcaggcgggtccaacagaaagaacggccattgatctattccaaaaaaataatgtgtttggggcccatgtgtcaggtacagcgcgaggcactttttaaggagctccacccttggctggcaggaactccctcggtcagcagaggctggtaaactaagaaagcaagatgctaggaggacagctggctccttaatcccaccctggccccccaaacaagacagctcaagtcttgccggccctggaggcccaggcacttggacatcacttgctctatgcctttcttgggaggcagagcttagtgggggttgaggagagatctacaggctgagtgcgctcatgacacaatcaagaagtttctggggccaggtgcggtggctcacgcctgtaattccagcactttgggaggccaaaagaagccaaggcgggcaaatcacttgaggccaggagtttaagaccagcctggctgacatggtgaaaccccatctctactaaaattacaaaagttatctgagcatggtggcacatgcctgtaatcccagctacttgggaggttgagtcatgagaatcgcttgagcctgggaggtggaggttgcagtgagccaagattgtgccattgtactccagcctgggtaacagagcgagactctgtctcaaaaaatatatatataagtttctgggtaggctgacatgaaaaaattaccactggagcttctgagagccctaaatcaccataagggtagaggaaggaagacaggaggaactgagatgctgagataagctgggatgtcccagcccacttccctagagaggccctttcctaacagccagcgggagaaccctgttcacggagccctatcactgacctcgagggcagcaccagcatccacagtcaggtcatcccgagagtcgtaaccactgttcctgccccaaacccaatgaccctctcaaccccatccaaatagcccaggatgagccacaagacagggccttagaaccctgggggtgtaagacaccctgaatgtcatctggcctcaccttccactgagacaagaagattccgccttgggttagagtccaaggtgtgggatcttgggtgagttattccatgtcttgcctaaattctctcatctataaagtagggctgataagctcatcatacctcttcacagtgttgctgtgaagattagagtctatttgagtaaagcactcagcaacagtgcctggtacccaacaagtattcagtaaggaaagttatggctactgttttcattattagcacccctgcatggtggacattcgctcatgtgtaaacactacagggcccacggaaggagctggagacctgacagggtcacccatcttctctccctcacatccttcacagcccataaagcaagacaggaatccagctcccaacaccaacgtctgcctccctgtcacagctacccactggccccagggctgccccctgaggtaccacagggtaactctgacacccacatcacctgacagtgctttaagcacacaatactgtacctagcaaaccccctctcaccaaaatctctacctctctgggccacgcagtctcatgtttttaaccactcttcacgtgccagcagctctgctctgtacttcaactagtagtttgacattttccctcctaattgagatcaggaactggagcggccctccaaaagtggcctgagaaggccaaagggcagccggctctgatctcccagagaaccttcttcctcccttaggagtcctcactccctgtcttgcttaatcttcccctgcccctcaactcccaacccagccctcccatacacacaataattaaaaccttgctatgtgccttcttcagaccctctcagtcttgagcttaggaatctgccaataagcctttgttgaattatttctgtatgacacacactaagccatttcacatatattatctccattaatctgctcaatttcccttagctgggaatcaatcccaatgctcacctgctcctttttcgagagttagctggatagattctttccacgtggccaaactccagcaaggagaaggtgctttgatactcttgatgttggacaagagtctgagacccatggactctactagactaagcaatatgtctacctgtatccttcactctttcccagatgagatagacagcaatcctgcaggccccacgtttgccatgattgttcttccttctccagatgccaacagtttaaccccttgttacaatttagagccaagataataggctgtcatgtctcatgtcacacgtggctcatctgtagcctccaattagagtctgaacttttcaaagaaagggtccaggcaagcttcaaaattcttttttcattcttgccaaagcgatacttctagcagcactcaatcaatacttgctgattgcctgattggactagattaggcctgtcaacatgacaacccctaaatccccaacaaacacactggaaatgggctcacttgatgtgaatcccttccctgcccacccacacaggtcctctgaggtttctcctactctctccttcctttgatctaaatgtatcaaacaagaatgtgctcttctaactgcagcttctggaaagggtccccaagcaaatatcaaagggacactcaacctgtagtgtcacaaacaccagcaatcacctcacccctctgcctgacggatgccaaggacagctggctctggactaaaaacagtgcaaccccaaatctgagccctggggatcttttatgtgttttccttttccctgtgaccccatgtgaggctgagaacaaaggagacagaaatcagctgtcctcatcacacaggtgggaaggccactgtcagacccaccctctcccagggaatcaaagaccagagactctaatggttccccatggctaccaactgtaaatttcaactaagagtagaaagtggccttacctgatacggtaacagaagaagaaaggaaaggagcagaggagtgccacccagggccctaggaggtaggtggagaggtggagctttgcatgccttcaagtgcctcctgcggtgggctaaaactcttactgttattaagaacatacagcaaccaaggaaaagagggggacaaaccctctactttatggcctagatccaggcatttcacagattctgatgcgctccagacagaagctcagggtccttttgagacatgaagagtcttgactgcacaagagaagaccaaaagttctttggagatggttctaggtccccactttagttaattaacaagcttttaccaagtacctcctaattcttctaagtacttccaacacctacgacacagccaggcacacagtgtggatgctgctactgaatccaggacaggagggaaaagagaatcaaaattaaatataagatacggttcataaccaaaggcgttcctgaaatagcttccagagctaacatgatttgggaacagttataaaacagcctcactgctaggaagcttctcgtgggcctggactgcgtcttacagccctttaagccaccacatggtgcacatccatgtccagtaaccatccactgggcaaacaggccgatgaacacaggaaggaaacacagcacaacttccgtg

SEQ ID NO: 524 - DNA, 23518 bp, Homo sapiens
agacagatgctaggctctagaaaagcatgagttctagtctaacaaaagttattagagggaactcaggagaatgggcagatatggagtcaccagtaacttccctgatggagaacgccatagaatggggtaaagaaagtgcctatgtagaaatttcttttgcaagagtcagccagaggaaatcactaaatgccaagggtagaagacagactaacctcctctttgaacataaataaaaattgagaaagccatttaaaggatgtaaggacggcttagcccaacctgctagtggccatccccacttcctgcctcctccctgagtactggctctgcagtcctcctactgctacttggcttttggctggggcagatgctgccggaactttcccttggcaggtgggaggctggggagatgagaaggtggaccccatgccaggctcaagagaaatctggccacactgacaaggccacccacccacataggagtcctgaaaaagatgagagggatggcagggcaggcactgttcctgagcaccatttactgtgtgctgaaggtgaaaatgccacctcttctcctcctcgccacaaagtccatgaggtcggccttatgatcctcacagtgtagaggggctagctaggagcatgctcaaggtcccagcctagcaagcgcgaagcctcacatctaggtatgtctgggatcaggcccacgctctttccaccacactgtgttgcgtctctgtcatctgggaagttatgaatggtctcatgctttctgagttagagctacagcaaaagtagtaatgtgcacaaaaccagtccccacctgagttccttctccagcctcaggattctttgaagggaagaagcagttcctagaactccttgaaattacactcaaaatagtgtgtgcatgatatggatttttttgacaagagcgtcgatgctttccattgggttcttaaaaaggatctatgactttaaaatggttaataacgagtgcgttgggcattattttgtctgactatctctcttgacagataaggaaatggagttctttgaactctattttctactttgagttacagtgtttattctgcaggaacagcagcacagcctgcgcagtatctgctccttccttagtgctgcggaaacttcctagtgaggccaaacagcagggtaagtggccagcacttcatttttcacaggaaaatggagagtccccaaggaagggaggcctggctccttgcccaaagtatcatgaacaatgagtatactttgtataaatcaaggccatgtgaaaagagtggatgccagaattacaataactcagaaaaatgaccctttaaaccaggtaggttttgggaaaggatgtggctacctcagacatgtgctttaaaccctgggccttggctgggcgcggtggctcatgcctgtaatcccagcactttgggaggtggaggtgggctgacctcttaagcccaggagttcgagaccagcctgggcaacatggcaaaactgcgtctctacaaaaaatacaaaaattagccaggtgtggtggtgtgtgcctgtagtctcagctacttgagaggctgagtaggaaagactgctgaaacccaggaggttgaggctacagtgagtcctgatcacgcctctgtactccatcttagctgacactgagaccccgtctcaaaaataaataaataaaaataaaccctggacccagtaacttttaagccttttaaaacgaaaaatttgggttaagagaagatggggctttggctgaaaagagtcatccaggggggttcctcaaagacctgtgactctaataggcaaataaccaatcctttttcctgcccctcaggggtgtcttagtaacttcctggaggcaaactgtgaatgtagaagacagggtgctctcaaggacaaagaggcagaagtccccactgtacctcggtgtgcctgctgggcacgtgcccactgggcaagagcaagggcactactgggtctttgcaaggcaaatgacggcaaggcaacttgcctttggtggtgggctgatggggagacttccatttgatgatggagaagctactgggcaagttcattttctgagattttaatatgaagtactttgtaatcgggcatgaaaagcatagaagcagtccataaaatcacgtgagtgaataatacagttccatgtgaagtttctaattgaaacattgtcttactgttacggtttaagaaacatgtttgaaactaagaatgtgctcacccatgatagaagcattaaaaacaaggggaggggtgaagtgcaatcagacctaaatgcgtaaatgcaaccccagagagcctccctaaaaacctaatacgttcccagagaacttccctcagaacctaacgcgttcccagagaacttccctcagaacctcaatgcgttcccagagaatgtccctcagaacctaatgtgttcccagagaatctccctcagaacctaatgcgttcccagagaaccttcctcagaacctcaatgcattcccagagaacttccctcagaacctaatgcattcccagagaaattccctcaggatctaatgtgttccagggaacctccctcagaacctcaatgcgttcccagagaacctcccccagaatctaatgctttcccagagaacctccctcaggacctagtgcgtcccagagaccttccctcagaacctaatgcggtcccagaagacttccctcaggacctaatgcgttcctagaaaactctcagaacctaatgcgttcccagagaacttccctcagaacctaatgcattcgcagcgaacctccctgagaccctaatgcgttcccagagaaattcccttaggacctaaatgtgttcccagagaacttcactcagaacctaatgcattcgcagagaacctccctcagaacctaatgcgttcccagaaaacctccctcacaacctaacgcgttctcagagaacttcactcaggaccaaatgagttccgaaaaaccaccccagaacctcaatgtgttcccagagaacctccctcagaacctaatgagtttccaaagaacctccctcagaacctaatgtgttcacagagaacctccctcaaacctaaatggttcccagagaacctctctcagaacctaatgtgttcccagacaatctgcctcataacctaatgcgttctcagataacttccctgagaacctcaatgcattcccaaagaacttccctcagaacctaacgctttcccagacaacctccctcaggacctaatgcattcccagagaatctccctcagaacctaatgcattgccagagaacctccctcagaacctcaatgcattcccagaaaacatacctcagaacctaatgcattcccagagaatctccctcagcacctaatgtgttcccagagaacctccctcaggagctaatgcattcccacagaacctcctccagcacctaatgcgttcccagagaacctcccacagacctcaatgcattcccagagaacttcccacagaacctaatgtggtcccaaagatcctccctcagaatctaatgcgttcccagaaaaatttcttcagaacctaatgcattcccagagaacctccctcaggacctccatgcgttcccacagaacctccctcagaacccaatacgtgcccagagaacctccctcagaacctcagtgcatttccagagaacctccctcagaacccaatatgtgcccagagaacctccctcagaacctcagtgcattcccagagaacctccctcagaacctaaagcgttcacagagaacctccctcagaacctaatgcgttcccagaaaacctccctcagaacctcaatgctttcctagagaacctccctcagaacctcaatgacttagcagagaacctccctcaggacctcaatgcattcccagaaacctcgctcaggatctagtgcgttcccagagaacctctcagagaacctaaagcattcccagagaacctccctcagaacctaatgtgttcccaaagaacttccctcagacctaatgctttcccagaaaacctccttcagaacctaatgcatttccagagaacttccctcaggacgtcaatgcgttcccagagaacctccctcagaacctaatctttcccagagaacctctgtcagaactcagtgagttcccagagaacctccctcagaaccacaatgcattcctagagaatctcccacagaacctcaatgagttaccacagaacctccctcaggacctcaatgcgttcccagagaacatccctccaaacctaatgcgttaccacagagcctccctcagaacctaatgcgttcccagagaacccccaacagaatctcagtgcattaccagaaaacctccgtcaggacctaatgcggtcccagagaacatccctcagaacctaatgcgttcccagagatcctccctcagaatctaatacgttcgcagagaaactccctcagaacctaatgcattcccaaagaacttcctttaggacctcaatgcgttcccagagaatctccctcacaaagtaatgcatttcgaggcaacctccctcagaacctcagtgcattaccagagaaccttcctaagcacgtaattcattcccagagaacttcccccagaacctaatgcgttcccagagatcctccctcagaatttaatgcgttcccagagaaattccctcagaacctaatgcattcccagagaacctccctcagaatctcagtgcattaccagagaaccaccctcaggacctaatgtggtcccagagaacatccctcagaacctaatgcgttcccaaagatcctccctcaggacctaatgcgttcccaaagatcctccttcagaatctaacacactcacagagaaattccctcagaacataatgcgttcccaaagaacttcccttaggacctcaatgcgttttcagagaacctccctcagaacctaatgcgttcccaggcaacctccctcagaacctcactgcattaccagaaaaccttcctaagcaggtaattctttcccagagaaattccctcagaacctaatgcgttcccaaagaatctccctcagaatctaatgcattcctagagaacatccctcagaacctgatgcgttcccagagatcctccctcagaatttaatgcgttcccagagaaattctctcagaacctaatgcgttcccagagatgctccctcagaatttaatgcgttcccagagaaattctctcagaacctaatgcgttcctagagaacctccctcagaacctcagtgcgtttccagagaagctccctcagaacgtaatgcattcccagacaacttccctcagaacctaattccttcccagagaacctctctcagaacctaatgcattcctagagaacttccctcagaacctaatgcgttcccagagatcctccctcagaatttaatgcgttcccagagaaattccctcagaacctcagtgcgttcccagagaacctccctcagaacctcagtgcgtttccagagaagctccctcagaagccaatgcattcccagacaacttccctgagaacctaattccttcccagagaacctccctcagaacctcagtcaattaccagagaacctccctcagaacctaatgcgatcccagagaacatccctcagaacctaatgcgttcctagagaacccccaacagaatctcagtgcattaccagaaaacctcccgcaggacctaatgcggtcccagagaacatccctcagaacctaatgcgttcccagagaacctccctcagaatggaatgcgtttgtagagaacttccttcagaacctaaggcgttcccaaagatcctccctcagaacctaatgcgttcccagagaacccccaacagaatctcagtgggttaccagaaaacctccctcaggacctaatgcggtcccagagaacctccctcagaacctcagtgcattaccagagaaccttcctcaggacctaatgcggtcccagagaacatccctcagaacctaatgcgttcccagagaacctccctcagaacctaatgcgttcccagagaatctccctcagaacctaatgcgttcccagagaacctccctcagaacctaatgcgttcccagagaacctccctcagaacctaatgtattcctagagaacttccctcagaacctaatgcgttcccagagatcctccctcagaatttaatgcgttcccagagaaattccctcagaacctaatgccttcccagagaacctccctcagaatctcagtgcattaccggagaaccaccctcaggacctaatgtggtcccagagaacatccctcagaacctaatgcgttcccacagaacttccctcagaacctcagtgcgtttccagagaacctccctcacaatctcagtgcattcccagagaacttccctcaggacctcaatgtgttctcagagatcctccctcatgacctaatgtgttcccagagaacctccctcagaacctaatgcattccgagagaacttccctcagaacctaattccttcccagagaacctccctcagaacctcagtgcattaccagagaaccaccctcaggacctaatgcgttctcagagaacctccctcagaacctaattccttcccagagaacctccgtcagaacctgagtgcattaacagagaaccaccctcaggacctaatgcgttcccagggaacctccctcataacctaattccttgccagagaacctccctcagaacctcagtgcattaccagagaaccaccgtcaggacctaatgtggtcccagagaacatccctcagaatctaatgcattcccagagaacccccaacagaatctcagtgggttaccagaaaacctccctcaggacctaatgcggtcccagagaacctccctcagaacctcagtgcattaccagaaaacctccctcaggacctaatgcggtcccagagaacatccctcagaacctaatgcgttcccagagaacctccctcagaacctaatgtgttcccagagaacctccctcagaacctaattccttcccagagaagctccctcaaaacctaatgcattcccagacaacttccctcagaaactaatgcgttcccagagatcctccctcagaatttaatgcgttcccagagaaattccctcagaacctaatgcgttcccagagaacctccctcagaacctcagtgcgtttccagagaacctccctcacaatctcagtgaattcccagagaacttccctcaggacctcaatctgttcccagagatcctccctcaggacctaaggtgttcccagagatcctccctcagaacctaatgcgttcccagagaacctccctcagaacctaatgcattcccagagaacttccctcagaacctaattccttcccagagaacctccctcagaacctcagtgcattgccagagaacctccctcaggacctaatgtgttcccagggaacctccctcagaacctaatgtgttcccagagaacctccctcaggacagaatgcgttcctagagaacttccctcagaacctaatgcgttcccagagatcctccctcagaatctaatgcgttcgcagagaaattccctcagaacctgatgcattaccagagaacttcccttaggacctcaatgcgttcccagagaacctccctcagaacctaatgcattccaagagaacctccctcagaacctaatgcattccaagagaacctccctcagaacctcaacgcattcgcagagatcaagacctctacgcgttcccagagaccctccctcaagacctaatgggtacccagagaacctcccacagaacctaatgcgttcccagataacctccctcagaacttaatgcattcccagagaccttccctcacaacctaatgcgttcccacaggacttcactcaagacctaatgtgttcccagagaacttccctcaggacctaatgcattcccagagaacctccctcaggacctaatgcgtttccagagaacctcccttaaaagctagtgcgttcgcagagaacctccctcagaacctaatgcattcccacagatcttcactcaggacctgatgcgttcccagagaacttccctcaggatctcaattcgtttccagagaacctccctcaggacctcaatgcgttcccagagaacccctctcagaacctaatgggttcccagagaacttccctaagaacctaattcgttcccagagaacctccctgagaaccctgaggtcacagaggaccttcctcagaacctaatgcattcccagagaacttccctcaaaacctaatgcattccctgagaatctccctcagaacataatgcgttcccaaagaagctcccacacaacctactgcgttcccagagaacctccctcagaacctgaatgcattcccagagaacttccctcagaacctaaggcattcccagagaacttccctcagaacctaatgcgttcccagagaacctccctaaggacgtaatgcattcacagaggacttccctcagaacctaatgcatccccggaaaaccttcctcagaacctaatgcgttcctagagaactttcctcagaacttaaatgcgttcccagagatcctccctcagaatctaatgcgttcccacagaaattccctcagaacctactgcgttcccagagaacttcccttaggacctcaatgcgttcccagagaacctccctcagaacctcagtacattcgcagacaacctcccttggaacctcagtgcattcccagataacctccctgaggacctcaatgtgttcccagagaccctccctcagaacctaatgtgttcccagagaacctccttcagaacctaatgcgttcccagagaacctccctcagaatctaatgcattcccagagaacctccctcagaacctcagtgcaatcccagagaacctgccttcaaacctaatgcgttcccagaaaacatccctcaggaactaatgagttccaggagaacttccctcagaacctaatgtgttcccagagaacctccctcagaacctaatgcatcccagagaacatcactcagaacctaatgtgttcccagagaacctccctcagaacctcagtgcattctgagaacctccctcaaaacctcagtgtgttcccagagaacctccctgaggacctaatgcattcccagagaacctccctcagaacccaatgtgtccccagagaacctccctcacaacccagtgcgttcccagagaacctccctcaggacctcaatgcgttcccacagaacttccctcatcatctaatgcattcccaaagaacctccctcagaacctagtgcattcccagagaacatcactcaggacccaatgtgttcccagagaacctccacagaagctcaatgcgttcccagagaacctccttcagacgctaatgtgttcccagggaacttccctcagaacctcaacgcagtcccagagaaactccctcagaccctaacgtgttcccagagaacctcccttagaacccaatgcgttcccagagaacctccctcagaacctaatgcgttccgagataacctccctcagaatctcaatgcgttcccagagaacttctcttagaacctaatgcgtttccagagaacctccctcagaatctccatgcattctcagaggacttccctcagaacctaatgtgttcccagagaacttccctcaggacctaatgcgttcccagagaacttccctcaggacctaatgcgttcccagagaacctccctcaggacctaatgtgtttccagagaacctcccttagaacctaatgcgttcctagagaacttccctcagaatctaaagtgttcccagagaacctccctcagaacctcagtgcattagcagagaacctccctcagaacctaatgcgttcccacagaacttccctcacaacctaatgcgttcccaaagaacttccctcaggacctcaatgcgttcccagagaatctccctcagaacctaatgcgttcccaaagaacttccctcagaacctaatatgttcccagagaacctccctcagaacctcagtgagttcccagagaacctccttcggaacctcagtgcattcccagagaacctccctcagaacctcagtgtgttcccagagaacctccctgaggacataatgcattcccacagaacctccctcagaacctcaatgcgttcccagagaccttccctcacgacctaatgcgttcccagagaacttcccccaggacctaatgcattcccagagacctctctcagaacctcaatgcgttcccagagaaccttcctcaggacctaatgcgttcccagagaacctccctcagaacttcaatacattcccagagaactttcctcagaacctaatgcgttcccagggaacttccatcagaacctaatgcattcccagataacctccctcagaacctgaatgcgttcccaaagaacctccctcagaacctaatgtgttcccggagaacctcactcaggacctcaatgcgttcccagagaactcccttctgaaccaaatgcgttcccagagaatctccctcagaacctaatgggttcccatagaacctccctcagaatctaatgtgttcccagagaacttccctcaggacctcaatgcattcccagagaacctccttcagaacctcaatgcgttcccagagaacttccctcagaacctcaatgcgttcccagagaacctccatcaggacctcatgcgttcccagggaacctccctcagaacctcaatgcattcccagagaacttccctcagtacctaatgcgttcccagggaacctccctcaggacctaatatgttcccagataacttccctcagtacctaatgcattccccaagaagctccctcagaacccaatgtgtttccagagatcttccctcagaacctcagtgtgttcctgaagaacttccctcaggactttcctgcagccgctgttgctctccccatgggagccaccttctggtcccttccgagtgcgttctttagactgtgaggcttcctctgggagcccaggccagtctgtctccagtcatctcgttacaatcatcttgacctttccaaaacctgccttccaacgtggaagggcttggctgcggacaaggacgcagggatgaggaggagtcttcctccttttctaatgccccctcacgcacacaacggacactggagcacgaacacagtcttcggctgttagtttggaagtctttgggatttttttaaaaacagggtgggagggaagaaacctggccgcagtgagatgctttataaaaatatttggaggctacaagtttgtgaaaagcatatagtatattttgtttgcttttcttttctttttttcttttgagacgaagtctctgtcaccaagctgggtggcatagtgacggctaattgcagcctctgcctcctgggctccagtgattttcccacctcagcctctcgagtagctgggactacaggtgtgcatcaccacacctgactagtttttttaaaaaaattatttataaagatgaggtttcagcatgttgcccaggctggtcttgaatcctgggctcaagagctcctcctaccttggcctcccaaagtgctgggattacaggtgtgacccactgtacctggccacgtgaaaagcatatactgtattatatagatgatccataaaataaaatcagaatccatgagttcatactgatatataaacaaataggggagagggaaaattcttccatatagtagaactccaattagtaaatgtagaagaaatgatgaaaatagacaatcgacatttggcaaatgccacagaaacaacgcttccgtcaggaatcaatcaagggatgcgaaatgagtgggcaaaagtttgatgagagcaggatatttacaaagtatcatcccataagatacttattaattaccaggagaaaaatagtaacttcacattgaagacagttggcaggtaccacctaaagcaagtaatcgaagtccccaataatgggacaaatcaatgtgatgtgcctcttgacacaatgcactggggatacaatgccacttttatggtgttcttgcccaaaattgatttcatcaagaaaaaacaaacaaaaactgaggacattgtacaaaatacctggccagtacacactgaggtcgtgaaagacaaagaaaacttgaggaatggctgggcaaggtggctcatgcctgtaattccagcactttgggaggctcaagtgggtggatcatttgagcccaggagttccagaccagcctgggcaacacagggagacagaatctctactaaaaatagagggtggcatgtgcctgtggtcccagctacttgggagactgcagtgggaggattgcttgagcccaggagatggaggatgcagtaagtcataatctcaccactgcaccccagcctgggggacagcgtgagactctgtctcaaaaaaggaggggaggggagggaataaaaagatgaggaactactcaagattaaaggagaccaagatcaaagagatctgacaacgaaatgcatgattattgggtcctggaccagaaaaaggggcattaatgggacagtattaccttctcgattttggtaactctggttgttatgtaagatgttaacattctctgaggagggcatgtgaaaattttttgtcctatttttgtaacttttttataagtctaaattatttcaaaataaaaggataaattatacttgaaaacatatatattagagactaggctttcttccaatacccagtgcctgacactgtaaagctttgtgggctgatatatgtcagggctcaacacccacataggaagggatcccaatgtagggatccactggggaccttattaggggcaaactcaggctctgagatttatagacacaattaatgataacattcaaaagatgtaaaaatacccctaatgggtttctagggagggtcacaggcatgccacaaccatctttcagccccggaaggagctgtgcgctcctaagacccagtcatgaccagagcggcgagaaatgcaggcagaaaacagcgaatgttcctcactcacttgtcttgggattcgatatacacgtagagatgaggctcaaaacacttggaaacaatgccatgaaatggattgtctggggctttaggcttctttggctgtaaaaacaaagaaaaataaaccccatacttgagtgatctttgcaaatgttcaagaatttttttaaaaacatcatttcaaagttcattcctaagtcacagataagagagtactcaatgtaacccaatacgatggtttcaccattcaccctggcaggtgaagaaaaaccagctttgttagcataactcacttgctctggacgatgaaagacatactgctacctggataacatatgtgttttgaatctggaagcaagtcatcatctatctgactggtgttttccagaatttaaatcccagctaataatagcaccttgtatttacacagtgctttagaatttaaaaagtgctttcacacaatccaatttttgatagcactttgataccaactaatatgtcacctgctcctcacaataatccttcatgtaggtatgactactactattttacacctcaagaaatgaggactcagaggttctctaacctgccccaacacatatgtagacgtctgcttttcttaaactagaactctttctgttataccattattttcctgcaatggttcccagaattttttgaattccatcagtaagaaaatgtaagaaaaagaagaatggacaaccaatagaggattgttaactttattttgctactttctattcttaccacgagttcctaaaaaaaaaacaaataaagggtttttttgtttgctttttgagacagagtctccctctgtcacccaggctaaagtgcagtggcgccatctcagctcactgcaacctgcaccttctggactcaagtgattcttgtgtctcagcctcctaagtagctgggactataggcacacgccaccacaccgagctaatttttgtattttaagtagaggtggggttttgccatgttggccaggctagtctcgaactcttggcctcaagtgatccacccacctctacctcccaaagtgctgggcttataggcatgaggcatggcgcccagccagaaaattgtattttatacccccaaattttataagaataaaatagcagcatataggcagtactttctaagaaaggacagttggtaaccttacatcagatagatagagagagagacaggcaggcaggcaggcagactatattgtctttattttttgctttaggccactgcaacactagatgagcgctggttcccaggctgttacttggaagccactgataaagaagtcatatgacaggcaagtattttaaaacaatatttgccacttaattcctttccaaacatctaaaaaataagcaaagattttcctatgtattacttctattcctaacaaatgtgaattctgtctattgccaaatgtctacaaaatgaccctgagccaaacacaccatgctggggttgatactaaatcataatttgcatgtaaattggcacccacaacatacttgttaaattgaactactcatatcttattttttaaaaacccactttattgaggtatgattgacattttaaaagccctacataattaatgtatacatcttgatgcgtttgaggataagtacacacccacaaagccctcaccaccatcaaggcagtaagtgtatccaccacctccccaagcctcctcccacccctgttgttacgattattattacttgtggtaagaatgcttgctgggcacggtggctcacgcctgtaatcccagcactttgggaggccaaggtgggcggatcacaaggtcaggagttcaagaccagcatggccaatatggtgaaaccctgtctctactaaaaaaatacaaaaattagcaggttgtggtggtgtgcgcctgtagtcccagctacttgagaggctgaggtagaaaaattgcttgaacccaggaggtggagatggcagtgagccgagattgcaccactgtactccagcctggcgacagagtgagactccatttcaaaaacaaacaaacaaacaaacaaaaaagaatacttaacataagatctaccctcttgaactgcttatatattttaataaatactggaagagataagccctaatgacagaaatgataactacctatttctggcctttaaaaaaatttttttttaaataacacgttgcaatggttaaaaacatctgtaaaaactgatttgtaaaaaatgatcactaaaaattaaatgtcaactttagacacatctactcaatcttgtacttaaccctcttccctttttacctttcaggagttccatgtctttcattttttggcaaggtttctagaaactttggtccttcctaagaataaatacaatctgcactgtttttactcttatcatctggaagtcactgccaaagccaggccttggactgagcccacaaccacacaagcctggctgattgagcttgaatctgccggatctagaattccacttgagtgcacagatgtcctgggagtttttctgcatttccattagtttaagatgaaggatctatgatggaggatgaggattgtgaggggtgtcctcacccacttgtcctgtttattccaagtcagtatcttttattattgattcaataagatgacttaagtgaatagaaaaatgtgatttaatttgtctaactctataggactagatatcatggattcagatttggaaaacatggctactacaaacagatatctttttattaattaaataataatgataagtattatagctattctttttatttaatttttttcttcttttgaagaaaatattcacactctgcaggataacttctggtaattatacatgtgaatttacataatacagaatgttaacatttaaaaaaatcaacgtgtatattttgctttttttttaaattttgaacatgtatattttgtattcagctttactgacttactaatttatgtgtactttcccaactactgacaatattttatcactttaaaatggctacattatgaaaatctttaaaagcctatatattatagattactgtatggatgttaaattttctgattttgatctatggtaatagaattgaatgccctttttcttaagaaatatatactaaaatatttaggggtaaaggacattatgtctacaacttacaaattgttctaaaggtcgggggggagtggggaggaaataataaagttatatagcaaaatgttaacaattgctgaatccagaagaaagatatttaggagctccttgtaacttttctcttagtttgacattattttaaaaagaaaaaaagtaaaggataacgtcagaaaacttggaaaatgggtacagtggcctggtggaaaattccagagacctcaatggagccatcttaagaatggcatattgtcccattgatctatatctcttgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctactcatgagaatggaatgttctcccatttgtttgtatcctcttttatttcactgagcagtggttcgtagttctccttgaagaggaccttcacatcccttgtaagttggattcctaggtattttattctctttgaagcaattgtgaatgggagttcactcatgatttggctctctgtttgtctgttgttggtgtataagaatgctcgtgatttttgtacattgattttgtatcctgagactttgctgaagttgcttatcagcttaaggagattttgggctgagataatggggttttctagatatacaatcatgtcgtctgcaaacagggacaatttgacttcctcttctcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagcgcttatgattttgagatacgtcccatcaatacctaatttattgagagtttttagcatgaagagttgttgaattttgtcaaaggccttttctgcatctattgagataatcatgtggtttttgtctttggttctgtttatgtgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcataaaatgagttagagaggattccctctttttctattgattggaatagtttcagaaggaatggtaccagttcctccttgtacctctggtagaatttggctgtgaatccatctggtcctggactctttttcgttggtaagctattgattattgccacaatttcagctcctgttattggtctattcagagattcaacttcttcctggtttagttttgggagagtgtatgtgtcgaggaatttatccatttcttctagattttctggtttatttgcatagaggtgtttgtagtattctctgatggtagtttgtatttctgtgggatcggtggtgatatcccctttgtcattttttattgcatctatttgattcttctctctttttttctttattagtcttgctagcagtctatcaattttgttgatcctttcaaaaaaccagctcctggatttgttaattttttgaagggttttttgtgtctctatttccttcagttctgctctgattttcgttatttcttgccttctgctagcttttgaatgtgtttgctcttgcttttctagttcttttaattgtgatgttagggtgtcaattttggatctttcctgctttctcttgtgggcatttagtgctacaaatttccctctacacactgctttgaatgtgtcccagagattctggtatgttgcgtctttgttctcgttggtttcaaagaacatctttatttctgccttcatttcgttatgtacccagtagtcattcaggagcaggttgttcagtttccatgtagttgagcggttttgagtgagattcttaatccagagttctagtttgattgcactgtggtctgagagatagtttgttataatttcttttacatttgctgaggagagctttacttccaactatgtggtcaattttggaatagatgtggtgtggtgctgaaaaaaatgtatattctgttgatttggggtggagagttgatttggggtggagagttctgtagatgtctattaggtccgcttggtgcagagctgagttccattcctgagtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgaattgatccctttaccattaagtaatggccttctttgtctcttttgatctttgttggtttaaagtctgttttatgagagactaggattgcaacccctgcctttttttgttttccatttgcttggtagatcttcctccatcctttcattttgagcctatgtggtgtctctgcccgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcgtagtcttgatggtctttacattttggcatgattttgcagtggctggtaccggttgttcctttccatgtttagcgcttccttcaggagctcttttagggcaggtctggtggtgacaaaatctctcagcagttgcctgtctgtgaagtattttatttctccttcacttatgaagcttagtttggctggatatcaaattctgggttgaaaattcttttaagaatgttgaatattggccaccactctcttctggcttgtagagtttctgccgagagatctgctgttagtctgatgggcttccctttgaggataacccgacctttctctctggctgcccctgacattttttccttcatttcaaccttggtgaatctgacaattatgtgtcttggtgttgctcttctcgaggagtatctttgtggcgttctctgtatttcctgaatctgaatgttggcctgccttgctagattggggaagttctcctggatagatcaatggaacagaacagagccctcagaaataatgccgcatatctacaactatctgatctttgacaaacctgagaaaaacaagaaatggggaaaggattccctatttaataaatggtgctgggaaaactggctagccatatgtagaaagctgaaactggatcccttccttacactttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgaccaatgggatctaattaaactaaagagcttctgcacagcaaaagaaactaccatcagagtgaacaggcaactacaaaatgggagaaaattttcgcaacctactcatctgacaaagggctaatatccagaatctacaatgaactcaaacaaatttacaagaaaaaaacaaacagccccatcaaaaagtgggcaaaggacatgaacagacacttctcaaaagaagacatttatgcagccaaaaaacacatgaaaaaatgctcaccatcactggccatcagagaaatgcaaatcaaaaccacgatgagataccatttcacaccagttagaatggcgatcattaaaaagtcaggaaacaaccggtgctggagaggatgtggagaaacaggaacacttttacactgttggtgggactgtaaactagttcaaccattgtggaagtcagtgtggcgattcctcagggatctagaactagaaataccatttgacccagcaatcccattactgggtatatacccaaaggactataaatcatgctgctataaagacacatgcacacgtatgtttattgcagcattattcacgatagcaaagacttggaaccaacccaaatgtccaacaatgatagactggattaagaaaatgtggcacatatacaccatggaatactacacagccataaaaaatgatgagttcgcgtcctttgtagggacatggatgaaattggaaatcatcattctcagtaaactatcgcaagaacaaaaaaccaaacaccgcatattctcactcacaggtgggaattgaacaatgagaacacaaggacacaggaaggggaacatcacactctggggactgttgtggggtgggaggaggggggagggatagcactgggagatatacctaatgccctaatgctagctgacgagtttgtgggtgcagcgcaccagcatggcacatgtatacatatgtaactaacctgcacattgtgcacatgtaccctaaaacttaaagtataataataaataaataaataaagaatggcacattgtcaacaccgcatgggctggagggcaacactgtgtgggaggcaaaggcactcctgcctcagcgaaataggggtgtggatcaatttcctggtttgatgatgcactctagtgccccccctggaggaagctgggagatgggaaggggtctggatcaatttcctggtttaatgatgcactctagtgtcccccctggaggaagctgggagatgggaaggggtctggatcaatttcctcgtttgatgatgcactctagtgccccgccctggaggaagctgggagatgggaaggggtctggatcaatttcctgatttgatgatgcactctagtgtccccctggaggaagctgggagatgggaaggggtctggatcaatttcctggtttgatgatgcactctagtgtcccccctggaggaagctgggagatgggaaggggtctggatcaatttcctggtttgatgatgcactctagtgccctgccctcgaggaagctgggagatgggaaggggtctggatcaatttcctgatttgatgatgcactctagtgtccccctggaggaagctgggagatgggaaggggtctggatcaatttcctggtttgatgatgcactctagtgccccaccctggaggaagctgggagatgggaaggggtctggatcaatttcctggtttgatgatgcactctagtgtccccctggaggaagctgggagatgggaaggggtctggatcaatttcctcgtttgatgatgcactctagtgtccccctggaggaagctgggagatgggaaggggtctggaccaatttcctcgtttgatgatgcactctagtgtccccctggaggaagctgggagatgggaaggggtctggatcaatttcctcgtttgatgatgcactctagtgccctgccctggaggaagctgggagatgggaaggggtctggatcaatttcctgatttgatgatgcactctagtgtccccctggaggaagctgggagatgggaaggggtctggatcaatttcctggtttgatgatgcactctagtgtcccccctggaggaagctgggagatgggaaggggtctggatcaatttcctggtttgatgatgcactctagtgccctgccctcgaggaagctgggagatgggaaggggtctggatcaatttcctgatttgatgatgcactctagtgcccccccggaggaagctgggagatgggaaggggtctggatcaatttcctggtttgatgatgcactctagtgtcccccctggaggaagctgggagatgggaaggggtctggatcaatttcctggtttgatgatgcactctagtgccccccctggaggaagctgggagatgggaaggggtctggatcaatttcctggtttgatgatgcactctagtgtccccctggaggaagctgggagatgggaaggggtctggatcaatttcctgatttgatgatgcactctagtgtccccctggaggaagctgggagatgggaaggggtctggatcaatttcctcgtttgatgatgcactctagtgtccccctggaggaagctgggagatgggaaggggtctggatcaatttcctcgtttgatgatgcactctagtgtccccctggaggaagctgggagatgggaaggggtctggatcaatttcctggtttgatgatggactctactatgttagctgtcccctggaggacgctgggagatcagtacactgtacctcgctgtactaggtttataatttatgagcccataattatttcaaaatataaagttttttaaaaagtggttcagaagatgtggacctgcatgtgaagaagttttagaaatatctttatttattttgcctatagtttcctttttatgtatgcacaaaagtgatatatgatttgaaagaaactatgttggagtaagtgtgaagagctcatctcttaggtataaaatacagattccaagtgagtaaagaaaatggctacataattccaacgaactcatcttgttcagtctgccacaggccctgcccttgatgacgtcccacaggtcctgcccttgatgaggccccacaggacactcagaaagctgcatgaccaggcagtgccagggttccacctctatctgcagatgacgctgccctgccctgccctccccaccaacagcactcttctgcagtgaggagggacccttgaccctgccaccacagcacccgggtcctcttgcagcacttctagtgagctg

SEQ ID NO: 525 - DNA, 23569 bp, Homo sapiens
ttggaagcaaggatcataatggctagttcacagaaatttgtttcttgactatatgttccctcatctgcttccaagaaggcttggagggagtgtcccacagaagggaccctgagagccaggacctctgtgccccatggtgagcaagcgccacctcctgccatactcaccgttctgtgcccctctcctttctggtttaagtaggctcggatagtggccagtccagcatattctccctgggctccgcttgcaaagacaagaagaaagggatcacggttaggtcttctggctttcatttactcattcaatatttattgggccctggccaggggttcaccagcacgtgacacatggtcactgtccagacgctgagagaagctcatcaaggagctctgctggagtcaaaaggtcttgaacaatcaaaacaatcaaagcaacagcatccagtttgtgcactacagctcaaccactcctacccaaagatggagctttctatatccttgctcaggaccacgcattgaaaatagccttttgttattatgaaaaatttcaaaactataccaaaatacagtgaagaacaaaaggaactacgacgtgtgtgtcagccagctgtaacaatttggtttacggtcaatcttgtttcctattatatttctcactaaccactttcatgctgaactatatattttgaagcaaacttcaaacatcctatcatcagttcaaatgtcaatatgcagccttcaaagataagtattgtttttaaaaatataactacaggccgggtgcaatggctcatgcctgtaatcctagcactttggggggccgatgtgggcagagcattcgagctcagaagttcaagatcagcctgggcagcatggcggaacagtgtctccactaaaagtacaaaaaattagcctggtgtgatagcatgcatctgtagtaccagctactgggcaggctgacatggaaggatcactggagtctgtgaggcggagactgcagtaagccgagatggtgccactgcactccaacctgggtgacagagtgagatcccgtctcaaaaaataaataaataactacaaacacaattgtcacacctagaacaatgaacttcagttttttcctttttttttcccttttctttccccctttaaatgggtaatgtgtcaacatcttaacaaggtttaaggaagacacacctatgaggtgaaaacaaatcatcactctataatttcttagtattaccaaatatcgagtcaagggcctgatcagccccaaaagaatgaggcacttttaatgtgacaccattcctggcagtctcaggttcggctctcccaggccccggatgcagatggctgttaggggctggccatcctcatctcaacggtcctggaaggcaccactttcagggcatatgccatgactaacattccggtgagcaatgctgactcaatcgtagactgttatttcatgttcccagtaccctgtgcaggaagggaagggaaatgagtaatagatgtatcagtcccattcaaaatgtgtatgtctgcgaagctgaaggcaaaaattaaatactaaaaaaagatacaaaaatttaaactttaaacaaatgaaaatttaaaaataaaataactttttttaatgttacccacagaaaatcggtaagaattttaaaaaatgtgtatgttctccatgccatcacccccattttgcacacaaagaaactgaggtctgagtgctacatgccaaatggccaacagtgacagatgaagacttgggtgtggagtcagcctgcctcccagagctacgggctccctttgcaagcagtgctgctcttctgagcacactgtgctctccaaggacggagagttgtgggagcaaatgctgattttctttctagcagaagtcttgtctgattgatagaactggggggtttagctaaaataaaaaataaaaaaaaaaagaaagaaaagaagaaagaaagcctgtcttacaagacctgagtcaccccgttcctcgtcacccgcactgagtcagctgcagctatctccgctctcttccaagaagaaaggcaaagactgctcttctgttttcctggcttctgaaaaacaagtcctagcctatttgaggttttttcattttgaggacaagaaaatgaatatgccgtgcttcaggaaaccactcacatcacaagtaacttcatctccctgtgcctatgtgcctgagagatgtgtaaaatggggatagtaacagtacccatcacacagggcagatgtgatgtgtagtgagatcatcaaggtcaaatgcttctcagccaaatcctgcccattcttcaactggctacaactctctgcaaagccttccctaaagccaccaatccagctctgtcacttcctcagagaggccttccctgaaggcaagaattttgtcaaccttgttcacaattgtattctctattccaagaacactgacataaaaaatatttgatagattgattaaagaaataatcctctacctcctccaaattatcatagcattttactctacaatcttatctgacattaatatcctatacatgtactggacatagaaaattattaccgatttcacatttactttgtatgcctgtcttatctcaattagagcataagctctgacagtagggtctaattctcagagttctgtatattcttcaacagggaatatatagaacagtactctgcatgtagtagttctgcaataagtatttagtaaatattttaaaaattgaattcctccagcacaggcaatcaatatgaatgtcatcctttcccctacagtaaggaacctcaagaaaaacattttatatttacccctatgtttttctcatgaattctattcatctgactttcttgaaaggccaatcaaggtgtagactaggaatgaaggaagaagcagattactggctatgagccagtagtgtaggagaaagactatatgctaaagacttgatcagaaatgctggatttctctctctctctctctctctggccttaaacatctataaaaatcagctatgtttcaacccaaaaagtgcaaatgatatattcaaatgtgacacaaggattactactggggcattagtaaaacaaattgttagtgccacctgttggtagaaaagtcttatgaaaaataattgcttatctacataacccagactaagcaaccatcaacaaactattatatatggaggacaggctaggtcagtgcttttctgacatctgtttaaaatgaagtagtgaatggtctggagctgcagggctggccagtgaacggggagcctcagaaacaccaagtttatgtgagcacagcttaaactgtcctagaaaaacaaggccctccatgccgggcgtggtggctcacacctgtaatcctaacactttgggaggccaaggtgggcggatcacctgagatcaggagttcgagaccagcctggccaacatggtgaaaccccatttctactaaacatacaaaaaattagccgggcgtggtggtgcatgcctgtaatccagactacttgggaggctgaagtgggagaatcacttgaacctgggaggtggaggttgcagtgatccgagatcacaccactgcactgcagcctgggccacagagtgagactccacctcaagaaaaaaaagaagaaaagaaaaacaagaccctccagtgtatggcatttactcaggctgattaaggagctgctgcttaatgcagaatggggaaattgagcagacaacttcttccaaaactcagattcattctacaaagaatccacaagaaattcaatagaccagaaaaagtagaacaactgaataacaggtataagagcccacaaggtgaaaacagctggagttgatggaattcaacagtattgtgatgactataacccaggccctttcagtatcagtgtatcatcacaggtgtgcaagttcaggagcaatactcaatgtaaacttaaaaaaaaaaagaatttgtagatgacatggcagagatagggtgagggtgatagttcagaagagctaaaagttcctttgccaaggttggaacgggagttcaaagaaaaaacaaattttaaagattttaaaaattaatttatctttccctttactaagaaccctagccaaacatactgagaattagaaatggatgttgtgccgggcgtggtggctcactcctgtaatcccagcactttgggaggccgaggtgggtggatcacaaggtcaggagttcgagaccagcctggataatatggtgaaaccccatctctactaaaagtacaaaaattagctgggtgtggtggtgggcacctttagtcccaggtactcagggagctgaggcgggagaattgcttgaacccgggaggcggaggttgcagcgagctgagatcgcaccactgcactctagcctgggcaacagagtgagactccatcacaaaaacaaacaaacaaaaagaaatggatgttgcagaccaggcacagtgcctcatgcctgcatgcctgtaatcacagcacgttgggaggccgaggcgagcggattacctgcagttagaagatcgagaccagcctggcgaacatggcaaaaccctgtctctactaaaaatacaaaaattagccaggtgtggtggtgtgcatctgtaatcccagctacttgggaggctgaggcaggagaatcgcttaaagcaaggaggtggaggctgcagtgatgtaagatcgcgccactgcactccagcctgggccacagagtgagactcaggctcatggccggggggattaaaaaacatcgtggctaactttatagacaccataagcaatttctcagatggtgactgctttggaatatttggacatgggtcactgtagctgcatgctttttatatatgcaaaaagtaacatgaaacccattttgcaagactgcagaatgcactaaagtaataatttatggtgaacaccagcagtcaccaaaactcccactgaatcacattgtaattatatggagaaaacagtatttgtgttctcaaatagaatgttgtatttttatacaagtcaaaagatgttaaaaatgtgccataagaaaagaccacgctgtggattctaaagttttaaaaattatagtaccaagaaattaagatttatatatttttgaattactaaatatctagattgaccatatctatttttgttttaattttccctaaatattctgaaaatcattttatagtttttaacacaccatcatagtttgtgcacggatggccacctttagtgtgtgatttcagtgaagttcccattgaagttatttataagcagtggacctattttacttcttatatttgaacttcttaagaagtttcttgaccaggcatggtggctcatgcctgtaatcccagcactttgggaggctgagacgggcagatcacctgaggtcaggagttcgagaccaacctggccaacatggcgaaacttcgtctctactaaaaatacaaaaattagctgggcgttgtggcaggtgcctgtaatcctagctactcaggagggtgagacaagagaatcacttgaacccagcaggtggaggttccagtgagctgagatcgcaccactgcactccagcctgcgcaacaagagcaaaactctgtctcaaaaaaaaaaaaaaaaaaagtttctcggggtatgtttttaaaaaaaatattttattacatttaaaatgataccttttcatgaaaaatatttattttatgagtgataaattataagtttaaatatgaggtgaatttgttcccttcaactacctataatatctatagcatccagcatacagccctttgtacaaaatgtaacatttagaagctaaaatatacatcatcctcccccaaaataatgattttcttatagacacaagcaagattattctaaaatgcatatgtaaaggcaaagtaactggaatagctactttttttaaaaaaaaaagaaagaaactggcacaaatcagttcatctgatggcaaggcttattaacagtagccccctcttatctgcaggaaatatcttccgggacacccagtgggtgcctgaaaccatggatggcacccaaacccaggtgtactacgatttttcctatacatacatacctatgataaaatctaacttataaattaggcacagttacagattaacaacaataactaagaataaatagaacaattacaccaccataccagtatcactactcttgtgctttgggtacactactaaataaaataagggttccttgcaatgagacattgcagtgagatcgtgccactgtacgatttcactgttccttgaaagcgctgtgataacatagcagttgatctggtaaccaaggcagctactaagtgactgatgggtgggtagcatatacacagtggatatgctggacaaagggctgatttacatcccaggtgggatggaacaagatgctgcagggtttcatcacactatttagaatggtgtacaatttaaaacttaggatgaattgcttatttctcaaattttccatttaatatttttgagccagttgaccatgggtaactgaaactgcaaataagtggggactatcatatatagctacaataatcaagcctatgtacacagagatcacacatagatcaatggaatagaatatagaatccagaaatagatccaaacaaatatacccaactatttttgacaaagttgcaaaagtaattcaatggaggaaagatcgccttttcaataaatggaactgaaacacttagacatccataggcacaatctaagtctcacagcttatataaaaatcacctgtaaatggatcatggacttaaatgtaaaacataaaactatgaaatttctgggaaaaacaaaaaacagaataaaaattgttgggatctagggtagatttgaaacccaaagcacaattcataaaagaaaaaaattgataaattgaactccatcataattaaaaactttttgctcccattagggttacaaggacaagctacagaacgggagaaagtatctgcaaactaccatagccaacgagcagtaagtacaaatgcaattcagaaaatgatgctgggaaaatgacatgtggacatgctgtcaatgtgcttaaaagtacgaaggagggttacattaggatgttgaaaatcaactgggttttcattggtgctgagtttagaggtgtgtgtgggaatgcagagcctttcagtggctttattatctgggggaattccctcttttgtgtgagtctatgggagagacacggtcctacactcccctatgaaagcaaaaaggattagacattcccagtcactaaacactaataagacatggaggtgtgaaacatcctgtgcaatactccagccaggacattatgaatctggatggacagaccaaaggaatgggacagttccatatttcccacagtgaagatggtgactcttcgcatggtgagactccattttcttctctgctgccagcctttcttgggtcttactcactgctgaagtctaattctccagcttttccatcaactctgtgaactgcccaataacttccctgtaaattatttttctgctgaagttaatgcaagccattttctgttgtttgcaaacaggagcccttaggtggcacatactgttaaatgtttcctacaacaagatcatgttaaagtcactcattcccaggcagatctcacaaacaggtatttcctgcagccacccgggagtttctctcacctctaatatcaaagttgttttttatttgctgcccttttcaaagctgtctggctccaagcaaattattcctctggatcccatctgtcacgtggacataatgctatctatttcacaggtgaacttaaaatttttatgatagaatacatttatgtgggccaggcatggtggctcacgcctgtaatcccagctactagggaggctgagacacaagaatcgctgtaatcccagcactttgggaggctgaggcaggtggaggcaggtggatcacctgaggtcaggagttcaagatcagcctggccaacatggagaaaccctgtctctaataaaaatacaaaaattagccaggtgtggtggcacacacctgtaatcccagctacttgggaagctgagacacaagaatcgcttgagcccggcaggcagacgttgcagtgagctgagatcgtgccactgtactccagcctgggcaacagagcaagactctatcttaaaaaataaataaataaaagaatacatttatgtgattttttaaaaaaaaatccatcatcagtgcagaagggttataaagcaaaagaagaagaaaaaagcgacccccatccatcctacccagtgtcaccccccagaaggaaatacttcacagttgcttgtgatacgtaagggtttggtgttggacatctttgatgtcagactcccctcatccaaactctcctttacgttgagaaacaaaaacgatgcaagtgaaacatcagctaagaaaccgatacggtaaaaatgatggcagtaaagtgatcctaacaaccactgtcgaaatgacccacttcagttcatggcaccttcagaggaccactctcaagaaaataagggaaaaatgggtgcagattcctatctaccaggtggaaaaaacaggtgactaacaatttaacagtacaaataccttgcaaacggtatgattttaaccagtgaaactccatgtactgcatgtctcaagtaccctaacgttagccaggtctctatctctatggatttaaaatcaaaacccctcaacacaacactctgtaatgttcttaccaatctgtatcaatttgacataagtttagttccataattaacctttgctatctagtcaaaaaacgtagataaatcagctggtatcagaagagcgcctcagagcagtggttctcacgctcagtctagttcccagacaatagaaagcatcaacatcacctgggaacttgttagaaatgcaaattcaggccagaacttcgggaggcagatcacctgaggtcaggagttcaagaccagcctggccaacacagtgaaaccccatctctactaaaaatcaaaaattagctgggcgtggtggcgggtgcctgtaattccagctacttgggaggccgagacagaaggatggcttgaacctgggaggtggaggttgcagtgagctgagattatgccactgcactccagcctgggcgacacagcaagactccgtctcaaaaaaaaaaacaaagaaaagaaaaaaaaagaaaagaaatgcaaattcataggctccactccacgaatactgaatcagaaattctggggtgcagtccaatgttagaaccactgccctaaagtctaacaaacttcaaaaatcaaaatatactcttgagagttaaggaaattgggaaagaggagttccttctcactgctttacatttcccgaaagacggctctcctcatccctcaccctgcttttttcctggcattctgactgtttctttgggaaatcagagagggcttacaggtctctcatatttggcccccagagtactctgtttctgaagctgcactaggctcggtggaaaacttaccagaaatgatcagtgatgtcaaccatgagctcaggaagggaggggagggagacggcaaatagtgggcttttgaccctccctgcactaaattatttgtgatatgcatatgatagccacatccatcttgctaaacctttctctttggtgttcctccaggccaaattgctctccaacccagtgatgcacattagaattagagagttttttgcttaaaaactctcccacttcttagccaggtgtggtggcgggcacctgtagcatcggttaactacttgggaggctgaggcaggaaaatcgcttgaattcgggagtcagagattgcagtgagctgagatcatgccactgcactccagcctgggcgacagagtgagactccatctcaaaagaagcaaaaaaaaaaaaaacaaaccccaaaactctcccatatgggctccatccccagcgaagattctgatgtaactggtttgtgcagtaggtagggcatctgtgttcttcaaaagtctccccaggtaattctaacatgcagccaggtccaagaacctctggtaaacctagtggttttcacaggctggtggccaaacgagctgcctcagcatcacctggggatttgttaaaaatgcaaattctggggccctactccagacttactgaatcagaaactctgtagggtgaggctcagtaattgcacaagccctccaggtgattctcatgcacaattaattctgacagccattgagagccctgttcacaccacaatttaagaatcttcccatgaaggagattctgggaaaagcaatggccacctccgtctacattaacaatcacagtttgcagtttttaaggacaaaaacaacttcctcaattttttaagccaagtgagctaataataattccaacttgtctttcactttacatatccatgggaggtgttaattactctttctgtctgccttaaacatcacatcataattctaaactagcaattcctagaatgtacttatgagctgctgaatgatttgaagagtggcaaagtgttatggagaaaaagctgaagcaagccccgctgggctcagtgggaaatgaaaaggtaattaaatattatttggctgttttctacaccaagctggaaaccctccccggggtttatgggtagaacaaataaataggagaaaatagggataagcttcttgacattttttctttcaggcccttcaaacacccttgggatcaaaatgtcctaaggaactaggcagaccagtgaaggcttggctacatcaagcaaagttatcttgacaaaatttatggttattgtcttaatccatccaggtgctataacaaaatgccaaaaactgggtggcttataaacaacagaaagctatttcccattgttctagaggctgagatgtccaagatcctagaagccagcagacttagtgtctagtgagggcgcacttcctggttcatagatagctgtggtcttgctgtgtcctcacatggtggaaggggtaaagagctctctggggtctttcttaaaataatggcactaatcccattcaggattgtacaaccctcatgacctaattacctgccaaagctcccacctcctaatgccgtcaccttggagttataatttatttttttcttcttcttattttttttgagatggggtttcactcttgtcgcccaggctggggtgcagtggtgcgatcttggctcactgcaacctctgcctcccaggttcaagcaattgtcctgcctcagcctcccgagtagctgggattacaggcccctgccaccacacctggctaatttttgtatttgcagcagagatggagtttcactacgttggccaggctggtctcaaactcctgatctcaggtgatccgcctgcctcggcctcccaaagtgctgggattacaggcgtgaaccaccgcgtctggcctggagttaggatttcaacaggtgaattttgaaggaatgcaaacattcaatctatagcacttataaaacctttttatgatccatattgactgtctattcctgaattaaatctcattcacttttctgttgctagagaaacctacaacatgacttggtaggaagccacataacagagccttaaaaacctcacattttctagatcctaacctttcccttgagctgatgaattctctcttagaaagaaaattcaccaaagagaaaggtccctgctgcagcatatatgtgggcagggaatgactgcagaaagaacaaaagccttctgtgcgcataacacagaaatgccctggatgagaagacagcgcggaaaggcacagcagcaaggatgaggcagagccagcagcgccacacgcagagaaatccagatgcaggcctgaaagttacatttcattctgctacttggtcatttgagaaccagagagttgtattctgagtccacttgatgttaaatattatcctattctgcagagtttgaactgggtgccctgggagactacctcactgtatttattaggatagaggtgccgctagggcagatggaggtggttatgttttgcctccagccccagggcaagcttcaaagccaaccttatcccatatccatcagctgatggaggaaccctctgagatcaggagaaccaggtgcaaatgagcctataaccaacttactatgcatttagttgtttcacaatacgcatgttctccaccataaaaatatcttttttgaattgactaaataacatatgatcaaggctttaaaaattttaaataatctaaaaacataaggacaaaaagtaaaatcacctgatattctaccacctagagacaactgtttgagtcccatcctttcatacatctttccacctatgcccctgtgcacacacacacacgcagttttacgcagctaacatctgttgtactaaattttatttcactatattttattttcttataattcccctcctctcctgctccccatctctacgttattgatttttttttgctcgaatcctgattctttccttccttctgcttgctttgagcttaatgtacttctttctctgttgttttagggtggaagattaagttggtttaagatctttcttcttttttcttttttaaaacagggtcaaccaggctggagtgcagcggcaccatcacagttcactgcagcctcaacctcctgggctcaagcaatcctctggcctcggcctctcgagtagctgggactacagaaacacgccactgtgcccagctacttttttaattttttgtagagactaagtctcactatctggtccaggcttctttttttttcgagacaggatcttgctctgtcacaggctggggtgcaatggtgtgaacatggctcactgcagcctagacctctgggtgtaagtgatcctcccacttcagcctcccaagcagctgggaccacagatgcatgccaccacacctggctaattttttaatttgtacaaagagggtcccactatgttgccgaggctggtcttgaactcctgagctcaagtgatcctcccacctcagactcccaaagtgttgggattacaagcatgaatcatggcacccagctctttcttcttttttaatgtagttatttacagctataaactttcctgttagcactgttttagctacagcccgtgatgtttgatatgcggtatcttcattttaattagttggaaagtacttcctctctttttttcttctcttagaaacagagtctcactctgttgtctaggctggagtgcagtggcgtgatcatggctcactgcagcctcaacctcctggactcaagtgatcctcccacctcagcccccaaagtagctgggaccacaggtgcttgccaccatgctaggctaatttttttggagagatgaggtcttgctatgttgcccaggctagtcttgaactcctgggatcaagtgatcctcctgcctcagcctcccaaagtactgcaattacaagcatgagctactgcacctggcttcaaagtactttccagttctccttgtgattcctctttgttccactggttatttataagggtgttatttaatttccacatatttgtgaattttgctcatctttctgttatttctagtttcactccatgtgatcagcctctgttaatctgttttcaacatgcccttatgttcctaaatgtttgttaagaaatcatttatttctctatgtttttaaatttgttgacacagggtagcatatactattcctttataattctttggatcttatctatatctgggtatgttctttctcatttcttatttgtatatatatattttttccttaggcaagaaaagagttaactgatttcactggatctttcaaataatcagtttttgtatttattaatccttgtgactattttatcttctaggtcattcattctagcttttatctttaatcatttcattttttaccatcattttggttatacaattttttttcacttcctcagatgaatattaattaactcttccatgttctcatccccaaatgctgaatcttctgaatctgtcttctgagttccttaacttttccctcacagccttaatctgtatattttgggtttttgttttggaatatttcctccaagtacctttccaagtcactaattttgttttcaagagtatcccatcctgattatttatttgataattttattattttttttgtagatggggtcttactatgtcacccaggctgttctcaaactcctggccttacgtgatcctcctatctcagcctcccaaagtgctgggactgtgagccaccgtgcccagtcctgattgtttaaaattgaaactcatggttttagttgcagaatgtcctttttacttaatactgaatgtcagccagctctgagatcgaagttgtattgctataactagctgactttgcctcacgccagtgcctataacgctggctgcccgggcaacctgttctgagcactctccctgtgcttcctctctgttgctgggtccagtgaagtgtgcaactaaaattttccctttgctggctacggctccattcacccttagggctgagttcaggttgctgcaacatcttcagcagcagaaccagtctgcaagctgtcagtcctctgttgggggcagtgggagcatcactgggagaatctcctcatctacaaaggctagaatccacacagtctcagaactacggaagacctggccccactcttcatttcccctgaagcaccctgaaggccagagagaccttcgacccaggaacattccttcagacaactgcctttcgtctcagggtttgtggatctccataagccaagttctcttcaggccccaaagaactcttaccctcaccctagggctccttgactcttgcaggctctctgcttctataattgcaggaccagcccacactgggcctgttctgttgataacaaaatgttgagttaccttataacagagtccacagttgcaagtcatgtagtctgggaatgtgcaatagaaaaagctttgacttctaacgacacccagaaccagggattccgcccctcggaaccaacaaggctggaagagaaccagaccctgcatgccagaacttcttcagaagtgaggggtctactgatccggaagatgtagggctcagcataccttaccgtaagctgtcaaatctgaagccctctaattagaccttgccaagccagcattcccaaatcccttcccctgccttctgatcccttaaaacttgccccagatcccaaatagaggagagaaatttcagctgactcttgtctccttgcgggctggttttgcaataaataaagcccttcttttctcaaaagctggtgccatagttattggcttctgtgcacatcaggcagcaagcccatctgctccataacacttcctgatcctacctgcctatcagtccccttctccattcaggacccactcaggctgccatcttcccctgaaaggcactggcatctcttcttccttaatctagttatataatacttattatccatttgccaaaggccatgcctactataggcaacctgtagcagacaggatcattgtgctgctcacaggtctttgtttcatcctgaagcttacttccagcttctgtggacagctccgacataaaatgaccgtatatgaactcaagcatctctgcctctccacctgagggtgttctctgccaggcacgttcttggttgaaagacagcccataactatcaagcctcaagtattgaggggttaaggcccccggggtgaagccttcaacaaatgaagaacaagtgttgctaactccagcttctcagtccttcccgggcaacgaaggagcagttggtaaatactctggcttcctcagctcttcactgggacaaatcggaggcatgttccatccagtctccctcagtgcccccaatgggactgatctctaggatcccatacagtgatggtgataacctggtcactaatacaaccttttccagctttcctcacttccctgtctcacctctgtacttctccactgtgctttccgggatcagcaaccacataaacttcttgtactgaagttcctgtttcagggtctgattttgggaaaccccaaataagacacaagcataccagaggcatagtggcgtctctgacagacagttaccagcattcagggccaactggtatctgggtcaataacatagcatttccagtgcaaaggcctcctctccagtcagggtctatgtcgctctcatgggtcaggtcaaggcagataatacagaatataaatctaaattgcaccatggtagatcatgaatagtaggaatgaaaaagttaatgtaaataaaaatggactaagagtggataaaggttagactatccaggttgaccaaaagctaatatttaccagagaaggccacagacattatgctagataaggtgcaaatcctttatatttattgtatatttagagttgcctttgtgcatcaaaaaacactgtaaacagtgaaaaggaaattcatggaatgataggtaatgtttgcaaatcatatatctgataaggaattagaacatataggctgggcgtggtgttcccgcctgtaaccccagcaccttgggaggctgaggcaggaggatcacctgagatcaggagtttgagaccagcctggccaacatagtgaaacccgatctccactaaaaatacaaaaactagtcaggtgtggtagcgggcacctgtaatcccagctacttgggaggccaaggcaggataattgcttcaacctgagaggcggaggttgcagtgagccaagattgctccactgcactccaacttgggcgacagagcaagacttcgtctcaaaaaaaaaaaaaaaaaaaaaaagccgggcatggtgtctcacgcctgtaaccccagcactttgggaggccgaggtgggcagatcacctgaggtcaggagtttgagaccagcttggccaacacggcgaaaccctgtctctactaaaaatacaaaaaaatttgccggccacgggggcaggcacctgtaatcccagctactcgggaggctgaggcatgagaattacttgaacctgggaggtggaggctgcagtgagccgagatggcgccactgcgctccaggctggacaacagagcagggctccatctcaaaaaaaaaagatataaagaactgctgggccgggcgcggtggctcacgcctgtaatcccagcactttgagaggccgaggcgggtggatcacgaggtcaggagatcgagaccatcctggctaacacggtgaaaccctgtctctactaaaaatacaaaaaattagccgggtgtggtggcatgcgcctgtagtcccagctactcgggagggtgaggcaggagaatggcgtgaacccgggaggcgatcgttgcagtgagccgatatcgcgccactgcactccagtctgggcgacagagcgagacctcgtctcaaaaaaaaaaaaaaagaactgctataactcaacaacaaatctcccaagaaacccaattaaaaaatgggcaaaggacttgaatacacgtttctccaaagaagatgtacaaatgcatggtaagcatatgaaaagatgctcaacattgctaatcattggggaaatgtccatcaaaaccacagtgagataccacttcacacctaccagaattgctattacttgaggaaacagaaaataacaaatgttggtgggggacgtggagaaatcagaacccttgtgcactgctggtgggaatgttaaatggtgcaacccctgcagaagacagtacggcgattcctcaaaaaattaaacataaaattaccctatatccaaaaactccacttctgaatatataccaaaataaaaactgaaagcagggactcaactagatacttgtacatcaatgtaaagtggcattattcactatagccgaaaggatggaacaactcaagtgtccctcaattgatgaagggataaacaaaatgtgctatatatatgcaatgaaatattccaccttaaaaggaagtaggccaggcgcaggagatcatgcttgtaatcccaggactttgggaggccaaggcaggaggatcacttcaggtcaggagttccagaccagcctgggcaatgtagtgagactcctgtctctacaaaaacttttaaaaatcgccaggcatagtgatgcgtgccagtagtcccagctaagcgggaggctgaagcaggaagatcacttgagcctgggaggccaaggttgcagtgagccaagatcctgctactgcactccagcctgagcaaaagaatgagaccctgtctgaaaaaaagaaaaaaggaagtaaattctgacacatgccacaacattgatgaaccttgaagacattatgctaagtgaaataagccagacacaaaaggacaaatattgtatgatccacttatacgaggttcctaaagtagtcaaattcatggagccagaaagtagaatggaggccgccaggggccagggaaaaagggaaagaggaaccgaagagttactgtttaacaggtcctgagcttgaatttgagaaaatcaaaaagctctcagacggataatggtgatggctgtacaacagtgtgaatatacttaatgcctctgaactgtacacttaaaaatacgtaaagcagtaaattttgtgttatgtatattttaccacaataaaaaatactttagagttgtgaaatactactaaggctacttcctaaaaattatgctatggttatatctgaaatatcatacaataatgaaagggaaaggaaacattcagattcaaaactttttgtgactacagaactctacagacacattgactgactctaattagtcaggtataaatgaaattaccaggaaatggttccttgatgacacctgtgactgcacctgctattttgagtataacatcagtggctgacatggtattcgaaattctccctctgtgcagagttgtcaagaaacctgtgtttcttcttacaaaaaatgtgacgtgcatataggtcccctagatttcactggactctagccagcagtaaatcatgacaaattagccaatatgtaagccctgttgtagacacagaataattataagacaagaaatgtgtcacccacttgtgcagagattagcacaaataagccaaaataggattgaaacaaggttaaaaaaatcacttatatatggaatatgtggtgtatcccttccttttttctgcgaattaagacatcaaattgctttactcaccagaagcatggcccttgtactttctcaacaaagaataaggcattttctcatctgtcacagcagcttctgctcatgaccagaaacatccttcattcctttatctaagcctaaacattgtgcaaagcccctgccatgctcaaatcagctcttggaaatggatggtatagctgggaatctcaggaactggagaagacatcattgccaggaacgacatcatgatgaagatctcttaccctctgcaagattgggatagggtgtggagtctcactgtccatcatatgaatgagaaaaattaggacaaagaaagaacaccaggtatgtagggaaaaacagcggagaaatgtctaagacactggttctcaaccttggctgcagttggaatcatgtagggaactttaaagaaatactcacgcctgggtcccttccctcaccccagtcattctccattgagattatgattcaatctgggattgtgatgtgggcatcagggatgttataaagtcaccatgggatctaattcctagccaaggctgtaaaccactgctttaagaagacaaatttcctgattcttaggtcagtcttctgggatcctggctgggatcacaatttactgcaagagctaataaccagaattaaaatagtcttgaaaaatcactctccaatatgacagtgaaaatgtgattatattccgtcactagagggcgaaatttcttaattttcaacatttaataactatcatagactcaaggttcagaattcactgaggtttgtctcttaaaacaaaacaaaaataagtaatgaagttctaaagaaggtatactaaagcttgactttcatgctatcagctcctacctatttatgaagtgagactttaagacgcaattgagagcactgtatcctttcattgccacataccctcttcccaaagggtttgtattttatagggtgtattgtttttacaaagtaaatggctttgctgtgtagtctatgttacaaaacagaaggtagggcatcttgaaacagaaattttgcattactaaccagctcccagaggggtcaactctgaggctgctggtagagaactatactttgagcagcaggaggtgaagaacctaggggcagataccataactcattttctaaagatattctaaaatgtaaactcacataccgataacatgattcctgcccatctatcattcatctatgtatgtatgtatgtatgtatgtatgtatgtatgtatctatctatctatctatctatcatctgtccatcggtccatctgtcatctatcatcatgaaggcagagagaccacaaatccaggggattccaaattgactgtgtattagaatcacttggtcttgtcttaaaaataaagattctaggccaggcgtggtggctcacacctgtaatcccaacactttgggaggccgagccaggcggatcacctgaggtcaggagttagagaccagcctgaccaacatggagaaaccccatctctactaaaaatacaaaattagccaggtgtggtagcacatgcctgtaatcccagctactcgggaggctgaggcaggagaatctcttgaatgcaggaggcagaggttgcggtgagccgagatcacgccattgcactccagcctgggcaacaagagcaaaactccatctaaaaaaacaaataaataaataaaaataaaaataaagagtcttagtctcaccccctggaggttatgatcagtgcgtctggagcggggcccggagtttgtatttttaacaagtgctcaggagattttgctggaggctgttgcttttgaaaatcactgttcttcttcaaagtctttcctttacaaagaaattgaggctggaagaggagaagggacctttcaaagttagtgacattaccaaagcaggatccaggttctcctggccctgctaaactgagacacttgttggaattcagcatgtgtgcttgatccttcttcttatgctgtgtcactgacaggtgtagtaagctagcttccaaagacagtccgcaatgaacgacatctaccaaaattcacacccaggtgttgtcccctccccgattcaatctgggctcgcctcgtgacttgctttaatagatagactaatctggaagggatgcagtgtaacttaggaggttcggccattagagatttgcagcttctccatgcttcatctgggaacacgcattctgaaccccgacattgtgctgtaaggaacaaggaagctcaaggaactacaaggaaagccccatatggagaaaaactatggccctagtgaacatcctcaaatgcactcccagcccacagctcctcaccagctatgtgagggagaacacgatgcaccttctagccatgctctccccagtggagtggaactgtctagcaagtcacagaataacacaaaaaagttgttgttctaagcctttaagttttgtggtgtatgctatacaagaatagattgctgaaacaataagaaaagaaatgcccttacctgtttggctggaaacagacctggtcataacctgtgagttcacacaaatccttctcaagctctcggaaaagctgctgatatccttgagcttgatccagaggcacaaaggggtggatgtttgcaaattctttccatgtgataggctgaaaagaaagaaaacaaaaatgcatatatacatattataatagcaatagcaataataactttaataataatgacgatgatgagaaaagctatgtgccaggcactgttctaagcgctatacatatgttaatttatttaagttccaccacaaccttataaggtaagtaccgttactgtcttcatttaaaagtgggacatagttgtccaaaaagggaacttacacaaaaatacaatgttttgctaacttttcagggaagaaaagcccccaaaacagatttctttccatgaaacacaatgagttgcttcaggtatggttggcataaactcttatatagcaatagattgttctctttcttcactaagtggaacaagaaacaaacacaaaagtaaatgggaaggccaggtacagtggttcacacctataattccagaactctgggaggctgaggtgggaggactgcttgaggccaggagtctgagatcagactggcaaacacagcaagaccttgactctattttttaaaaaaatagagagggaaatattcttatcatgatataaaatgatttctttcgtctgatatgatatgtcacttcagaataaacgtaagaaatgaaagaaagaaaaaaaaagcttcgctaaaatggatcctggcctagtagagatacttgccaaccacaacagcgagttgcacaaatcttctgttgacttgaatccctatctttctgatacaggaatgatttctagaaagacggcttaaggttcgtaattctacctgagatttagaactataaacaattttttttaaaaaagcttttaatatgacaggtttaaaagggggtgggggtgggggagggataggatagaaaggcataaataccatatacatttaattaattttattaaaaaataataagtttacccatacatttaaatgatgaagtcgtgagaaatacagggttactcccaagattggtgaatagcaaggtaaagaattattaaaatagttcttcaatcacagaatcacagtcccagtagatttcactagttctgggcttaggtggaagctagaacactgccccttgctgagtatccacttacagaagtgagctacttactgcgagttcagacgaactgttcagtttcatggtgcaggatccctttaagaagaacatccaaaatgtatcacattagtgattttctatagtccatcaatcaaccctccattctcccagcatggccacccctttgttgctcttggagcatattaggtaggaccaagagacgtgggattggggtagcttggaaatgagaaaaaaggccacaaataactaccagtggaatcatgctgtgaacaagggaaatgtctttattttccagtttcttcatgtaccggacaatgtttgtttcagagtggtagctgtgaacacaaaacacagaattaggggccccaaaagtagatatgagtccatg

SEQ ID NO: 526 - DNA, 23801 bp, Homo sapiens
tggacaatattttaaaaataacgcaatataccaaaaaccattaaattgcacacttttaaacattttactgaatttatgttacccagaccggcctcaactcctgggttcaagagatcctcccacctccgcctcccaaagcgctgggattacagctgtgagccatcgctcccggccaaccgcacacttttagtaggtgaattgtatggtctgcgagcatttgaataaagctttttcttttaactattgtttaaaaatgtttaaaatggcatttttttacaataaaataaacgtatgtttaaaaggcaggtacacatataactgtgaccaaaaaaaattagaaaaaaaaaaaaaaaaaaaaaaaaaaagacctgtccacgagagaacggagacaccatatcctaagcccagacaggaaccaccgcccggcttattgctcacattagtggaggaaagagtcaagggttcagtttggggctcctgagtctaccgggtgcagggttgagtgataaaaaagcgactttagcctcgtcgcatgattaggagaatcaagaattaaatgaatggagatgtatagataagtaaatcagaggccgggcgcggtggctcaagcctgtaatcccagcattttggcaggccgaggcgggcggatcccttgaggtcaggagtttgagatcagcctggccaacatggtgaaatcccgtctctactaaaaaacagaaaaattccccgggcgtgatggtgcacgcgtgtaaccccagctactcgggaggctgaggcaggagaatcgcttgaaaccgggaggcggaggttgcagggagccgagatcgcgccactgcactccagcctggaggacggagcgagatcctgtctcaaaaaaaaaaaaaagaaggctccagacgggcaattctttaatttttaacacaacaaacacccatcgaacacagcgcgggcattttgacaatggacaaaatcttgcccttgactttataatccatcgacatttggggacccataaaccccctaacctctgagaactatttagacaaatactagtcgggttttttggtttgtttttactttttaaatggaaaagtgatgattcaccttttcaaagacttgcggcttttggccaacaaacacgccatggtttactcacccacttcctctgattcttggccagacgctctaagcttgcactccctgggatagtgtttttgaattatcgtccacagttccacgttgacgagagaatttcttcgggtatggtaccgagtccacgacgatacccggcggcgacagaagggacagcataaactcgccttttcgacggtcgactggaagcacggtttacacagcgtgtggttacacgggagggtgacgggctccacgaggatttccatgcagatcccgcactggcactcggacagcgaggggatggcgtctttgggtagagccatttcaatatgttagtaaagccgactaaacaacgacacctgcacgaaaaagaatcctattttcggccaaccacagagagagcaaaagcagttttgtgtttcagtattatgcccagaagcgtatcagaattcggagaacaggagcatccaacacgtcttgaagcaaaaaggcgctctcagggtcaggcaaacaggaataccccggagggcggcgtctttgtccattttcaaggcaaacgtcccgccagcaaataaatgcaggttttcgtcggaggagcctggctgctccgcggcatgaacaccgcggctgcggctcccggggcagcgaggggaacgcgccaagtcctctcctcccctcacccggaaaggatgctccgctcagctcggggcagccgggccccgggacgcggctccgggaggaagcccgggctccggctgcagcataacttccgctttaccgctgctgcgggggagacgcgcgactcccgtgttcacctttcgggcgcctggcgcagtttcccagagctccgcgcccccgtccctcctacgcagccagaaaccctattcgttgcggcagcgcagcagccaccggacaagcgctagcaacgtcacaaccgcccgccaaaatcgcacttcccacccagaaaactgcccaagggcgaacgttcccggggcgggacttccggggtctgcgcgccgcccgccctccctcccagccggagacggtcccgccctggcgtcgcagccccgcctagtgcagcctgggtggagcctgacctttccctgagatttctgcgaggcctcagacacccctggtttcttggtttctgggtagaaaaagggaaacctcaaaacaaaatcaacagccaaacaaggccgggtgcggtggctcacgcctgtaatcccagcacttcgggaggccgaggcgggcggatcacctgaggtcaggagttcaagaccagcctggccaacatggtgaaacccccgtccttactaaaaatacaaaaattagctgggcattgtgacaagctcctgcaattccagctactcaggaggctgagacaggagaatcgctaaacctgggaggcagaggctgcagtgagccgagattgtgccactgcactccagcctgggggacagagcaaaattccacctcaaaaaatacaaataaataaatagataaaagaattggggtctcactgttttatccaggctggactacaactccagggttccagggattctttcgcctcagcctctggagtagctgggtctagagcttgcaactccatagccagctccggacctgcattttttgagggaatcaatcagtgtgaaggaagagaaaagaaaatcactgtgcgtgaaagcagcctttaagttgttttgaggctgctgagagcattcaggctgggtaggggatggtttccaggttgagaacaacgaggagacatcggtcgttggtagaagtctttgggaactttcatttcaatgtgggttcagaaacctgttattgtctgtgatagctcacacctgtagtcccagcactttggaaggccaaggcgggaagatcagtggagcccaggagttcaggtccagcctgggcaacatagtgagaccctgtctctacaaaaaataaaaaaattaactcggtgtgctggctcacacttatactctcagctactctggtggctgaggtgggaggatcacttgagcccaggaggtcaaggctgcagtgaacagtgatcgtaccactgcaccccagcctgggtgacagggcaagaccctgtctcaaaaaaaagaaaaaaaaaagaaacctgggactgtcatctggttgtctacagtaacagtaccttagcttggaatttcaggcttgttttttgttcgtttgtttgtttttttgagatggctcctcattctgttgcccaggttggagtgcagtggtttgatctcagcttactgcaacctccacctcctgggttcaagcgattctcatgcctcagcctcccgagtagctgcaattacaggcgcgtgccttgtaataccacgtgcattgtaataccacgcctggcaaatttttgtattcttagtagagatggggtttcaccatgttggccatgctggtctcgaactcctgacctcaggtgatccaccggccttggccttccaaagtgctgggattacaggcgtgagccactgcacctggccttcaggcttcctaatatgtccacaacctgcttttcccatcgaatctcccattattcttttaaacatgcaactatgatttattctctgtcatccaaacgttttgctttcatgacattgctttctcggttcatcctaaatgggttgctttgtggctgtgcctacttcaaacaccaatttaatgcagttgggccaggcacggtggctcatgcctgtaatcccagcactttgggaggccaaggagggcggatcacaaggtcaggagttcgagaccagcctgaccaacatgttgaaactcagtctctactaaaaatacaaaaattagctgggcatggtggcaggtgcctgtaatcccagctagtcgggaggctgaggcagaagaattgcttgaacccgggaggcagaggttgcagtgaggccagattgcaccactgcactccagcctgggttgacagagcaagactccgtctcgaaaaaaaaaaaaattaattcacttcttccagagtgcacttttatgtgcaatttaatgcactccccaccaccagtaatgccccttttctaaactcacccagtcatatattgcccagtgatactgatttttattgcagttttactattgaactcctgtattttgatttctatcttcaggtgcttatgtcttgtgtaatggatatatttcatgtacttcctcagatttccttcactttgtttgctttctgtacccataatcacttgctctttttggggctcaccagttgcatttccggaatctctggcttctcctgccacttctgaacaatgcaggagctgacttctcagaggctgctagggcctcggtaatgcatgctgggagggtgggggggtcactccccatggagtaactttcaccaattgaaaccagtggactgaccgagcacaatacttaaattcccttttcttcttccttccaaggatggtttctccagtgtgtctggagacaggcaagactgagggagtgtgcctgctgaaaaagctgctgtgtctcttgtggctcattttcaaggaggggacagcaaggtaacacatcaccatgtattacttcacatccttctctacctaacttccttccagctttcttcactctggctgtcctgaatttgtacctcccaaataaagcatcggcacttaatctttacctcgagggcaggatccacatttttaatgtttctgttatccacagtacctagtacatggcatttggtattcgataaatattataaataaatggtcaagatgtaagaatctcctttctggtataaataactatggtacttcattagagaacaaatacacattaagatacaatttataggatctcatgatgtatattttaggtgtttttgttttaatttatgaaaatagagatgaggtctcactattgttacagctcttactcccgaatttgatgagttctgagttgttgtcccatgactgagaagaatgaggtacacggacactggagagtgagtaaggcaaagtagaatttattgagtgacagaacggctcttggcagtgagaggggacccgaaggtgggttgctggccacgagcctgagtctatgggtttttgtgggctagaaatgggcaagtgcatgctgattggtctgtggctatgcttgacaaagcaccattcagaaataggcacgatagtgtagaggaccaatcgcggaagggtaggtatgtataaaataggtgaagggtaaggaccaatcaggagagagggtgccagacgagaatgggagctctcagtctggctcatggatttatccagaactcatagcttggttttcaggctttagactgtccttggcttgaaggttgagtttcaccagggacccctccctgtctgcctaggaatttacctgcctcctattgctatcactgtgttgcccaggctggtctgaaacccctgagctcaagtgatcctcctaccttggcctcctaaggtgcttggattataggcatgagccaccatgtccggccttgtttattttttaaataggtaatacattcacatggttcaaaattgaaaatgtaaaaaatggattaacagtgaaaagacttcctcttgtctttgacccctagcctcttagctttctttcctgacaactaatgttatcactgtcttgtgtatctctgcagaagaagtttatggatatgtaaactaatatgtgttatatatatatttatatatatatatttgtcaccttttttccacttagcaatgtatattggaaataaacatttgaaaacaacaatacatttggtgatcacttcatatcattacacaaagagcttcttcattcttttatatggctgcaaagaaagtatctattgtatcaatttgtcataatttatttaacatcctctcactctttgctataaaaataagactataataaattgtgcatactttttgctgtttccaagataaattactgtaggtggaatcactgggtcatagggtaacaggttagtttttgacagatggtatcaactcttcgagggatgacttttgcttttcaggggtcctaactgctttccccttctcaattacctgcacagccctcagcaaactgtcctgcagagcctggttctttaccatgttagtaattaggaacgtgacatccctgatgtacatctgcctcactttagcagtatagtgttctgccttgttaccacgtgcaataaagaaggtacaaagtgctgtgatgtctccttcttgcagcccacactcctccagtatggactcccatacaactctaacgcgcttgttcttaacttttcttctgagtacagaggctaaggttggaagacctctcaccaggtctggcagcttctcaagcacacgagtatgcaagcagataagtacttcaatgacgtagctgtataaaatattcaattccattgaagtgagcctacaaaaaatatggagagcttcttaagcggtcaaaaatattttatatagaaacagaaaatgaattcttttaggataactcaatatgaacccactaggagaaccagctgttgtaatttagaaaatatttactttagaatttaaattcaaattcaaatacttacattttatttttttttaagagacagggtctcactttgttgcccaggctgttctcaaactcctgagctcaagtgatcctgtcgcctcggcttcccagagtgctgggattaaaggcgtgagccatcatgcccagccagtactcactttagaattaatgcagataggctgggcgtggtgctcacgcctgtaatcccagcactgtgggaggacgaggtggttggatcacctgaggtcaggagtttgagaccagcctggccaacatggtgaaaccccgtctctactaaaaatacaaaaattagctgggcatggtggcgggcgcctgtaatcccagctactcgggaggctgaggcaggagaatggcgtgaacccaggaagtggagcttgcagggagccaagattgccccactgcactccagcctgggtgacagagtgagactccatctcaaaaaaaaaaaaaaaaagaaaaaaaaattaatgcaaataaggctttggcaagcaagagactttgtgatgagatgtgtactatagtgcctggcatataaagagatgctcaaattaatcttttttttttctttgagacggagtctcgctttgtcacccaggctggagtgcagtggtgagatctcggctcactgcaagctccgcctcccgggttcacgccattctcctgcctcagcctcccgagtagttgggactacaggtgcctgccaccacacccggctaatttttttttttttttttttttgtatttttagtagaggcagggtttcactgtgtcagccagggtggtctcgatctcctgacctcgtgatccgcccgcctcggcctcccaaagtgctgggattacaggtgtgagccactgtgcccggccaaattaatctttttttaaaaaaataaatgaacctaagaaaatgtaattgctttacaatccattgtgggaaacatactaagaaattcaattttgcaatgaccagtggaagctctcacaaagccacagaatcccactgatttctcaattgatactcactggagtgcccgaactgctgtccacatctcatcttgggctgcttggcttgccaaagccttactatgatgttcgaatttctgcatcaggttatccttggtgaagtctagttctttgaactgtgtttctaacgcttggagtttgtggtctactctgtaggataacagaatcaagggttagtttaggttacaggacaaaactaaggttttgatttaagctgaggctctaatacattatttacaaccattaccaaatttggataacttttttttttttacttttactttaaactatgaagggaaaatgggtagctatttgaatttgaaagtttcaacaaatggctccatttgccattccctctagccatcatccttgtcctttcattccatatattgcaaacttttgaattgtctaattatttgaattgcctgtcgtgtcttgtttttgtattataccttatactttatgtatttatttattttctaatacagagtctcactctgtcacccaaaccggagtgcagtggcacaatcactacctcccaggctcaagtgatcttcccacctcagcctcccgagtagctaggactacagttgtgtgccaccatacctggctaatttttaaaaaatattttttgtagagaccaggtattgctatgtttggctggtcttcaacacctgggctccagtgatccacctgtcttagcctcccaaagtactgggattacagccatgagccaccatgcccgggctataccttacgatttagagaatattttatgtaagcattactttggtgttcacagcaaccataaaaagtaaagcagtcatttttactattttactattaaagaaattgagtctcaagaggattgagacctaatgtcataaagttagctagtgctgagaccagtatataatctggatctcctcggcaggaaagtcaagggccttcaccctttgctcctatcttccgccagtcccctcacccatcctagtcaccaattacatgagacatctagttgctgcttgaatacattatgtggttccaagcttacatatggcttataccctattttctacccgattctaattgtccaactcttatcctttcttccagaatcagctcaaatccactgcctttttgaatccccatctacctggtgatctccttgcccccctgcgtctcgcttacaagcactgcctctgtggacccatctcccgcctcctgctttactattagggttagcctttcatgaactaaactacgttcttggagggaaggaatcagagactatttcttagatacctttatgtctgtcccccaatacccagcaaaggtcttgcacagtaataaaagtttccctgtatgattgacatctttgatgagaatgaaatgctgagttctgtaacccaaaatggggatttgagtagctccgaacagccatgatcatcagaggctgctgtggcaccagcattatgtctaattaaccacaaagactggagcaacacaattcacttgcctgagccacctagattgtccttatgagggaaacttgcctgggccacctagattgtcattatgagggaaatttgcctgggccacctagattgtctttatgagggaaacttgcctgagccacctagattgtccttatgagggaaacctgcctgggccacctagattgtctttatgagggaaacttgcctgagccacctagattgtccttatgagggaaacctgcctgggccacctagattgtccttatgagggaaacttgcctgggccacctagattgtctttatgagggaaacttgcctgcgccaagtagattgttgttatgagggaaacctgcctgggccacctagattgtccttatgagggaaacctgcctgggccacctagattgtccttatgagggaaacctgcctgagccacctagattctcattatgagggaaacctgcctgggccacctagattgtccttatgagggaaacctgcctgggccacctagattgtccttatgagggaaacctgcctgggccacctagattgtccttatgagggaaacctgcctgggccacctagattgtccttatgagggaaacctgcctgggccgcctagattgtccttatgagggaaacctgcctgggccgcctagattgtccttatgagggaaacctgcctgggccgcctagattgtccttatgagggaaacctgcctgggccgcctagattgtccttatgagggaaacctgcctgggccgcctagattgtcgttatgagggaaacctgcctgggccgcctagattgttgttatgagggaaacctgcctgggctgcctagattgtctttatgagggaaacttgcctgcgccaagtagattgttgttatgagggaaacctgcctgggccacctagattgtccttatgagggaaacttgcctgagccacctagattgttgttatgagggaaacctgcctcggccacctacattgtccttatgagggaaacttgcctgggctgcctagattgtccttatgagggaaacctgcctgggccacctagattgtcgttatgagggaaacctgcctgagccacctagattgtggttatgagggaaacttgcctgagccatgtagattgtggttatgagggaaacttgcctgggccgcctagattgtggttatgagagaaacttgcctgggccgcctagattgtcgttatgagggaaacttgcctgggccaagtagattgttgttatgagggaaacatgcctgggccacctagattgtcgttatgagggaagtgatgcgtcaacacacatgctacttctctgagcttccgtatctccagtgacctgaatacctttgtgactgcccagcattctatgcttgatcatcttttattcttggtcctaaatttctccctaggctaattcaccttcaggtactacatctctcctaagctttaaacctgtatttcctttctttttttttttttttttttttgagatggagtcttgctctgtcgccaggctggagtacagtggcacgatcctggctcactgcaacctctgtctcccaggttcaagtgattctcctgcctcagtctcccgagtagctgggattacaggcgccaccacatccggctaatttttgtatttttagtagagatggggtttcaccatgttggccaggctggtctcgaactcctgacctcaggcgatccgcccacctcggcctcccaaagttctgggattacaggcgtgagccaccgcacccggcctagagatgtattttcaatatgttttgtgcatctccacaaagatggagatgtcaaactcaactctcctaagcttaacctactaatacctcccccatcttcagaaattactatgaagaaatgttgtcactgctttacacatagataagactcagtataaaatgttcattttgtaggaatagaagcctgtgtgacctgatatgcctgtaatttctgtctacaagtcaaaaccatgtgatttgagctaggtgcagtggctcacaactgtaatcacagcagtttgggaggccaaggtgggtggatcacttgagtccaggagtttgagaccagcttgggcaacatagtgagacctcatctctacaaaaaataaaaaattagcctagtgtggtggtgtgcacacttgtggtcccagctactggggaagctgaggtatgagaattgcttcagcccaggagttcaaagctgcagtgagctgtgatcatgccactgcactcagcttgagcaacacagcaagaccctgtgtcaaaaaaaaaaaaagaaagttggccgggtgcagtggctcacgcctgtaatcccagccatttgggaggccaaggcaggtggatcatgaggtcaagagatcgagaccatcctggccaacatggtaaaaccccttctttactaaaaatacaaaaattagccgggtgtggtgatgcacacctgtagtcccagttactcaggaggctgaggcaggagaatcacttgaacctgggaggcggaggttgcagtgagctgaaatcgcgccactgcactccagcctggtgacagagtgagactctgtctcaaaaaaaaaaaaaaaaaaaaagccatttggcatactattttgtgttaacttttagacctttaagactatattgcttataggtcatctgtagtttgaaacttagggaagaagtctagcttgtcaatcagtataaaaatttacagttgcagcagttctttggaatcctctcaccaaaggacagtccgaggccgttccagataaatctcaaccaacatgcaaatctcagcgcaggctgttttgttttgttttagtacagttccctagtttcgttaatgacctcaccatccaatcaattgcttgaactagaaatctcagaataattctcaacttttttcttcccctgatttatgtctctctaacccattcctgcctctccatctccatcaaatgagtttctcatcatctttcactaggacccaagattaccgtagcctaactggacccccgttttccatttcccatccatcctccagacacattcttctaaaacacaattccgattctgtgactcaactgattacaaatggtttatgtcatcctggcttgcccagtgatatactcagaggcaaactggatctcctcagcaggaaagtcaagggccttcaccctttgctcctgtcttccaccagtcccctcacccatcctagttaccaattacacgagacatctagttgctgcttgaatacattatgtggttccaagcttacatatggcttatatgcactgtttcctcagcctagaatgccttcccatatttttctccctcataagctcctacttgcactttaagatccagcttaaatgaccctatatgaagagttcctttttctagtgtcaaaggcaaaattggttgatcctcccttcatgttcgcatagacctttaggaacatcaccattgtaaggtcagtcacattaaattgtaaatgtttttcaaacttttctctttcctacaggctgtgagctccttgagggcagaaaccacattttacttatttttgtaaatctaggatttagcatatgcatacattcaatggagttacagcacctgggagcagacttttctttattgttaatttacataggtttgggcctggaagacttaaaccactgtaatagagacggaattctttttttggacggagtcttgctctgttgccaggctggagtgcagtggcacgatctcggctcactgcaacctccacctcccgggttcaagtgattctcctgcctcagcctcccaagtagctgggactacaggcgcccgccaccatgcctgggtaatttttgtatttttagtagaggcagggtttcaccatgttcgccaggctggtctcaatctcttgaccctgtgatccgcccacctcggcctcccagtgtgctgggattacaggtgtgagccaccgcaccggccacagagacagaattctaatgagcatgtctgcagttctttatttctattcttcattcttctcttacccatcttcccagaatagcagacccatgcttgctccctccctatagccctcagcaaccttttcattgcctccttcaaggatatcagggttgtggtttcattgttcatcttctgaaggcaaaaggaaagaaaacaaaaacaaagcaaaacaaaaaaagcaataaatgtttgaatccagaattttctgcggtcttcctctcagcaacaggcagcagtagcaggagcgctcagtctacattctgcctgaaaggtcactcagtacaagaagcttttaatagcctgcagatccaaatatagtttcaaagaacttatctcgtggacacaggtgtcctggaatgcactataacatttgcctttgaaaactgaaccatagtacattaacatacagcaacaaccatgtataattaatgactgtgtacattatggtaaatgtatatacagatacattaacgtaacgtataggattaagtttgatggaaatattactgtcatattttaactgcttcattattcaattacaacctaaattaggtttgaagagtgccccagatcttttatgatgatgatatcaaagcaaaaaatctaactatcattagaaactactaaatacttgttatggctgggtatggtggctcactcctgtaatcccagcacttggggaagccaaggtgggaggattgcttgagcccaggaattcaagaccagcctgggccacagagcgagactgtctccacaaaaaatacaaaaattagccaggagtggtggtgcatgcctgtagtcccagctactcaagaggctgaagtgggaggactgcttgagcccaggagttcgaagctgcagtgagctatgatcatgccactgcactccagcccgggcaagaggataggatatatatatatatatatatatatatatatatatatatatataattatatataaaattatacatataattatatataatatataatttatatcgtatataaaatatatatataattttatataattatatatatattagattaggaattgaatataaatgtggaaataaaataggactgctgttttcatgagatttaaaatctagttgggaagaaagaatatatccttaaatagaaaatgtatatgggatgtgtgctaagtagatagagaccataaaaataatagaaggtgagagactaagtcactgaaatcttgggtccttggggagatattcaccctgaaggtggtacttggcttggccttaaaggtcaaggtctttgattatcagagaagagtgttaagggtgttacgaactggagaaattgtgtgagcaaaatcacagaggtggcaaagtaaatgatgtgttcaggaaacaatgagtaggtatgttttgagcaaaagattcatataagaaaaagaaaataaccacaccatttaaactggtaagagccatgtcacgtatttgttctttcactgaatactttattcacttattcaatatttactgagcatcatagatattaattgaatgtataaaacctacgaatggatgagcagcactattccaggcactggtaatatagtgataagtaaggcgaaatccttgtcctcaaggaacatactagcagggagacagcacataaggcttataagagaggggatgcttctagctagcttggtaaggagtttggacagatgtgagctgttggttctagaagattaatctaggctcaggtgcagtggctctcacctgtaatcccaacattttgggaggctgaggtgggtagatcacttgaggtcaggaattcgagaccagcttggccaacatggcaaaaacccatctctactaaaaatacaaaaattagctgggcatggtggcacacacctgtagtcccagctacttgggagtctgagataggagaatcgctcaaacccgggaggtggaggttgcagtgagcagaaatagcaattgcgccactgcactccagcctgggtgacacagcgagactccatcgcaaaaaaaaaaaaaaaaaaaaaaaaaaaaagattaatctagcagtgatattgtagtataatatgaaatatatttggtcttcgtccccatttcagccacaaagctcctaaaacccttggaatttcctgagtgataggagtgtctttttttattcataatgagccccttttgatcacatgtgagtttatgctaatgaggtgatttagggtggtgcaactagaatagcctccagatggggctggtcactagaaagaccaggtgattctaagttggaactttcagcccccacccaccaacctctaggaaatgaaatgagtgagctggagattaagttccataaaaattcttggacaatgaggtttgatgagcttctgggttgccaaatataaggaagcgctggtgggatggtgctggggagagggtgtggaagctctacagcaccctccaccatatcttcctctatgcatctctaacagcacccccccatacctttccctatacatatctaacagcacccccctgtgccttcccctatgcatcactaaaactgcctgttcatctgaattctatttattttattttcttgagatggactctcactctgttgcccaggctggagtgcagtggcatgatctgggctcactgcaacctctgcctcccaggttcaagcaggtctcctgcctcagctcccctagtagctgggattccaggtgtgtgccaccactattacaggagttattaaaaaattattttagtcagctagaaagggtaaaagagtcctcagtaatgctttttattttaataaaaaagcagcccccgcaaacatttcttttctaacagaaagtggctggaaaaaccagacctgcaagcattgatttgcaagtcacaggcttacatatgtaaatgctggtggctaagagccaggttcacccaatatggcagttcctgctgctttttctttgttgccacatgtgcagatatcatggcagccagccaggtagaagtaacatgtacaggcatcatggcaaccagccaggtagctgcatttgcataataaaaggctagggtgggagggccagtttttttgtgggctacgtgaatgccacacctggtcaaaccaatcccttgggctctatgcaaatcagatgccacctcctcaagcctcctgacataaccaactgctttctgctaaagggggttattccatttggagccctcctcccattgtacaggggagctgttctcttccttcttgcctactaaactttccactccttaatccactctacgtgtgtctatgttgctaattttctcggcatgtgacaaaggaccctggatgtttccccagacaatggagccatatcacgatgctcagctagtttttgtatttttagtagagacggggtttcgccatgttggccaggctggtctctaactcctgacctcaagtgatccacctgcctcagcctcccaaagtgctggagacaaaggaccctggcacaagacaaaggaccctgggtgtttccctagacaacgtagccatgtcatttttgggggctcatccggaatcccaaggtacaacattcaatggagcagtgagtagaggagcggactcaaaatctgtcctttcattccaaggctcttggtctccattttaaaatctaatcaaatcaataacaagcatccatcagccagttaaagacacggttagtgtggctgccattcttagagacttggatgtcaggcttactggggagaacatggagacccccccaatacccatgggtcactgggcacgttggccatgcttcaaatcagcttcctttcaacaaggaaacctaaccatcccgtgaggccaggaaaagttcttaagcaattgagaatttctggccagtgcacacccttgtgttattcaaatgcttctggactggactcagcctccaatagcctgcccaggtgttggtaaagggtccccagctagcctgttgcaaaatttcccttctttttctatctgcgatcactatgtctcttattttctctgtgtgtcaaatgtgagggaatttttgcagcccagggaagtaatcctgttggggaagatcaggaaatgctgtagtaaccatggatgtagttcaggatcttgtgatcttttaggaacagagggcctcccctttcccacacagtgaggtcactcgctactagtcctcgtgcgagcacgtggtatatttaagccaacagcgccacctcgtggaaatagaaatcccctctgtaagacacgttggtccactgtagcttcccaatttttccattttgcagctttctttatgctgcttctgtgaataggaaaattctgccccaacaattaggagtaaaatgtcctctgcagccaaattttagtcctgatactgtcccatcggcaggaaaatcgccattaggtccttaagtccctttaaggcacctattctgtctccaattaaaacagtacttaattagtaaggggattttaagtctggaagttaacctgaaccattttctaagggtaaatgccctagtgcgggccataatagtagccaatccagcacattccctccgttaaagaagccttgccttttacatagtttttcccaagatccattttccagggaggcacacagatcacacaagtctaggaaataaaaggggaaccacatgcagagaactaggatagcatgggtaggcatgactaatcccatcttctagtttctctggttccatggcttggagagtcacacctacaaccacgggcggcacatttaacaaggtgccaggacccaggaaccaaggagggaaaacagtcgggggggacgctcccactgtcttcttctccaccctgggtcacacaccaaaaggaaggagactaaatggatggctttttctcacttctctttctagatgggaaacagaccatctacgacctgcactcctctcaagtgcattctaaaacgctgggacttcttcaaccttgagactttgaagaaaaagcacctcatgttatattgcacaagggcatggccttcttaccatcctggggacagacaaacccgctggagggagccttgcttttaatattatccaaaaattcgatcttttctgcagacagaagggcaaatggtctgaggtcccctatgtacaggctttctctgccctgtgagacaacccagatctttacaagttttgtacaatggactcagttcttttagcagccatggcaggcaagcccataggtaataattccccagagctaaagcagattccagaggagcaatctgagacagctattgaatgtcccaacccttctagtccccctcatccagaaccccctccaatcatgccatcagctcctccagctccaccatcttcaatatcacccactttgcccacttcgctcttacctctgcaggaaatgcctgatggaaatggtgctatgaagcttcatgttcccttctcattacaggatcttaagcaaataaagggagacaagccgattttctgacgaccccgatagatatatagaaactttccaaaatttaactcaggtgtttgatctcacgtgttgctcctaagtcagactctcaccgctgctgaaaagcaggcagttcttcaggcagcagaaaaatatggagatgtgtgggtgaaggattacctaggtgctgagacaagagactgaaggcacaaactgtttcagtataataaagaaaatagttagaataagaatagttataatacaaattagatatagagatgatcatggatattatcaataattagtataaacattgttaatcattagctcttaatattgctctttgttgtattactaatatagccaaggaataactggcaggtatagggtcaggtgctgaagggacattgtgagaagtgacctagaaagcacgaggtgagccctcttgtcaacgcctgcataagggccacttgaggggtcctgggtcaagcggtaatgccagtgcctgggaaggcacccattacttagcagactgcaaaaaggagtctctctttccttggaggagtcagggaacactctgctccaccagcttcttgtgggaggctggatattatccaggcctgcctgcagtcatacagaggcctaaacccctcactgtggtgctgtgcttcaatagtcatgctccttgtccactttcatgttcctcccgtactccgggttcctctttgaagtttgtagcagatagtggtagaagaaagagtgaaagtcttaaaatctttgatctgtcttataagtgcacagatgaaaacactgacgtttgctgccttctctctctgcttcggctacctaaaagggaagggccccctgtcccatgatcacgtgacttgcttgaccttatcaatcacttggacgactcaccctccttaccctgctcccttgtcttgtatgcaataaatatcagcatgcccaatcatttgaggccactacgggtctttgcgtcttggcggtagtggtcccccgggcccagctgttttctctttatctctttgtcttgtgtctttatttcttactatctttcgtctccgtacatggggagaatacctgctaagccctgtggggttggaccctacagagataagcaacatgtctcctatagcagaccaaagagagaaaaaggaaatagggaaggtgaactaaaaatggaaactccattcccactaggaagagaagcagttctggcagacaaccctcatgggaaccacaatagctccgtcgatgaatggaaaacgaagcacttttaatgtgcatattagaggcctaaaaaaaccagagccaaacctcttaattactgtaaactatctacgatagaccaaaaaccagatgagaatcccacagcctttatggaaaggctgagagagacactaacaaaacacacctctttatcccctgatttagctgagggacagctcatcctgaaggacaagtttatcacacaggcatctccagatattagaaggaaactacagaagcaatctataggaccaaatagcacccaggaaaacctcctgaatatagccactttggtctttgataatagggatcaggaggaggcccaagaaaaagagaggaagcacaagagaaggacagaggctctagtggcagcattgcaagcttgcaaagtccaggatccccatggtgcatccactagctgttactgatgtggcaagtcagggcattttaagaaggaatgcccaaacagcaagaagaagccagctcaaccctgtccagtctgtgatggagaccactggagattgaactgctcccagagatggaggtcactaggttcagaaccagtctcactgatggtccagcaggactgatgagtcccagggctcaaccccctgctccagcagctcaaactgccattacagcacaggagctccaggtgtttctggaaattgaaggaaggtagatctccttctggatactggaggcaggctctctcttctctctaatccaggtctcccctcttcccatagcacaactgtaaggggtgtctcaggaaaaactctaatccgatatttttcttcacccctagctgcagatggaggggacctattatttacacatgcctttttactcatgcttgaaagtcccattcctttatcaggtagagatattctagctcgcaggggggccggcatccttacagccccaggacaaactctttgtctccccctggtggaagctaacattaatccagaagtgtgggctactccagaaagaagaggttgagctataatctctaggccagtccagattcatcttaaggatcccacttattttcctttctttctttctccttttttttctttctttttgagatggagtcttgctttctcacccaggctggactgcagtggggtgatctcagctccccacaacctccgcctccagagttcaagtgattctcctgcctcagcctcctgagtagctgggattataggcatgtgccaccacgcctggctaatttttgtatttttagtagagacggggtttcaccatgttggccaggccagtctggagcttctgacctcaggtgatccacctgtcttggcctcccgaagtactgggattacaggtgtgagccaccacgcctagtcaggatcccatttttttttcctaatcagagactatatcccctaaatccagaggctaggaaagggctagcagccattatcgataacctaaagatgcagggcctcctcaaaccctgtaatagcccctgcaacgccccaatattaggagtgcaaaacctcaataaggaatggagactagttcaggacctctgcctcattaatgaagctgtcgttccaatccatccaatggtacctaatccctttacactgttaactcaaatacctgagggaactaaatggtttacagtcctaggtttaaaggatgcctttttctgcataccgttacatcctgactctcaatacctgtttgccttcaaagatccctccagccagaccacccagttaacatggacgttgctgcctcagggattttgagataggcctcatctgtttggacaggcactgtcaaaagatgtctctgagtgttcccatcctcaaattagggtcttgcagtacgttgatgatactctgctctgtgccccaactaaggaagctcctcaggaaggcactgaagctcttcttaacttcttagctaacagaggatataaggattcaaaacccaaggcccagctttgcaaaacctcggtgaagtacctgggtttagtgctgtccaagggaactggagcattaggggaagaaatgattcagcctatttcttcctcccttctccctaaaacctcaagcaactaagaggatttggggacattacaggattttgtagactatggatacctgggtattgtgaaatagtccacctgttatataacctcataaaagaagctcagggagctaaaactcatctttattttattttatttttttagatggagtctagctctgtcaccaggctgtagtgcagtggtgcaacctccacctcccgggttcaagcaattctcctgcttcagcctccgagtagctgggattacaggcatgcgccaccacgcccagctaatttttgtatttttagtagagacggggtttcaccatgttggccaggatggtctcgatctcctgaccccgtgatctgcccacctcgacctcccaaaatgctgggattacaggcgtgagccaccacgcccggcctaaaactcatcttttaatctgggaacctgaagcttgaaaggcctttgaccagctaaaacgagccttgcttaaggcactagctctcagccttcctgtagggaagactttccatctgtacgtatcagaaaggaagggaatggccctgggagttttaacgtaagcttgacgagcagctcaacagccagtgggttacctaagtagggaacttgatttggtggctaaaggatggccagcatgcctttgagccattgcctcagtagccctactggtcccagaagcccccaaattaaccctgggaaatgatttaactgtttacaccccacataacatggcaggactactgtactctagggggagcctttggctaacaaacagtcgactccttaactatcaggccctgctgttagagggttccaacatccaattaaaaacttgtgcagtggctcacgcctgtaatcccagcactttagggggccgaggtgggtggatcatgaggtcaggagttcaagatcagcctggccaacatagtgaaaccccatctctactaaatacataaaaattagccaggcatggtggtggtgcatgcctgtagtcccagctactcgggaggctgaggcaggaaaatcacttgaacccaggaggtggaggttgcattgagctgagattgtgccactgcactccagcctggcgacagagtgagactccgtctcaaaaaaaacaaaaacaaaaccaaaaacaaaaaaattgttctcgcctaaatccagccactttcctccccaaggaaactagggaacctgaacatgactgtgaacaagtcctgatacagacctatgcagccagggaagatctcagggaaaccgctagagaacccacactggaccctcttcacagatgggagctcttttgtagaacaaggaatccataaggcaggatatgcagtagtcactctaaatgacgtcattgaaagtgtgtctctccgtccaagcactcaattagctgagctgatagctcttactcgagcactagaattaagcaaaggaaaggtagctaacatttgcactgactccaagtatgctttcttggttcttcatgctcatgctgccatctaagctttcttttaaatattttcagtat

SEQ ID NO: 527 - DNA, 23825 bp, Homo sapiens
attgctttctggagaagatggaattttcaaaattgtctgaagcaaaacttcctgctttttcctgattatatattacatgcccattgttgagaatctggaatattgggccaggtgcagtagcttacacctataatcccagcactttaggaggccgaagcaggaggatcgcttgagcccaggagtttgagaccagcctgggcaacatagggagatcccatctctgttaaaaaatatatattaaaattttgaaaaatttggaaaatgaggaaaagaatcaggagcagagatttagctattaacgtttttgcttgttcctgctttttatttcatgcatatataaatgtgtttttaattaaagttgcgcttatgttacaacaaattccaagtgagaaaaaagttggaattgtgttataagaaatttcagatgaggcctggctcagtggctcatgcctgtaatctcagcacttttgggaggctgaggcaggtggatcacttgaggtcaggagttcgagaccagcctggccaacatggtgaaaccctgtctctactaaaaatgcaaaaattagctgggtgtggtggcacatgcctgtaatcccagctactcaggaggctgaggcaggagaattgcttgaccccaggaggcggaggttgcagtgagccgagatcgcctgggcaacagaaggagactgcatctcaaaaaaaagaaaaatttcaaatgagaaaaaaagttatttaataggaagagggggagtaaattacctggttgcacagctctggagggcaccattcacactgtgttcagtagcaaacccagcgatcctgggttgaaggggtaagagcctccaggcacagtttaagaaactgataaaaagcctttgttttgtcatatccttcgtggccaccattccccctcccccccccccatttagttgttacatgcaatactactcaatttgcaaagctaatacaactggattctccactgtttttggtaagaaactatcagttcaactaacacagatactttttttttttttttggaggcagagtcttgtgctgtcacccaggctggagtgcagtggtacaatctcagctcacttcaacctccaccttctgggttcaaggattctcatgcctcagcctctcgagtagctgggactacaggcgggtgccatcatgcctggctaattttttgtattttagtagagacggagtttcaccgtgttgcccaggctagtctcgaactcctgagctcaggcaatctgcccaatccacccgccttggcctcccaaagtgtaggattacaggcatgagccagcaggcccggcttaactaacacagatacttttttttttttttaatacttttagggtacatgtgcacaacgtgcaggttagttacatatgtatacatgtgccatgttggtgtgctgcacccattaacttgtcatttaacattaggtatatctcctaatgctatccctccccccctccccccaccccacaacaggccccagtgtgtgatgttccccttcctgtgtccatgtgttctcattgttcaattcccacctatgagtgagaacatgcgttgtttggtttttggtccttgcgatagtttgctgagaatgatggtttccagcttcatccatgtccctacaaaggacatgaactcatcattttttatggctgcatagtattccatggtgtatatgtgccacattttcttaatctagtctgtcattgttggacatttggcttggttccaagtctttgctattgtgaatagtgccacaataaacatacgtgtgcatgctcacacagatactttttaacaacatgaccactttctaagttcattaccctttgaaacaaaataaaacaaaactcagctacaccatttctaaacaaaggtgtaaaaaaaaaattgaagatccagttagctaaggaagccactaaaagagttggaacaaaaggctctctccaaatggctatgaatttaagcctttataattcataaagaacatatgaattcaggaagaaaaatgtgcagtttatagttttatatagcattaaccctggaagttgctctcagatcttaaaagtcttcaaactcttctgttacttttacatatgaagatagcaacgtatttggttgatgatggctaagaaaacatctggcacagccatattaacaagggaatagtttgttttacgacagaagaggaagcttctgttctcggctaagagccatgtcctcagataccatggcaataaatggaaagcttgtcagtaagtggttgcctctttgtcttaaatttttaagcagtttagtagttagctccaaattaggaaattaactggcaatcaaagcattggagcaggaaaacccattatagctcttccaaatctccaaaaaaaaaaaaaaaaaaaaaaaggttagcattacgataactctttgtaggaagaggaatacagcagggcgcggtgggtcatgcctataattccagcactctgggaggctgaggtgagcagatcacttgagactaggagttccagaccagcctaggcaacgtggcaaaaccctgcctctactaaaaatgcaacaacaacaacaaaactagccgggtgtggtggcgtgtgcctgtggtcccagctactcaggacgcggaggtgggagaatcacctgtgaccagggaggttgaggctgcagtgagccaagagtgcgccaccacactccagccggggtgacagagtgagaacctgtctcaaaacaaacaaacaaacaaaaaaaattagaagaattgaaagaattgactggtagatggaaacatgctggaatctgttggcttgcttgcaggtataggggcctcaaaaggtatctccccatttagaacctttgtgtttgttttaccagtggctttaattatttctcagctcaaccccactgcttccctaaacactggatagtagtggaatagcttagtggtgacatcttataggcccaagaatagaaatagcaccggatcagttaactaagaacaaaatgtcattcacatacatcttgctgagatggtgaagaatattctccctttcttcggctttcctatatttctttaggagacctcttgtactgtggtaaattgtcaacatatctcatgtagttattctcatgcatgccatcttcctgaacagcaacagatactgtgaggcaggaactgtgccttatactttctcccccacagtgcctaggagaatgtcttgtacacagtaggttttcagtaaatgaaaactggatacattttaggaatcaagccaagggagtggccagctgtagcaacgatcaatgtggctcaactacactcaagagtatcccatcttcaggacaaaggacagtcaatcttgagccattctgaactgattatcatactcctaagtatcattgatttcatttggcattttcagtgaagatgtgggctttttatttatctctggaatattccatccagagtatttgggtttacttatagcaaaaaaaaaaaaaaaattcatttaaaaactgtttatcaaacatgagagcaaaatgtattatgtactcaagatggtgatttttaaattttttcgatttcattttaactattgttgaagccatccactgggagattttatggttttcaaaaaaaccatacttatatatgtataaaatatatataatatataaatatataaaatacatacataaaatatatatacataaaaaatataaatatttgttgagatggagtctcgctctgttgcccaagctggagtgcagtgttgctatcttggctcactgcaacctccgcctcctgagttcaggtgattctcctgcctcagcctcctgagtagctggtattacaggcgcccaccaccacgccctgctaattttcatatttttagtagagatggggtttcaccatgttgaccaggctggtcttgaactcctgacctcaggtgatctgcctgtctcagtctcccaaagtgctgggattacaggcatgagccacagtgcccagccaaaaagctgtagtttgaatgagtgttataatgtaaacagagatttgctgttgccaagtttttagagaggaatgttcctacgaagcatttagttctcagtgtgtccctccccttggatgtatattaaatgatcctgacagcttcagctgacatgagttttgaggaattccaagctaatctattaggtcatatctacagatactttggggatctcttgttaaacagttgggaagttctaaatatttccatgaaaaaactgccaggaaagagaaatctgctaataaaaaggagaatgacatagtttgagggtctacttattgtaaagcaagagaaagaacagtaactggagtaaaatgagctcacagctgtgatgaacggctgtggtggcttagctattgaggccaggctaagctgtttaccaccagattttgatacaaagggacactaccagaaaggatcctttggaaatacatggtggagttgcaagaaataaatcttcattcatgaaactggcaacctttggggcaatgctgaatcacacagagggggaaggcctgtcctttgcaaaagacaaaatggttttcaaccaactgtattagtctttagaaagttatgggcatccttgctttgcagaagtgtcagagtttccaaaagagatttctttcaccaggtggctacccactaataaaggccatactgcttctttcaaagatgacaaagtttaaaaggtgcatacagaactctgtaaatgcaatgatgattactgtttgtcaaatgtgtcgttgcttcctgcatgagtcctgtctccagttagctgtggcagtttctgagatgagctggcctctgtggaagacccactggtgaaaggtgggctggatacaggaccaaaaaggttcaatttgggggttcaatttggggaccccaaaatgcctgcggtcaaagcatgaggacaacaaagagttgccccttctctttttcttccgttcctcctcctcctgcttcctgtgtccttcttgctccacttctctcagctccttaccagaagcctgacttaggggtccagtacctgtctgtttccatggaacaatctctgacaagttaaccagccagtcagttgacttcctattccctaggctctcctcttccctaggcaagttgcccttcctcaactcttaaccattactggaaggtagctggaggaaatgagaagctgaggagaaaccagtgcctttttctgtgtttaggatatattaagcataagcacaattagtagttttatctgagaataaaagtatcctaaatagatcctggctgtgtgatttcaggcgctcgaggagtgccctcctggaacgtcagtttccttcctcaaagccccgagggcaggttcttaacactggctggaggtcaaatagggtactgactatatttccatttcaccagcgaactccaaggtcaaaaacaaggctacacctgacagaacatttaaaaaagaattacactgctgtgcaaatacaaagaagtgtccactgattttcaccaaccctgggtgcactgcctatgagttagcccagctcctcaaggaaatttacgattaaaaaataattcattgcctttccaccttccagcatagtacttcaagttgagatgctcaccggggcctcctaacccctctctttggatgcaacccctttcttcctaggtggtccatcctacaggactgttaaaccaatatttcttatttgccattttgaatcctcaaggattcactgagtgcctactctacaccttcgcttgaaaactttcagagatttcctgtattctgcttcatgcccagctccaccttcccatctaaacattgcccacttaccctaagccttccagtcttgccaacctccaaagcaccatgccatggggcctaaaatgccctcttctctcccctctgagcctgttcaaactcagctcagtctctcgtcctgggttttggtgtctctccagggtaaaggggtggggagggtgccttcattctgactggctcccagtgaggcagccccccttgaggaagaggctgagatgccaagtgacttgcctggagtcatttgccagcaggcgatggaatagggactacgagacaccctgcagcctctcctgggaggacaacgccccttctccctctccatgcactcttgaggcagcaaagaggaggcatctggacgcgtttacctcctccccacccccacagcttggccctcactaaactatcttgtgtccttcctcctgctatgattgattcgcccaggaaggtggggcttcatctttacctttcaaatataattctttagttctcctaattacaaggtggggggtggggggtgggggtggggtgaggcggggggtacaaaacaaaacaaaactccatgaagcaacttagaaagcacgaccgcaaaggccctccatcatccccacccagaggtgaggacaaggtctgggggtgctgggtggcttcagaccttccacgggtccaagctatctgcttcaagagggcatcgaaaggtaactcatagacttaccgcccccgccccccgacttttgcaggagggagcgctctcccctcctctgggaggctggagactcggggacagaagatgcgctggagggaagagaacggagcgtcggacaccagaaaaactttgggggattcggggtgagaaagaaggcgtgaagagagaagggaggctcagcaggggaggaggggcgggggcgggggcgggagcgggaggagtcactgcgccgcggccgcccctccccgccctccactcggcggccccgggtcttcctccccctcctcctccccctcctcctccccctcctcttcctccgcctcctggtgtggctggctgcggccagaatcggagccccaaccgcgctgccggtgagtgaccagccccaggggacagagacgggaggcctgggaccccccctctccagggtggggcctcccgccgtgtctgggaaagtttgcgggcgccccgggacgcgggcatctccagggccgctcggcgcctccccatctccccgcgcccgccctggccgcccccaggggcgccctggggcccgcagagggatggcctcccggcagggactcctcggctcccctctgttctgagactgctgctgggaccggggtccgactctaaagagaaaactcaaacagcaaaaaaaggaatatcgactcagttccgagggcgggggccggggctcgttctcacccgcgcgcggcccctcgacctctcggacccgggccaccagctctgcgcccctcacgcctccctcggggtctctgtgtctctctcccgctcccggactccctcctccttctgactgctgttatttgggctgttgtccctccccgctccctggtacctcagctcggaccttagcctgtgcctgcagcccggagtcccctcctgccctggaaggcaaggagccaggccacggggccacagccgcgggggccaccacactggcccaaatatttcctgcaggtatgaccattcactgggtattggggttgggtcccttggacccacaaactgaacctcgtgggtacagggaaaaattaaaatatattcctccttaggattgtactgcttctgttggtttggcatctttttatttttaacccttctaactgtgctttcttcgaataataatgatacttcatgtaattagcgtttctaatatctaaagacagaagaaggaagaaaataaacggaagagagagaatgcttgctaaaaatactcatttttgacttcagtccacactcgactgttttcctgggagatagaagttcagtgtagcttgttttcagactaaccgcaaacacgattacagcctcctccaggctagaagttttaatttgcctgacatgcagcacactgtttgttggtattcccagcctggcattcccgtctgcatagctctagtctccctcccaactcccccacccccactttctttctcataaaagggagctgtgaaaacaaggcaatgggagaggctcaaacgagctggaccacataataaaaacagccctacttattttaatcctgaggctatggactcccctggactctgattgggtggaagaattgtttagttcatttgtgtggtttttctgtcagtagttattatggttgaatcagtgtttccatgacagtcttgcttctgtgggcacgatggggagcctgttaattctcggatgggtctggacagatcaagtctggagtctggagagatttttcagggcttgacctgggctgatattgcaaacctctgcacactcactcagaaccagagcagccgggagcagcctgagctggggttttcttccacatgatctgggaagaaaaagctctaccaaggagcgaactgtgtgagcatggttgctgggggatgttgaatgttttacgtttttaggaagaacacacttctcaaaactttagccattcctgtttccatacaaacaataaatgtggttgtaacaaatgtagtagatcagattctgaacaaccccttaaaaaacaggtccaagtattgaaccatttggaaataaagattttattttatttgaattctactggaaataaaagagtttatgttaaaaaggatgtaattcacttctctccactgatgcagtttgacagttccccattggtatgaatcagttaggttttattgtggtctcaaaacatcattaaggcagggcacaacatcattaaggcagggcacggggttcatgcctataatcccagcattttgggaggccggggcgggcagatcacttgaggtcaggagttcgagaccagcctggccaacctgatgaaaccccgtctctattaaaaatacaaaagctagctgggccaggtggcgggaacctgtaattcccagctacttgggaggttgaggcggaagaatcgtttgaacctgggaggcggaggttgcagtgagccgagattacaccactgcactccatcctgggcgacacagcaagactctgtctaaataaataaataaataaataaataaataaataaataaataattgataggcaagtgttgtgactgtgacttccattcaaaaagtaagtccaaaaaaaaaaaaaaacaacaaaagtaagtccataaattctgagcttgtttggccctgttgcttagaaaaacaatgtactgtgctcagataaaaatcttcagtctcttcctcttcctgagaatttttaatagtgcatttaatatcctgtaagtcaaccttatactgtttacagaaaagttgcctttctgccttgtccagcttttgcactatctcatgaaatattgttagactggatggtttgccacgggtacaagagtctgcccagcagcccgaggagaggctggggttgtaatgaaggccacgggggcctggacctaaggagcaggtggtctggatggtgagatgaaggctacatccccagacagccacagaaagcagccactgatcacctggacaggtcagatgagttggaaatatcaatacatgaagtgtgggaccagtggagagcaaggaaggcagaggtggttaagaagcaaaatgatacaaataaataaaaaaggaaaaggccaggcacagtggctcatgcctgtgaagtgctaggtgtggtgattcatgcctgtaaccctagcactgtgggaagtggaggccagaggatcacttgaggctaggagttaagaccagactgggcaacaaagtgagaccccatctcttaaaaaaaaagatgggccgggcgcggtggcttccgcttgtaatcccagcacttggggaggccaaggcaggcagatcatgaagtcaggagttccagaccagcctggccaacatagtgaaaccccgtctctactaaaaacacaaaaattaggtgggcatggtggcgggcacctataatcccacctactcgggaggctgaggcaggagaatcacttgaacctgggaggcggaggttgcagtgagccgactgcaccactgcacttcagcctgggcgacagagcgagactccgtctcagaaaagaaaagaaaaaaaaagatgtaggccaggttcagtggctcatacctgtaatcccaacattttgggaggccacggcaggtggatcgcctgaggtcagaagttcgataccagcctggccaacatgatgaaaacctgtctctactaaaaatatagaaaattagctgggtgtggtggcaggcacctataatgtcagctactcgggaggctgaagcaggttgcagggagccaagattgtgccactgcactggagcctgggcaacaagagcaaaactccgtctcaaaaaaaaaaaaaaaaaaaagagataaaagatgtaaaataacccaaaggaatactctgtgaccttttaaaatcatgttgtataagaatgttgaattacacaggactttttttttttttttttttgagacaaagttttgctctcgttgcccaggctggagtgcaatggcgtgatctcagcttatcgcaacctccacctcctgggttcaagcgattctcctgcctcagccacccgagtacctgggattacaggcatgtgccaccatgcctggctaattttgtatttttagtagagatggggtttctccatgttggtcaggctggtttcgaactcctgatctcaggtgatccgccagcctcagcctcccaaagtgtcaggattataggtgtgagccactgtgcctggcctggggttaatttttgaaagcaagttataaaatggaaagcactataattttactctttgaaaatacatcgagaaaatactggaattatgtgcatcaaaatggatggtgagagtatagctgtttttaaattttctttgtacttgtatttctcaacttttatagtaataatagctaacatttactgagaactaagcacttacatatggtattttattcgaaaactctttgaggtaaatattactattattttcattatggagtttcagaaactagaaccagaagggtaactcatccatggtcacacagccactaagtgctggaatcaagtgttgaattcaggtcggtggctaaagtctatgcatctctgtcactactgtctaccatctccctgcacatgtattattattattttaattataaggaataagtagaaaaggaaagggaaaatgtttcatgctttagtaagaactgatgggcacagtggctcatgcctataatctcagcactttgggaggctgaggtggaaggatcacttgagcccaggggttgaagactaagtggcacaaattagtcaggcatggttgcacatgcctgagtcccaagtactcaggaggctgagctgggaggatcacctgagcctaggagatggaggcttcagtgagctatgtcacgctactgcactccagcctcggcaacagagcgagaccctgtctcctaagagggggtgaggagggagaaaaacaaaaacaaaaacacactgatacgtaaaatggaaaatgcctcccatctcttccagctccgccagtcacttctctttagaagtctttggtaactgctccagatttagaggtagctcaccccttccttgcaaaccagctccactcacaagaagaatcccgaattccatggaggcttcctggccagcctggaattccaggtaccttatgggattctggagcagtcctcagtacagggcaagatttttaaagtagatcaggcaaattatgtcttcagagctctgcagattacagggtgtcatcattctttgcagcgtcaggagagtgtgataggtagaaagacccagggaaagcaccgaggctcaaatgtacctgtgtgttacatggaatgccaggggaaataaagggtttaccatggaataagaaagagaaaaaaaaaacctcattgctggatgcttattactatgaacacacaacaataaattatctttcgaaagcttgcctatgtgggtgatcccatgcattggtgagtttgactgattgggtgaggtggaaatatttagtgtgagtgattctggggagagctctgggaaaaaatgcccacatcctgtactaccatgtcccctcacaggcaagcagctcctgggatcactcatccattctctttgtggaaggtaccttgagatccccagaaggatcagcattcttagagcccctggcccatcacataacaaacatgccttaagaagaaggctttcagctgggcgcagtggctcatgcctgtaatctcagcactttgggaggccgacgtggggggatcacctgaggtcaggacaagaagtctgatcacaaatgattgtcattttattataatctgccttctccctggtagcttttaaaattttctctaaaatgttccacaggtatgtctaggtatggatttagaaaattttatcctacccagcagtcagtgagcatttgtgattacacaaatttgtgtagctgggcacggtggttcatgcctgtaatcccagcactttgggaggctgaggcgggctgatcgcttgagctcaggagtttgagaacagcctgggcaacaaggatgagaccctgcctctacaaaaaatataaaaattagctgggcatggtggtgtgccctgtggtcccagctacttgggaggctgagatgggaggatcacttgagctggggaggcagaggttccaatgagctgagatcaggccactgcactccagcctgggtgacagagcgacactctgtctcaaaaaataaatcaaaaaacctaaaaaccaaatttgtgaggatttgtgattacccagtgagctgtgtgaccttgggcaagttgccaagttctctcagtctcctcatctatgaaatataaataatgatagtatctattacaaagatactgtgaagagatagtgcatgaaaatgtcagaatacgccaggtgtggtggctcacgcttgtaatcccagcactttgggaggccaaggtgggcagatcacctgaggttaaaagttcgagaccagcctggccaacatggtaaaaccccatctttactaaaaatacaaaaattagccgagtgtggtggtgggtgcctataatcccagctactcgggaggttgatgcaggagaatagcttgaacctgggaggcggaggttgcagtgagctgagatcgtgccattgcactccagcctgggtgacagagtgagatgccatcttaaaaaaaaaaaaaaaaaaaaaaaagttagaatagtacctgctatataaggaagaacgcaaaaattgttagctattattacttttttattttttcagaatttctgggccatcttggatttgaccaatttatataaacgttagtttgtctagttgcacacacacagaaaatcctgttgagattctctttgaaattgcattcaattaatactgacatctttacagtgctggcttttcctatcttctccttttattcaggtgaatgattactggtgatttcccctataaatgtcttctacaacttttgctgtatttatatcttatagatttggttgatattttaaacaatatcttttgtcctagtatattctctagtttacttgctggcccatagaaagaaacattgctgatttttgaattttgtttttttacccagcatcccagctgattctcttattagttctaatagtctgcatatagataattcttgaattttctatatagacaatcataaaacaacgataatttatcttttccatttctgtgactcctacatctttttcttaccatactgcattggggtagatggtccagtacagtgttcaatagaactgtgatgacaggcacccttgccttgtcttcttactgtctttaactttaactgctcttaaagtttctccattaagcgtgaagtttgcttaaggtttcagtagatagtctttattaaactaagaactttgctctattcttaatattttttaacaaggtaaaaattatatcatgacagtatatattttacttaatgctttaatgtctttttcataactatatgagatgatcattttttcttgatattacattgtgataagatgagcgtattaattgtgttgaaacatgtacataaatatacatatacaggtatattattctgtagggtatcggttgctagtattttactttggatttttgcaaatgttcataagtgaagttgttctagaattttctttttaaaatattggtctggctgggtgtggtggctcatgcctgtaattccagccctttgggaggccgaggcgagctgatcaactgaggtcaggagttcaagaccagcctggccaacatggcgaaaccctatctctactaaaaatgccaaaaattagctgggcgtggtgacatgcacctgtaatcccagctactcgggaggctgaggcacgaaaatcacttgaacccgggaggtggagattgcagtgtgctgagattgcaccactgccctccagactgggcgacagagcaagacttcatctcaaaaaaaaaaaaagaaaaaaaaaggaaaaaaaaaggaaattgttcttatattgtttggtatcaagcttgtattggccctataaagtaatcataagtatatgtctttctttatcttttttttttcgagacagagtcttcctgtttcccaggctagagtgcggtggcatgatcttggctcactgcaacctccgactcccgggttcaagcaattctcctgcctcagcctccttagtagctgggattacaggcacgcgccaccacgtgggcccagctaattttttgtatttttagtagagatggaatttcaccgtgttagccaggatggtcttgaactcctgctctcatgatatcccctcctcggcctcccaaagtgctgggattacaggcatgagccaccgtgcctggctggcatatatgtttttcttaactagtttgtaagagataaagattatctgtttcttaaaatttggtaaaactcattacgaaatcatctgaaccacttataaagggcatatgggtcaagtttttggtgattcagtttcataaatgattagtgatgaatttaggctttctattccttcttgattcagttttgataatttagtttagatgatccattcatgtgttcttgggcttcttagcatagttattcgtaattttctcttagggttttataaatattgcctctatcttttttgttttttaatttttttattacctttcctatggtgctgagaatctagcttatatttcttatttatttatttaagacagagtctcactctgttgcccaggctggagtgagtcatgcgatctcggctcactgcaacctctacttccagggttcaaacaattctgttgcctcagcctcccgagttgctgggattacaggtgtgcgccaccacacccagctattttttttttttttttttttttttttatattttctgtagagatgcagttttgccatgttggccaggctggtctcgaacttctggcctcaagtgatccgcctgccgcggcctcccaaaatacttggattatagggatgagccactgctctcggcctatttattgattttttagagatgggatcttgctgtgtcacccactgctggagtgcagcggcaccatcatagctcactgcagcctcaaactcctgggctcaagctatcctcttgcctcagcctccctagtagctgagactacaggtgcgcaccactatgcccagcaaagttttgtattttttgtagagatggggtcttgctatgttgaccagactggtctgaaactcctgtcctcaggtgatcctcttgcctcagtctttgaaagtgttgggattacaggcatgagccaccactccttgccctttttttattcttaatattgtttatttgtgccaactctctttttctttattaatatagatgtctactacttaatcttttcaaataaacagcttgttcttatctatatttttgtttttcattatttttacctttatctacatttcttctgtttctagctacttgaattcatgcctagcttactttttgtttttcagtaaatttatttaaatctataaatttacctctaaatactgctttagctacatcatgcaagttttaacccatgtgtggtgttatgatatatgttttcttttttgagatgggatggagtctcgctctgtcacccaggctggagtgcagtggtgtgatcttggctcactgcaacctctgcctcctgggttcaagcgatcttcctgcctcagcctcctcagtagctgggactacaggggcatgccagcacaccaggctaatttttgtatttttagtagaaactaaagttcctgggctcaaacgatcaatgggcctcagctttctaaagtgctgggattacaggcgtgagccactgtatacatttaaccttatttcttgcatgtactacacgcctgatttcaaattttataggccactcattttctactctttgcccaagcagatgacaaggtttctggctgttttctcaggttagtaaatgatgttcctctagacctatttcacatatggagcagctttttatgacctccagctttttgtaagtgcctcactaacagctcatggtgtaaggtgaccatctcctggaccccctcactgcatgtatggtcattaaagccccagctcgcaggtatttaggcctcttgctgcggtggatttctctatgagccccttggcctcagcttccatacattgacctaacttccacttccctctgtttctggtacctggagatttctactttatctaggttttagatgatatttttgttatcatatttttgttcagtgttttgaagtgtttggatgggaggatgtggtgttatgatatatactagtttttatccatggttcctggctcataacaccccacagcccttgttacagtttttgttgttataatactgggtgtgttaggcctcagaggcagccctctgaccttctgccctcctttcacttaccccaaggcaggactctaatgttccgcctgtgagagtgttgatgcacccaatgccctggaggaaggaatgctgacattgtgaagcttccataaaaacccaggaggaccgggttgatggagcttctgaatagctgaacacagggaggttcctggaggatggtgcacccaggcagagcatggaagggctgtgcccctttcctcatactgccctacacatccgcttatctgtatctttcgcagtattctttatagtaaaccagtaaacctaagtaactttccctgagttctgtgagctgctccagcaaattcgctgaacccaaagacggcgctcttgagcctcaacttgaagtgggtcagtcagaagttcctgaggctcagacttgtgactggcatgtggggaggggcagtcttgggaactagccctcagcctatgggatctgacactatctcagagtagatagttcattagaggacacccagctggtgtctgttgcttggtgtatttggaaaaagcccccacacatttggtcacaagaagtcttctgtgttggtgattattatggtgtgagagtggaggaaaaacatggttagagagtttttcctatacagagggatatttctacccaatccgtcatactgactgaggttcttaactcctaattaacttaattaaattaactcctaatttaaaagtttattttgggccgggcacagtggctcacgcctgtaatcccagaactttgggaggctgaggcgggcagatagcttgaggttggggagttcaagaccagcctggccaacatggtgaaaccctgtctctactaaaaatacaaaaattagctgggcatggtgttgtatgactataatcccagcactcaggaggctgaggcaggacagtcacttgaacctaagctggggcggaggttgaagtgagctgagatcctgctactgcatcccagcctgggagacagtgtgagactccatctcaaaaaaaaaaaattattttcttatatgtaaaatagaatacagcgaagtcggccgggtgcagtggctcacacctgtaatcccagcactctgggaggctgaggcaggcggatcacttgacatcaagagttcaaaaccagcctgaccaacatggtgaaaccccatctctactaaaaaaaaaaaaaaaaaaaaatacaaaattagtcgggcatggtggtgcacgcctgtagtcccagctacttgggaggctgaggcaggagaatcacttgaacctaggagatggaggttatagtgagccgagattgcaccattgcactccatcctgggtgacaagagtgaaacttcgtctcaaaaaaaaaaaaaaaaaaaaaaaaccacacaaaaaaacagaatacagcaaagtaaatacatgtacattggctcctgcatgtgaaatctcctgctactaagagaatgcgggagagaagaggtctgaataaataataccgtgtgccactgccaccatctggaaccctgcacgcttactgcggtgtctcactctcatctggccaatgttttcagtccagaaaagatctgaatttcccaaccatgctgctccagtccctaaatgctgtcctttagattctctatagtagatcaaaacctcatgctcaactagcatcttaactcacatctatgttgaaaagaaaaaacatgtggaaaagttcctgttgtccttggatatgaagacgatgttctgtttctgctgggcatgcatgtgtacgtgtgtctctaacagtgcagaggtttacagtgagcaattgattctttacttgtggctgattccatctctgggaatgttgatccatatcagtggagcctatttataatgctgaaagcagtctacacaaagatattttccccatagtcattggccttctcctctggcccttttaagagctttatcagtgtccttctatcagtgacaatgggaaagaaatgggctttggagtcaagcagatctgggtttgaatctaagctttgccactaattagatatgtggcctttggcaagttacttaacacctctgagtctaaattgtcttctttataaaacagtaataacaaaatccacctcaaaaggttgttctgaagatcaagtgagataactggaaataatataaccttattataagcattatgttaatgctcacaaatgttagtttcctcccattatctccactctcctattcttattctttcaaagtagaattgtgcttcaggaggtctaatcaggctaggcatggtggctcaagcctataattccagcactttgggaggccgaggtgggtggatcacttgaggccaggagctcaagaccagcctggccaacatggcaaaaccccatctctacaaaaatacaaaaattagccagacgtggtggcacatgcgtgtaatcccagctactcaggaggctgaggcacaaggattgcttgagccggggaggttgaggttgcagtgagccaatattgcaccaaggcactcccgcctggacaacagagtgagactctgtctcaaaaaaaaaagaaggtctaatcagagacacttttggggagtggccgtggttactcctaatatcttgactttttttttttttttttttttgagatagagtctcactttattgcccaggctggagtgcagtggcatgatctccactcactgtaacctctgcttcctgggtttaagcgattctcctgcttcagcctcctgagtagctgggattacaggcacctgctaccatgcccagctaatttttgtatttctagtagagatggggtttcaccatgttggccaggctgatctcaaactcctgacgtcaggtgatccgcctgcctcggcctcccaaagtgctgggattacatgtgtgaaccattgcacccggccatatcttgatatttttggtaatcaatttagatttattttgggcgaatttcctgaaactttttggacagccagtttattttgcttctgtaccagctgttatagccctcccagcctattgttggatctttctgtagagtagctatgttgttacttaagaaccatgtccctcttaaccagaaatatctctttgccttatttgttaatgctcctgccttttaggagataaaaactctttatttcatttttaaagataacttttttttttttttttttttgagctggagtcttgctctatcacccaggctggagtgcagtggtgggatctcggctcactgcaacctttgcctcctgggttcaagcaattttcctggctcagcctcccaagtagctgggactataggcatacaccaccatgcctagctaatgtttgtatttttagtagagatggggtttctccatgttgaccaggctggttttgaactcctagcctcaggtgatccgcctgcctcagcccctcaaagttttgggattacaggcgtgagccaccactcccgacaacgataacattttaaatgaaaagaccccagagagactatgtaacatgtaaatataagctagatccacttctgggactaggttttcccaggagggatcatgaagtccccaagtgattgaggagtaggtgggggtagggaatcaccaaaggggtggctggaggagatagaagaactgaaggtatttttttgagaattttacaagacctaaaatctgcctgtttcacaacagtcatttatctgggccctgtggaatctgtatttggctcagaacatgttgctttttgcaagtatctcatcagaaataataataatgatgatagctatgactattcttttttttcttctctggattttgtgtgtgtgtgtgtgtctgtctgtctagacctctgatcatgacttcttaaggagaggaaaagactatcatgaaaataaaacgtaattggaattatggatttgccttcatgtaaatatctgtggctcagagcacaaaaatagcttttccattgcagagctaagtcaggagtttcatgagaaattgagcattgatgatctaatttaaaacagctatggcccagaaattcagagaaagggctgacacattggcctctgtttatacctttgaatattttcttcctagcttatggtaactcatattcagggacagtttggagggatgataaggccataagtttttttggtttgttttcgttttttgttttgttttgtttttttgagacagagtcttgctctgttgcttaggctgcagtgaaatggcatgatcttggctcactgcaacctctgcctcccaggttcaagcgatcctcctgcttcagcctcccgagtagctgggattacaggcacccaccaccatgcctggctagtttttgtatttttcgtagaaacaggggtttcaccgtgctggccaggcttgtcttgaactcctgacctcaagtgatccacctgccttggcctcccaaagtgctgggattacaggcgtgagccactgagcccggccataaggtttgatgctacaaaccttgtttttgttggcattggtttaatgttaacacgaacgtagagaaaaattttaatctcaatcctttgcaaccaggaatccctcctagtgtagctccaggcctgttgctcatttgtggcttgaggcagagccttatacattttgtgaaactcccggtgactcttgttagtcttggtttcagcagagggtgcctaattgaggtcattctcagcagcacactggtggtcaggtgctcctgattttcagaaaaaattaccttgtttaaaaaaatgtgatcaggctttcctgggaattgtctgataggcttggacttgcctaggtcaacatttttattcggtaaggcaggaaattgttgttttaggcatctgacatcatctttatcaatcacctgactataaactccaagtgagaatggctttataacacatgtgatggggtttcgccagctttcaacagcccctgcttgtcggtattggcctcctctgcacccacatattcccatctctgccagatgttctgacttaactgctcacatgtgtgcaaccacacgggcgcgcacagaccccggccagacatgtgtccctgctacaaactcctgcccctagcggctggcttgctgtctgtctaaccagaggggccatctttccatgattctttcgagggctgcctcagtcactctctgcctttggagacggagacacagaatctcctcaccagacaggcgctggctcctttagtggtttcctcatctgcctgtgctcctcactctccatggctatgtatcacctagttcctttaaccttatccttcctggaacttttctgtttgtcttctgatttgttactttgcttggacttgacttctcagtccttcccagcactgacctcactttgtttaggacttctctacctccacccctttgtgatgtatgtggctcaggcattcagcccccacttaatgagcagctgctctgtttcaggtacctacatatcacaattggtcatgatgctaaggctgacattactttctggggccaccaagtcactgtggagaatgatgagggtgatgttgcagttctgcaaagctttggggaaatttccccatgctgtgggatatgtatatgaaaaacaattctttctctcctcttatatttcatacttaaaaaataaatgtgtaggggcagagttgtcaggtttcaaccctcatgtcttacctgagttcctgccatagcctcctatctgacattcttgccattggccttgccatcttccggtctgtccttcactctttctaaaattctgatttgaccctgtttattgtctcttttaagtcttttcactgcatcctcattttcttttggataaaatcaagctctatcgtgagacagaatggcttcttcgacctcacttgcctgtagttctctccctgtgtcacctgcattaactcctggctccagcttggctgtctccctgcagtcaggctctctcctgcctccctgtctttgcacacacactcagctctgtgcactctgttctgcctgagcatatcagccttcaagatttagctctgaagctcatgtttccatgaggtgtttggagttctccaggacctgcatctttgtccccccatcacagttatggacacttgccaccatcattcctgccaatcttgattaggcatctggctttgtgtcccacagaacactggatttgtctttgtcacatgaacaaagtacttcagaattgtctcctagacagaaaatgccctaagctaaaggactatgatgtgtttttacttgcagcagtgtatagcatagttttaagagttgtcagttattgctattgctgttgaatgaatgcatggaagaattattatttttagagatggggtgtcttgctatgttgcccagtctggtctcaaactcctggcctcaagcaatcttcctgctttggcctcccaaaatgtggggattacaggtatgagctgctgtgcctggctatacaagaatcaattcacacacacctttcaccacattgcatgaacacacaccaagacatagatcccaatgggcagcttacttcaaatcttactgagaatatttacaaagcacatagtaggtgcttagtgagtttctgttgagtcaaataaagaatgaatgcacatccacacaaactatggaaaatatactcagaa

SEQ ID NO: 528 - DNA, 24207 bp, Homo sapiens
actatccacattctccactgaatcctctaactgttactaattctacggaaatttgtggaaattaataaaaccttgtggaggccaagggaaaacttccccttcatctgaatgttcacagaaaatcaactgaaaaaagacagctgagaaataataagagaaaaggcatatgaacttattaaagtgcacaggagttttacaaaacataagatctcaaataaatgaccggatggttgacgcttttacaccatcttgagtttccagaaagaatgaggcttggatcagtggcaaaatggcttatgggaccagagaagaggtggcctgtctagcgaaggtggtcttgttacatggatggaccctcacaggtagcagtgctcagagacaatagatgtaaatgtttcaggcctttagaaacatcagaccctcagttaatcatccctaaatctggacaagggaaggcctcagagaaagcctggctgcatcaatgcagatttttctctacaggtgcaaatcttcttcacaaaagacagcttttcagctaaatttgtgtttccagccctcctgaacagccatcttgaaacatttcaaagaagtatattttaggctaaaatattctggctacctttgtaatctgagaagccaaaatagatatctctttatcgaataagatggaccccaaggctaaggcaatgaaaagttacctacaggctgagggctccaaggccttgctgccacggcaactccctaaattcctttggctacagcaaaaaccacaggtttgctaaactccctaacaataggaaacatcaggcaaaatgtcaggcccttcctaactctgatttacgacctctcttggtgtctggcttgggacccctttccggtaacaatcctgttcattctttggatgacactttcaaccttgcatgtacaatatgatatacttgccctgtttgatgaatcgtctaacttgttgtttctcaacctgttcattttttattactgctggccctaaaaacttttatgtggcattatttctgagagctctgttctgttccattggtctgtatctctgttttggtatcagtaccatgctgttttggttactgtagccttgtagtatagtttgaagtcaggtagcgtgatgcttccagctttgttctttttgcttaggattgacttggcagtgtgggctcttttttggttccatatgaactttaaagtagttttttccaattgtgtgaagaaagtcattggtagcttgaaggggatggcattgaatctatgaattaccttgggcagtatggccattttcacgatattgattcttcctacccatgagcatggaatgttcttccatttgtttgtatcctcttttatttcattgagcagtggtttgtagttctccttgaaaaggtccttcatgtctcttataagttggattcctaggtattcttttctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatgcgcttttctagatatacaatcatgtcatctgcaaacagggacaatttgacttcctcttttcctgattgaataccctttatttccttcttctgcctgattgccctggccagaacttccaacactatgttgaataggagtagtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaaggattgttgaatttcgtcaaaggccttttctgcatctattgagataatcacctttctctcctcccctggatattatgaatcacatcacaaggaggtgtaccccctaatgatatggggagtaatatcatgtctctcccactggatattatgaaccatatcacagggaggtggacacccccgcaatatggggagtaatataattcttcttccctctctagatattacaatctatatcacaggggtgtgtacgcccccacgatataaggagaaatatcacctttctctccctcactggatattatgaaacatatcacagtaggtgatgaggaaagaggatgatattacctccaatattgtggggagtgtacatacccccttgtgatattgtttctaatatccagggaaagaggattatattactctcaatattgcagggggctgtacaaccaccctctgatattttcctaacatccggcgggggggcggggggcggaagacgatgatatccagagggggagatgatgatattactcttaatatcgcaaggggtgtacacccccctgtgatattgtttgtaatatccaaggtggggagacgatgacattagtcctgatatcacagggggtgtacaccctcctgtgatagtgttggtaatattaagggtgggagagtataatattatttgcaatattgcaggggatatacacccccctgtgatattgtccgtaatatacagaaggaaagaggatgatattattcccaatatcccagggagtgtacaccttcatttaatgttgttcttaatatccagggtaggagaagatgacattactcttaatatcaggggctgtacacccccctctgacattgttcgtaatattcatggagaaagaggatgatattactcccaatatcctgaacaccccatgtgtacaccaccctcttgtatcgttcgtaatatccagcaggggagaggttggtattactctcagtatcgcagaaggtgtatgccctgctgtgatattgtttgtaatattcagggaaagagaggatgatactacttccagtctcgcggagcatgtacaccccctgtgatattgtacctaatatccaaagaatgagaggatattattcctagtatcacaggctgtgtacattcctcctgtgatattgtttttaatatccagggggcgagaggatgatattaccccaatattgcagaagggtatacacaccccgcgatatggggagtaatatcacccttctctcccccctggatattacaaacaatatttattgggatattgtttctaatatccaggcgaaaaaacaataatacttccaatattgcagggggtgtacaccgctcctatgacagtattcctaatatccacggggggagaggatgatattattgccaatatcgcaggagctgtacactccccctcttatattgttccttataaccgggggggacgggatgatattagtcccaatgtcgcagagggtgtacaccgcctctgtaatatccacgggggaaaaggatgatacaattcccactatcgaagggggtgtacccccctgttgtattgttcctgatatccagggcgtgaggaaatgatatcactcttaatatcgcagggtgtgtacaccctcacgttgataatgttcgcaatatccaggggaagggaggataatattattcccaatattgcaggggctgtacgtctcccctgtgatgatgttcctaatatccaggagggtagaggatgatattactgtaatatcgcaaaaggtgtacaacccctctgtgatattgtttctaatatccagatggaaaggggatgatattacaacaccctgtgatattatttctttttctttcttcttttttttttgacagagtctcactctgtggcccaggctggagtgcagtggtgcgatctgggctcactgcaagctccgcctcccgggttcacgccattctcctgcctcaacctcccaattagctgggactgcaggtgcccaccaccgcgcccagctaattttttgtatttttttttagtagagacggggtttcaccctgttagccaggatggtctgtatctcctgacttcgtgatctgcccgcctcggcctcccaaagtgctgggattacaggcgtgagccactgcacccggccaaagaatacattttaaattagaagaaatcatgtaagtgctattcttgaagtttcttattttaatttgtgatttaattaattcagtctcataaataaactcaatgaggaaggaagaatgtggaactgacaatgtaagttgcttacataaatcgcctcatatggcttcagactgagtctctaaattgagaagatcttaatgcgtgacaattagctacatggtagagaagaaactactcaatgaaaatttatttctatttcttgagccaaaatttgaatgattgtccttatttatggtagcccagtagaaagattccaagggtttctttcctttctttgtttttcttttcttctacatttcttccaaaattaacttaaagtaactcctgaggttgtatataggatagtagaaagcacactttcataacgttgtttggaaggtcaattatatgatgaatgcaaaatgctgggattttgcattttgtaatgacagttacaaaacactgccaaaataaatcagagatgacacaaataaatggaaaaacattccatgcttctacataggaagaattaatattgttaaaatgcccatactgtacaaagcaatttacagattcaatgctatttctaccaaagtaccaatgtcatttttcacagaattagaaaaaactaatctaatgaccaaactaactgaaaggtcaaaactaaccgaatggccatatcaatctcaagccaaaagaaaagagttggaggaatcacactctcagatttcaaactgtactacaaggctacagtaaccaaaacagcatggtactggtacaaaaacagacttatagaccaatgggacagcttagaaaaccctgacacaaagctgcacacctataaccaactgatctgacaaagtcgacaataacaagcaatggggaaaggattttctgttcaatacagacttcaggataactggctagccatatgcagaggattgaaactggatgtctttatttcaccatgtacaaaaatcaactcaagatggattaaagacttaaatgtaaaacttaaagataaaaaaactctagaagaatacctacggaaataccattctggacataggccttggcaaaggtttcgcaaggaagactccaaaagcaattgcaacaaaaataaatattggcaagtgggacctaatttaactaaaggccttctaacagcaaaagaaactataaacagaataaacagacaatgtagagaatgggaaaaaatttgcaaaccatgtgtccaacgaaggtttaatatccagaatctataaggaacttaaacaaatcaacaagccaaaaaaaggaattccattaaaaaataggcaaagggcaggaacagacacttctcaaaacaagacatatgtgtggtctacaagcatatggaaaaatgcttatcactaattattagagaaatgcaaatgaaaaccacaatgagataccatctcacacccgtcagaatggctatttattattagaaagtaaaaaaaaaaaatcaaaacaacagatgctgggagggttgcagagaaaagggaatgcttatacactgctagtgaaaatgcaaattagttaagccaccgtggaacaatttgaaaatttctcacaaaactgaaaacagagctaccattcaacccagcaatcccatgactgagtactttcaatggcaaaaaccgcaattacttttgcaccaatctcatacatataaagcatggaataccacacagccacaaaaaagaacaaaatcatgtcctttgcagctgcatggatgcagctggaggccattgtccttagtgaactaacacaggaacagaaaaccaaatacagaatgttctcactcataagtggcagctaatcactgagtgcacatggacacaaagaaggtaaaagtaaacaccagggcttattggagggtagtaggtgggaggagggtgaggatcaaaaactatctatcaggtactatgccccaaaatacataagaatgatgaattattctagtgcaaacacacgttacatataaagattcacatagataataaataatagagggagatttgttatgctaagaccacgaattagctgcatacttcacacaagaaaaatgattcaggctaactatgggcagttcataataataaatgggatgcatactcaaaattacatgacaagctttaaattacatgtaatgacaaaaattgtcttgttattgtcccacaggaccctgaagctcttttcattaccctttcaatcttttttcctcattatatttagattatgtaattcctatttgtttatctttaagtttgccaacacttccacctgtcttctttattttgttattacactgaactacagtgaggattttttttttattattactatttggtctgccttttttggcttttacatttttatttagttcttttgtttttctttgctgagaattctcttcactaaattatagacttaatgttgtagaaagtacatttagacctcctctatttctggaactgtatgcaagtccagctgctcaccacctagaagcaaactgcaaaagaagtaggatggagtgacaggaaagcagttttatttttcaattgctaggagatgggagatgggctgcctcaagcctcaaaaacaaaacaaaacaaaaaaacccatctcaaagctttgagctgagggcaggggcttaaaaagggaaacgtggtgtgggaggtatgcaggggttatgcagagtgtagggtctgcgtgtctttttgcaatggctatcttgagttattgtccacctagagtgccaactggcaccatctcaagtgtggctgggctgcagattattcatcttgaggtcatctttcagagggagagaatttgccactgggtctccatgcctggctggtttcaaaattagtccctagaatctcttaacaagcatacagtaagataagtgtgtgtggtgcaagggagtgcctggtcagaaagagagggaagctgtttccatttcagctcctcaggccagcatattcctagttggcaaattccaaaccaacttgtgcctttcagttggaactagaacttccaggcaaacatattttagtgccttggtcattgtttctagatgtcgtctatacctgcactccatgtgactgcccccctgctctgtgctacaagaacacatctgtgtgaatagcactggggctcccttcatactgaattctgatcgagtttggctcatgcagtgtaatgtacattatacagtgtcatgtgctctccacactccccttcccacttgagcactgaagtacttgttcccccagctgccaggagaattagtatgtgacagctctcagctaagtccttctcaagtcactgttcccagttgaggtaaactgcctcacccaagcttatgctctcttcctgggggcagccacatgcaatcaatgctcctgtgggaacacaaacgcggggccacctgccctactacaaggcaacatggaaggttaatctcacagttcatccaaggagtagccaagactgtagttgtgactacatcacagttcatcttctcccagtgcccaactttgcttcattaatgccacaggaattgacactaggaactctccttggtcagcttcctgaatgtcgaagtctccatctcagtctttttttcaggaatttctgagtgataattatttctcctgctcaggcttgctggtctgtggattcttgactttgccctctggcaggttcaccttggaggtggcctcctccatacagcccatctgtgtgaaatctggaagctggtctatccccacaggccatcaggaggcgagtgggcagaacatcacggtcttggtggtgtagggactcagcatagcctctctttggttttcgtaaattgtgccacatagtagttaatctcaactcagctacccagcatcgctgtcctttccgtttttctgtggagctctgggcagtacatacatctttttctcatctgactcacagcttgtctggccttaattctcacacaccctagagtccttcagagagatttatctacttaaggcaaaaggctacttcccccattggacagtagccacctgtgttactacaccattgtattgatactcctgggaccccagagacatcagtgttcagaacatggaaagataaaacttttatcataagtgataggtaaactttcattgaaagttttatttgttacttgatatactaaatatctacaacctactgcttgcactcagccaggaatttgtttttttccacaggaaataagataacctgactttaactgtagactgcatgtgatcaataacattctaaatcagagtaggattagccacttcagtaagatacaacatgcaaaggcagaggtgtcactaaaatctatgatgggcttgccttctaaacacaaacaatggtgattacaacttcacttggaataagcaattacaatatctcacgttttgtctaggagcagctttccccatgatctattccatgagaaattttgtttaaatatatttttttttacagttttggaggctgagatttatatatactggcagtgaagcctgagtccactaaacttgcaaaagctggagccaggatcccaagggtgcttgacagtagaaaatattaagaacaaataacacaatcatagaaggcagccccagataaaatcaaaccgcaaactgcctggcacagtgaatacaatctgttgttactattgttgctatcactgattttattacatagatacaaacacacaaaatattaaaaaatacaattatatcacacagatgcaaaaatattgatacttataaagcagcagagattctgtcaagtttagttcaataaggaaactaccatggattctaccacggtttctttttatttcaactactttctttgacaagagctggtctttcaatatcacactgtttaatcttcccatcctattaaactacacacaagtaacgccagagccacattacctcgccccttaatgtatttttcaacatcatcttttccatgcacatctatttacatttcatttttgctcctaaataattctctcttctttcaataaatcgcagctttccaaaagcattttggaagtatattaaaattatgggtatttataaaatgtccctgaaaattaaacatctttggcagccaaagtggcaagctcatgcctctctggtttattaatcagagttgatttaggtcacacccctaaacagtagactgtagacactgatacaagtgaagccaacacagccaggctggaagagcttttctcgatgctgctcagacaggatccagccttttgggaggagtcatcacttttatcttctgtaagtagaaaatctgtgattctgtaaatactaatcacttaatatttaataattttcctgtaaagtttgaactctagataattcacagctatatatctttacgtattttacaaataaaattctattatccattctacaacctgaagaatcaaaagttgctagctgacacagtcatcaggttaaattcctgtaataacctgtcaattttgtcaaatatatgatttggctgtttccaatttattttctgacaggacaaattgattaatcattttagtatcatggggaggagagttacagttttactattaagttttggcaacagggatcagaaaagcacagaatggaatgttagaggcattgttctcagtgttctgtgattacttgacgaattattgatgagaaaaaaggaagggatatatacgtgccttctactagcattgcaaaagagatcagtgtgatttaaagtaaaaatgtccacattttatcaccattctaagtaagaaactatggggacagaagaaaatatagttcaaaattctctagctttctaagctatagtgaagaaagaaaaggaaaatatttatttttcagggtaatactttatcatacttctttctacactagtcaatcttgaattttcaaccctctgttaaatgaaattatagacattttattagcaagattatttaattcttcatttttcatttaactgttctttgtatccatggccaatttttaaaaaaaattatcccaaataatcatttttgtaggtttataaacattttaattagtggcaaattatcttagctttgtaacataaaaatatagacagtaatttcaataaagcaaataatttaatattatcacatcgtagaaaaatacagttatctactaattttatttaacacatttaattaatcatttcgtgaaataatctgaatgctatggcatgatgaccagttagactgatacaaactgataatttttatacacctggaaataaagaatttttattccacataaacataaagaatagaaatattatctattttcactgaaaaggtacaagctaatgacatcaaattttacaaactatttaaccatagtaggaacttcataataagaaaatgtatttcctgaactgaaaagtcatgcaagttgttgagattattctctgaaaacatatgaaccagtctggcacaatttaagcggctaattaattgcaattgctatatttttatgctatatatgtttaccttaccaaaataaaaaaaactaacatctgtcgtgaaacattccattaaaatgatacttaaacatacagctgaagtgagtgggagcaacgttaatggctatgactggataattgaacaaactgttatatatgcagataatgaaatagtattcaccctttggaaggaaattctgacacatgggatgaaccttgaggacattatgataagtgaaataagccagtcacagacacacacacacacacacacacacacacacacacacaataccacatgattccatttatatgaggtttctaaaacactcaaatttatagagacacaaaatagaatggtggttgctgggggctgtgtgtgagaagaatggggagttatttcacagtgggtacagaatttcaatttagggaggtgaaatgagattcatagatggatattgtggatggtcatacaacaatatgattatacttgaagccactgtactgattgtgccttaaaaatatttaatatgatagaaaaaataatttaagaaacttgtccaacaccctacagttatgacattacagactgattttttaaaagatatttaaagttgatcaagcttcaacactaaggaaggttgggaaaacggagaaatggaagatatcgagtgaaagaaatgagtcaggagggttttgaggtctttcagcaaagtgacactaagggctgtaattagagattttgtatagttcctacgtgtagaaagtacatgttattgcattttctaagaagtaaaaagaaaaaaatagagcatgttagagatacgaaggtgtgaagatcacaaagttttgtcaaatgcagaatttatttgtcaagaaggacatatgtatatttccatgatgtttaaattttaaacaaccaaataaaaccctcaggtattgtgctgcccgtacaattatgatgctcaagtaatgcactctggtattgactgacgcaactgcactgcctttcccagtcgtgactggcattttagtttagggtggatacaaaaagtggaggcaaagggaatgcgcatggaagagatgggctccttctgccatataactttattgaattagaccatatccttgagattgaatcagcatcaatacctctgcaggtgtggcgacatttattcaacaaggtagaaaacttcctgcaccagcagatctaagatgaaaatgtctataaagatttcatttctcttgagactgaagaagacattaatttatctctgtgattggataaagatcttagttttcttttttctcctttacctggtaaaggttatacttgtggactgatgagaaaaagtctcattgcaacaaagtaccttgtacagttaatgaaaatgtgtgtttaccattatactcttacactgcaaagaaataaaaaatatccaagaaggtcagtactgttttcagtctatcacctataaaggaggactaaatgtgttcacaactccaaattaactatgttttcatctgcagactcagcctttccagacctgagaatataagtcaccctctttagaaaggaaaaaaagtcttcttggattaagtcagggaaaactgcctgattttggtaggtttcaatgagttttgatatgttatagacccacaaccttcacagtcaaggatgtagttttatataatgaaatatactgacttaattcagcttctaaaatattgactatgcatgatgtaactcaagcacaaataaagtgacaaattatgtgaatcatttcattctcactcacttatgatggtaccagataaagcaaaaccattctgacaggttacttgcaacttatccagaacgtggatttgtgatataaaattaatcaatacttagcctgagaagcatttattatgaaatccttggaaatgagaaaaagtttaattaattttatgcacaaattagaacattttgcaagtggcaaatgaaagatttgacataggtttcatcgctttcacacaagtacttttctatttttttactacgtaactcaaatggagtaccataaaggataaacactctgtcttctttttctccatttgcagtgtcactcttatttgaaatcatggaaaatgggagctatacctcttatttcattctcctaggactctttaaccacaccagagcccaccaagtcctcttcatgatggttctgagtatcgttttgacctccctgtttggcaattccctcatgattctcctgattcactgggaccaccggctccacacgcccatgtacttcctcctgagccaactttccctcatggacgtgatgctggtttccaccactgtgcccaaaatggcggctgactacttgaccggaagtaaggccatctcccgcgctggctgtggtgcgcagatcttcttcctccccacactgggtggtggagagtgcttcctcttagcagccatggcctatgaccgctatgcggctgtctgccacccactccgatatcccactctcatgagctggcagctgtgcctgaggatgaacctgtcgtgttggctcctgggtgcagctgacgggctcctgcaggctgttgctaccctgagcttcccatattgcggtgcacacgagatcgatcacttcttctgcgagacccccgtgctggtgcgtttggcttgtgctgacacttcagtcttcgaaaacgccatgtacatctgctgtgtgttaatgctcctggtccccttttccctcatcctgtcctcctatggtctcatcctcgctgctgttctgcacatgcgctctacagaagcccgcaagaaggcctttgccacctgctcttcacatgtggctgtggtgggactcttttatggagctgccatttttacctatatgagacccaaatcccacaggtccactaaccacgacaaggttgtgtcagccttctatactatgttcacccctttactaaaccccctcatctacagtgtgaagaacagtgaggtgaagggagccctgacaaggtgtatgggtcggtgtgtggccttaagtcgtgaataagactatatatttgccccaacattcaaaactgtgcaaagtgtttgtgtggaatttcctagaaataaggaatatacacttttatttctacatctgttgtctctgtgtgtgtgtgtgtttgtgtgttgctttgaattgcagatgaatcttcattcctcgggttcatttactcagctatcattacccaatcaaatcatggattgttaaaaatcggtgaactcactaatccttagtaagatggttttacatcatacctcacaataattttttgttcaaagaatgaattaaccattcaagcagttttgaaagttgttgccatttgtttcaaattgaggtgtagcttacacacagtagaatgctcgcatttaagatgttccttttcaactaatttccacaaatatctaccctggtaattcacccattaggaagagacaccattttcaccacctcagaaaggtcctgcaggcccttttccagtgataccccaggcctaagatacatccactgctctaatttttatctctgttcgttagtttgggctattctaaaatttcacatcaaaggaaacaaatagtatggtcttgaatcttgtttccttctttcagcttaatgtatttctaaaatccctccacatttttacctcattgttacattgcttttttttactgctaagtagtattttgttttctgaaaatttcatcatttgtttatccattattttgctgatggacatctgggctattttcagtttgaagttctggtgactgaaatgtatgttaatctcctatttgtaatcatatgtttttatttttcttggtaggtgtctggtgaactcttcagtaaactgttttcaaagtggttgtttactcttatactgccgctgacaatgcacacaagttcctgttgctccaaatgtcgatgttttcttcattttagcaattcttctgagtgtagtaggaactcagtttgcttttaatttgcattttcctgatgactaataatgttgaggcctcttgcgttagcttattatctattgcctattgatgtaaactgtctacttcagtttttggaaaaaaaaatctgtatatgcttccaaagcgaaaacaacttggtcattaactaataggcaatctatggcattcatagggctacttggaattttggaaataaaatcatatattgggttattttttattatatttcctgacacatgtgttatcattcaatgcctcaagatttgctgttttattaaaccaggtatttagtacatctcttccacctcctgcattctgcttaaagctataaatctgtttgttttaattatgagttgtaacagaacatcccacttcactggaggaatgatgccactaaaaacacacagattttattaattttacatatacaggggcttcttcacaagagcatgaaatctgaggaagtggccaaagagagaaattttatattttctcgagaaagaatgataaatttaagaagacgtgacaggacaaaggggatggggtaacagcagtacatttctaggtgagtcattaggatgtatgtgaaggggagtaaaactcgtagaagggttacttcgctaagtatattcattctgatccattgcacccccggatcccagtgtctggtgtaagggctattttctcagctggtacatggagggtgcacctcccgaggaatctctatggcttcgcacatgtaggaagagaatgatcagctggccctttctgaaataaccattgctcctatgtttttaattcgaagtaatcaatattccaatttggtatttggggaatggcatgtctttcactcctttacaggtaaatgattatatagatgcagtaattttcaggcaagaaatttggcatgttgaagagactgctgattttacgaaggaaacaaacataaacatacgtttatttctatatcaatttatttataaatatatactcatgtgatctccaaaaacaaaaaattaaatccaaaaatcaattgtaatacaataatttcacatacttagagactgtttttttttttactttgcttttttttagtctcaatcttctccttcacaactttttcttttcttgaaataaggagcagaggaatgtagagcagacgctctcagggagcaggagccagtgagatccaggttggcaggtccctgcagtactgtggaagtggcggcccctggggattgtggaagaaagcctggttgaggcatttaccccgggcctgcaggttgtgctttagggtatctaaagccaatttattacactttaaacctggtttatttctataaacataggcataatttgatcatagggtaatttcatcaaatagccaacttccatattctttcagaaacatgaagtgaattggtttaaccctcgcctagatggagtagagtataacttcttatgaaataactataataacagtaataaacacaaatacctctcattcatttagtacttaatttgcaactgtattttgcttaatatttcaccttcattttattattttagttataaccataaccttccagaattggctcagtgttcattctcatttttttaaaaaaatggagacaagcttattggggtaaaattcactatccacttttatacagacctgaatccaattgcctgactttaaaaagcttgcactcaggaaagagctagttttcatagtgtttcagtgagcacctgcccccaccccacacatatacacatgcacactcatttgaaatcgccatcatttcttctactagtgttcaagatgttgtcacatggttttcctccttcacacaaggtattgctgcaggttctcctcacttttttctcaggcatcccctagggacatgagtcctcatggtgccctatgaaagggtggccgttttctctcccacaagccacatgctacaggacttccaactgggaagttgtctttcatccttttccttgctcctttcaaatcacatatccccttctccctgtaaactgtcagctaatcggaaggaaatcgctgaactgagtatcacccaatgcctctgagtcactctcaaggacatgacattgaaacaaacatctgagtagcatgaacagcagctggacaccatgagggaggaaggggtgttgagcccagtgtgctaaatgtgaaaggccctgcctggaatgtcctgtgcggagcggaacgtggtaaggtcaaatgtggtgggagatgggtaccccgggaggacttcagggtcaggtcacataggaaggcgcaggttttgttcagagcgcgctagggtacacctgcagtcagccctcatcaggaaggagcagacggtccacataaacataagcagctaaactgtagattaaacatgatgttctgacagagcagattctgagggggagagagtcatcctctttaagagaacaggaaagtctccatggagggaagatttacatgtaaaatcttgggagaatggaagaaattgaagcccttagaagtgctggggaagagtgtttatgtgcaagaaataatccaacttatgaaaaagatgcagaatagctcaatttatataaatataaatacttcagcttcactggaaattagaactaaatgtaggcaaattttatgaattttttttaaatttaaaagaatgtgacctagcagaatgtctgcaaatgcaaagttgtggttacagaaagaggaatctagtgttaggactgaaatggatttatacagggagaaatttgaggcagggaattaacttaattgtcattataatttttgtgtttctatcctataaaagcgggtgctaaatactttgagtaaaacatactggaattacagtagattgaagattccgccaatataaaatctaatagatgcattaagggtagcaaacgattatcacagactactgtactaggttttctattcccagatcaactcatttgccttcttcaatgattctttctcatcaatatatttcttctgtaaattctgaacacaaaatgtgtaacattctaatataatctgcatacatacataatgtactaaagtgaatttagtatagaactttaagatatgcctgtagtaggcttgattttcacatatttattcaataaagcaaattaaatcatgccattttatttagataaatgaaacaccatttaaaattatttgaaataacttaaaataaatataaacattatctttagcatagaattttagttttgatttaaatataaaaatttggaaactcaatgttacttattatattatttttactattaaaaactgaaaggtaatataaatgtaacaagtaagataatagttgactaaatagttgtacacccagttgaaatttactacattaacacacgataatccaaagatctttgactgatagcaatggtaaagagtttctctgctgccagtggagaagtcatataggttaacttgttatataccccttattttggcctctgaaaagattgtttgtccactgtggtcttttaaccttgacatcgcctttggattgaattttctttccctcagcataatgctattgcttttttgatctctaggggaaattggagattgtacattgatgcatacaatttgtggccaaattccttctactgcagtctcaatggtctaggggttacttacagttctacaacacacaaattcagagtggtacaaccagacttaggtttcctttggcagtactggtgtttcaaaaacatagctggcatttattcatttccatttgagaccactatcagtcaaaatctactgctaagatagagtttttaatctcttgattgctcccaacattagttaaatgtggctacactgagaatggtttcaacaatagactttagtgggaacaaactagcttgattctttgtgacaagcaagatgccccctgtattctgcagcgttctcaaggaaaagtgcttgatgaggcttgagccacggagtcatttccttgtcaggcgcacacaccccatatgcagttgatgttttcagtccttcgaggcttctaagtattaggcttgggtgatatctatttcatgtttcagacagagaaatatttgatcagcaaagcttattttctcatctctgctaactctagcttggttcatctcacacttgctggactttgctttgtgttctgtggtagaacaggtaacagagttaaatagcctgctaactcccacacaaaagacatttccctaatttctagaaatcatctcagtttttttcaatcacctgcactataataagaaaatcgttttcttttttctgacagcattaagtgcataataagagagaattcagttctatcatcagtaacagagacctggtcagtagggacttcaacattaaacaaggatttaaaaagttaattgatgcacaattcttgtacaaatttatggggtacagagtgatatttggatacatacaaagtttaatgatcaaatcagggttattagcatattaatcaccttaaacatttagggggtgtgtgtgtgtgtgtgtgtgttgggaacattgaaaatcctttcttctagctatttgaaaagatagaaaaaattatcattaacgataatcatcctagagtgctatagaacactagaacttattcttccaacatagttataaatttgtactcattgagcaacttctctctcttctcttaggccctcgtgtttcccagcctcgagtaaataccattctactctctacctctatgagatcaggttttttaaccttctgtatatgaatgagaacatgtagtatacatccttctgtgccctggtttattgaactcaacataatgtcatccaggctcatccatgttgccaccaactacaagattttattctttttatgactgaatagtattccattgtgtatacataccacattttctttaactattcattggttgatgaacatgtagttgattccatatcttggatattgtgaacagtgtggcactaaacattgaggtacagatgtcccttcaataggctaatttcctttcctttggatatatgcccagtagttgaattgctggatcatatgatagatctatatttttagtttcatagtgttctttataatagctatactaatttacattcccatcaacactgtataagatgtctctttctctacatcctcaccagcatttgttattttttgtcttttttgataatgaccactctaattgcagtgaaattatatgtcattttggttttgatttatatttcccttatgattagtgatgttgaacattttttcaaatatttggctatttttatgtcttcttctgagaaatgggtatttagatcatttacctattttcaattggattatggggttttatttgctattgagttcctcgcatatactatatattaatcttttgtcagaagaataatttgcaaatattttcttcaattttgcagggtgttttttcattgagatgaatgttttcttttctgtgcagaaggtgtttagtttaatgtagccccatttgtgtgtttctatcttgttgcctgtgcccttgaagtcttagagataaaatcttttctgagaccgatgttgaagcatttcccttaaaacaagcatcatttttaatttcttcataagaagcaagtgttgattttggccaatcagggcagcttttgtgattggtgatcaacaggaaattgcctggtagcagacagtcttcggctccttaatcccttgagttttgtccctatgaaatggttacaggaacatttcaggaacatacatcatcatatccatatgctaaagaaacaggatgggccgggcgcggtgcctcacgcctgtaatcccagcactttgggaggccgaggcgggcggatcacgaggtcaggagatcgagaccatcctggctaacacggtgaaatcccgtctctactaaaaataaaaaaaattatccgggcgtggtcgtgggcgcctgtagtcccagctccttgggagacagtaattataggaatcccttaaatcaggtggcagtaacaaggagaagacatgtggtcactcactccgtaatgattgtatggaattgaaaagttagaagggccaaaaaaaatggtgaattaaaacatcaaatggctggcataaaatgagattgtaagcagctcagattatttgatttcaaagtcttcatttgctctttcacactcattttcatgtgcgcatgtgggtgaggaagccgacctaaacattctcattcagtgtggtgagtttctttctccctagcttaatgagtcaattttctggacagtgagtacaaaatatacttctgattcacgcattatattgtactttgctttacatagctacattctatcatatcctgaatctctcttctttcattcctttccttcctgcccctcttttcctctccctagctatctcattttctccctcccctggtatataaccccttacatgtgtatttaagaaacaaaaaagagtaagaatatagtaattataggaatactaatatagtaataatagtagtagcaataataatcatcctgagtattgactgtgtgccaggctctattcccccccttcactcggtgtgtgtgtgtgtgtgtgtgtgtgtgtgtgtttgcagtgggggtatttaatgagtctcatctaatattcaaaacaactttatcaggcaggtactgtcatgatcttcatttcatagaaattcatttcagacataatttaatggatatttcagatataatttcatatctggtgtttcatgtaagacaaaaaaatgaaatatttttgggatattgcatttccattaaattttcctgtttatctcttcaaagcagtagggtattgatgatattgttattttcttaataaaatgtttgagtcaatagcatacgaattcctgggctaggtaacatccattatatttctattatatccatgtctgctctagataaagtaatagttaaatttcatccagatttaggttaatttagtatttgagttttgcctgtcctatgaaattccactgtagtccagtgaaataccagtgaccactttttaaaaatagtcagtcactaactcattaagtctgatattttaagcttatgataaagcttatcataattgatttagtgattttcttttgtcttgtgcttgtcttgcagtcaaacatgtaatgtaaagaaataatgtaggaacaaataaataactacttaacatttgaatgtcaagtcattgcaatattagtgaacaatcgaagtctgtataaatcaaaatttaaagaaacatgttgtatgctttatcggtataatgagagatctggtagataaattaaaaagtattttttagttgaactaagtctaaattaatgaatatgtggtgtgttttaacaatcttcttagatataaaatgctcagaaggatttgagtgtagtgggtcaatgagtgaagagtacaaaaggagactggggtatgatggtgtctgtacctagaatgtaatttccaagcaggagtaaattcaatggaacatttgcacagtaaacagataggaacagtttgattcactaacgggaataaacatatgaactctgaagtagttccattgacaaaatgaaacaatttggctacatgtacaaatatttggaatagttggctaaataatttaaggagcctaaatgattgttcctaaatgaagacatttttagatatggtaaagtctcacacacacatacccacacccaaacacacacacacacagacatttaatcacatacagttatcatttgaaggaagtgtgatgtgtctggaaaaaaatgtgggctcttcttttgtattaaacttagtatgaaattatgtacacgatttatgctggtgtcactctatatttctttctctataatcatgacctgcgtttcttcaaatcaaagtggctcttttatgctcagtttatgtgaagtataatgtacactggttaaatttcagactgacctgcctgactgcttcttccaaatgataaaacttgaagtatatataaagatgtaaacagacttttgggaaactaggaatttcctaaaaattacagagccacaaagctgaaaaacttaagacaaaatcctgaggagagcatgttctctgattaatctccaggcttatagaaaagacatggatgtagagtgtatatttttctccaacatttaatattattaacaaggtatacttggagctagatgggtgataaatgaactttacctcgtcaaagagtttcctgtgtggggaacaagctataggataggtgacacgtattttctccactttcaaacacggaattgagagcatttctctttgcatacaatggcagatttcacccaaaattgaaatactcctgggtaacatagaggatacactttcttgaatcattccatcatcatgggagtatatttcagatccctgactgactggttaagccaagagatatgaaaaaaagttgcagaaatatgaggtgcctcatagtagtggacatatggtgttggaagtaagatgatgagggagataagaaataaattgtggattgcttccaatttctgaagaaaaaatacaggtattattgcgtagatgatatgaactctaaaaaatgtaaaagccagtatgaaatacagagaaggagaatttatgcatagctgaaaatatttttacatcaaagaccactaaaacaattaaatcattcttgtaaaaagcaattaatgagacctaaaatgggccagaagtcagctaaggacatatgattcagtagggcatggaattatgataataaagtaaatcattgattaaacaagtaaaacgagaagaatgatataactccagggagtggggaaaagttaacttcggatataggtgtgttgatttgagttgtcagcagtgtttattgattttgtaaatttatttacgatcagctcatgcagggcaccactgccctgaagtctgaatctgtgtgtatcatcacattttacaaagctgtgggtcaaaacagtcaaaacggaaaggaatggctgggtgcggtggctcacgcctgtaatcccagcactttgggaggccaaggtgggtggatcatttgaagtcaagagttcgagaccagcctgaccaacatggtgaaaccccatttctagtaacatacaaaacttagccgggtttggtagtggtgcctgtattccaagctactcggaagctgaggctcgagaattgcttgactccaggaggctgaggttgcagtgagctgagatcacaccactacactccagcatgggcaacagagcaagactctgtctcaaaaacaaataaacaaaacaaaacaacaacataaaa

SEQ ID NO: 529 - DNA, 24475 bp, Homo sapiens
ggtaaaaaccagaacagaacatttccccataaaccatggtttcaacaattcaaaaaagtgagacggagtggtgcaagatgtcagaatagaagcctatataactaatctccctcactgaaacatcaaattgtaacaactatgagcagacagaaaagcactgtcaccagaaccaaaaaccaggtacggaatcatggtacctggttttaacttcatcttgctaaaagaggcattgaggaaaggcaggagacacagtcttgaatcaccaacaccacaccttcccaatcacccagcactggacgtgcagtgcagagagggaatctttgcacttttggaagggacagtacagctactgggggactttacattgaactaactgctgtgctgtcacagtagagaaaaaagccatgctggcctcagtcagtgcctgtgcacggagggaatatttgaactagccccagccagaagggaatcgcccatcccagcagtcagaactcaagtttcttggcaagcctcaccattgtgggccaaagtgctctggagtcccaggtaaacctgagaggcagtctgggacacacgaactgcaattcctagataacttctagtcatagcctgggctaagagctagaggactagggtggcatgtgacctagggagacaccagctggcatggctaagggagtgcttgcaccattcctcccccacctcaagcagtgcagcccacagtaacaaaagtgactccttacttttgcttaaggagaggagagtgaaaagtaaagaggattctgtcttgcatcttggataccagcttagtcacagtaggatagggcactggacagtgttgtgaggacccatttctaggctcagctcctggacaacactctccaatcaagagagatacagtgtctcgaccaggcatggtggctcacgcctgtaatcctagcactttgggaggccgaagtaggtggatcacttgaggtcaggagttcgagaccagcctggccaacatcatgaaaccccaactctactaaaaatacaaaaattagccacgcgtgattgtgggtgactgtaatctcagcctcttggggggctaaggcacaagaatctcttgaacccaggaggcggaggttgcagcgaactgagatcctgtcacagcactccagcctgggcaacagagtgagatgctgtctcaagaaagaaaagaaaagaaagaaagatagaaaaaaaagagagagaagaaaagaaaagaaaaatagatacagtgtctgaatggatgaaaaaataagacccaattttgtgttgacctcaagaagcactcttcacctataaagctacacacagactggaaataaagggatggaaaaagatattccatgccaatggaaacccaaacatagctggactagctctacttatatcagaccaaatcgatatcaggacaaaaactgtaagaagagacaaagaaggtcattatataatgacaaaagggtcaattcagcaacaggatataacaattatatatgcactcaacactggagtatatatatataaagcaaatatatatacaacactggagtacagatatataaagcaaatattattcgagctcaggagagagaaagacctcaatacaataacagcaggagccttcaacaaccccactttcaacattgggcagatctcccagacagaagctcaaccaaagtagtaacattggacttaatctgcactatagaataaatggatctaatatttacaggacatttaattcaatgagtgtagaatacacattcttcttctcagcacacagattattatcaaagatagaccacacagtaggtcacaaaagcagtcttaaaaattcagtaacaatgaaataatatcaagcatcttctctgaccacaatggaatgagactagaaatcaacaatgaggaattttggaagctatacaaacacatggaagttaaacaatatgctactaaatgaccactgggtctatgaagaaattaagaaggaaattgaaaaatgtcttcaaaaaatgaaagaaaaaccacataccaaaacctatgggatacagcaaaactagtactaagagagaaatttacagctgtaggtgcttctatcaaaaaagaaaaaaacttcaaataaatcacctaacaatgcaacttaaagacctagacaagcaggagcaaatcgaacccaaaattagtggaagaaagaaataataaagatcagagcagaaataaatgactttgtaataaagaaaacatacaaaaagtcaacaaaacgaaaagttggtttattgaaaaggtaaacaaaattgacaaatcttgagccagactaatgaagaaaaaagggagaagacccaaataagtaaaatcagaaatgagaaaggagatattacaattaataccagataaattcaaaggctcattagtggctactatgagcaactatatgccaacaaattgaaaaatctagaggtaatggataaattcctagacacatacaacctaccaagattaaaccataaagaaatccaaaacctgaacggaccagtaacgagtaacacaactgaagccttagtaaactctcccagtaaagaaaagcttgggacccgatggctgcactgctgaactctaccatgtgataaatattgatgcaaaattgatgcaaaaaatattgatgcaaaattgatgcagagtgaacaggcaacctacaaaatgggagaaaattttcgcaacctactcatctgacaaagggctaatatccagaatctacaatgaactcaaacaaacgtacaagaaaaaaacaaacaaccccatcaaaaagtgggtgaaggacatgaacagacacttctcaaaagaagacatttatgcagccaaaaaacacatgaaaaaatgctcaccatcactggccatcagagaactgcaaatcaaaatggattaacgactaaaatctaagacctcaaactaagaaactactacaaggaaacattggagaaactctccaggatatctgtctgggtaaaacaaatcttgagtaatatcctataagcacaggcaacaaaagcaaaaatagacaaatggatcacatcaagttaaaaagctcctccgcagtgaaacaatcaataaagtgaagagacaaccaacagaaagggagaaaatatttgcaaattacccatctcacaagggattaataaccagaatatataaggagttaaaacaactctataggaaaaagtctaataattagatcagaaaatagacaaaagattcgaataggcatttctcaaaagaagacatacaaatggcaaacaggtgtatcaaaatatgctcagcatcactaatcatcacagaaatacaaagcaaaactacaatgggatattctctcaccccaattaaaacgacatatccaaaagacaggcaattacaaatgctggagagagtgtgaagaaaaggggactcctgtacactgttggcaggaatgtaaattagtacaaccaaaatggagaatagtttggaggttcctcagaaactaaaaacagggctaccatatgatccagcaatcccactgctgggtatatatcccaaagaaagcaaatcagtatatcaaagagatatctgtactcccacgtttgttgaagcactgttcataatagccaagatttggaagcaacctgagcgtccatcaagagatgaatggacaaagaaaatgtgatacatatacgtaatagagtactattcagccataaaaagaatgagatcctttcatttgcaacatcatggatggaactggaggtcattgtgttaaatgaaataagccaggcacagaaagacaaacatcacacgttctcatttatttgtggcaggtaaaaatcaaaacaactgaacacttggagatagagggtggaaggatggttaccagaggctgtgaagggtagtgggggggttgagggggaggttgaaatggttacttggtacaaaaaatagttagaaagaatgaacaccacctactatttgctagcacaacagggtgactatagtcaaaacaatttaattgtacatttttaaacaattaaaaaaatacaattttactgtttgtaaaacaaagaataattgcttgaggggatgaacatcccattttccatgatacttgcatgcctatatcaaaacatctcatgtaccccatatatatatatgtaccccacatatatacacatatatatgtgtaacccatatatatatgtaccccacatatatatatatgtaccccacatatatatatgtaccccacatatatatataccccacatatatacactatgtatgtgtgtatatacatagtaaatctatttatatatagtatatgtttatatatagtatatatttatatatgtgtgtttatatatacagtatatatatatatatatacagtatatatatatatatatatatacacactatgtacccacaaacgttaaaaataacatttaaagataaaaaattttgaaaagtggaacataaatagaaatttgtacttctctgtctgtctactgtatcttcttctgcattgtccccatgactgaatccacgggattcctttcttccagtcagtaaaacagtggccatggaataggatatgaacaactttcttaagttcaggacttgcttgttttttaccccttacttcctaattctaccaagctcagaaaccaacagtaagtattttgtattggcacatatacctatacctgggttgtggaatgaagatccagtcttgcataaaaatcttcaaatatggtagagattaattctaagactgcaatgataatccttcgtgagttgtcagcatcctgtatgtgcttatcatgtatcttcccaactacatatggcattgtgacaaatagaagaggctgctaatgctgctatagctgaatgtctcatttaggaacaaacaattctggaaaagctcccagattatgcatctgtccctctagcttccactttaaaagataaaattctatagtgataacgtgaggattagtatactattctttccttatatgggtaatgtgaggttatttccttaccttgacatgaaagaaaattatttattgaatgtctcagtagaaagattacaactgagatagcaaattcttatcagaaactcacattaggaatgggcttgcagaattgcatgctcattccctactgtctgaatacagagacgattagggactttctcttcgaatctgatttatttggtttctactcctgttttctctcctttcgtttctttcattttctcatttttcttcatgtagcacaaatggcagccagagcctgtgagtgctttaatgctgcaggcttactgctatgagaactgaacaatggagaaatccctggggaagcagcttccaactgtcccaccctcagcatcctaatgacctgtggaactgtggttccagaatggtggtgataaatttggaaaatactttctctaaagcagtagtgcccacatatttatctgacaggctgtactgggcaattataaaatgttcaggggtccatggtgaaatgccaaaaatagaacaatgcggtatgcttttcctaaagctacaccttctttattaaaacaattatgatttatgtccctcctgtacttaaagtacatatttattatttttaaaatgtaagtataaattttagttcagtccagcattcacacagaaatgtgtacacatcacaagtgtatggttccataaacttccctaaaggaaacacatcaatgcaagcagcatccacatcaagaaacaaaacattacccagtccctagaagcctgcttcagcccttgttaatcacaactcacaaaggtaactcctatctgacctctaaactccaaagtgcctaattttttagtttcatataatagattcatacagtaagtgttctcttatttctgacttactttatacaacactgtgttcatattttatttttcaacatttcctttattttatgaaatattattaataagaacatttgattaattaaatgcccttatacttctttctctaatttttttagaggtttctttttttgctatagaaatgtaataatatagaaataaatactcttagtctcatgtctattttacatcatatctaaagctcagaaccatcttgaatttaactacttatatgggtgggtaagtcaacccaacatatctgactaagtagaattccaagaaggaaatactgattttaaaacattactttcttgatgtttgacagggaccttgttgttacacaataatgccatcttatggctgtacagcaatttgtagtctagaaactgccttcattttgatgatagcatttgaactgttctaccctcttagtctttgggaagtcattttctaaaagtgggaaacactcactaatggcttacaggatagtaaagatggtatcagaaagaaactaacgacaatagagtataacatctgacatttagtaggcccttcttaagtgttcattgaaagaagaaaagagctttgtttctctaatcccagatagatcttatgtaaattctttgtttttacatgtttcctataggtatattttataagcagttagttacccacccgaaaatcaatgaaaactgaatttagcagtaatattaatttcccaaaaagttaactagtaatcttacatataggcatatctatccatacgttcatggtgcttgtggatttactgttgactgtgttgactgttagtgaacaatcagaatgtccgtgaaaataaggcttttaatactttgatgatgtgtaacttgttgagatacatgttgaaattctatttgctgaaagacaatgtatggaagcaggtatgttagataatgaatgagcagtcataaattagtctggctttttaaatatcttcctgttctcatctaaagcgtaatgtctgttttaccttatgacatttaatagagatgactgaacgagaaatacgcagatgtactatttagtatgtgcttaggcaagtcacataacatctttgaaatatagttttctcccttataaaataatgaagcagggcaaaaccactaaggcattttctagctgtaaaacaatcctgttataaattattaactatctctaataatttgaattatggttcagcaaatattaacatctctccccccttccactgtaggaagagtctactttctcattctattgatgtcagatttggcaacgtaatttgctttggccaatcaaatgtcagtgaacttcacaggagcagaggccatgagtgttcttgggaggtttaggtttatactttggtgactggtcatgaaaacatgtcactgacccttcatcttaggtccagagcaaagacatatatagcagaccttaatccaacatgcatcatggaacctagctctactaacccacatcttgaagcagagcttcccggccaagcccagctgagtcagtcaaggtacaagtaacctaaacagccagaaatgcctgttgttttcagtcagcaagttctagggtgatttgtgtcacagcattattgcggtcatagctaatactaccatacatgtaccatttaagaaaaataccaatatagcccttcttactagctcaaatttattttgatttaacccaaattggcttactaaaaaactcagcagatttttgttgagaacaccacatgaaggctgtactgaacatttgtgtattcaggaatgcatagcttctaaatctctccaaggattcaagaatctaccattgtatgggacttagtaggacacgaggtgttgactgccactacaatgaagaacaaattcagctatttattttccctgatctctggcaataagaacctagttctgtggcctaaacctgtattgtaacagcagtcatcaatctatggcccatcagcaattccagcctgccatctgccttggtaaataaagttttatttaaacacaacatgtccatccatttatatattatacatggtttttttcaccctaaaacagcagagttgagtagttgtgacagagactacatgacctgcagggacaaaaatatcgactaactgcccctttacagaaaaaaatatccatcctctgactatcagatgcttctgccagagaccctagttgtagaatgagcgacacacagcaagaataaataatttagatactttttttttgcagtgacgatagcaagcaatgtccagtgcaatggtgctcctggtaaagcaatggactctggcatgacagcaaaataattcagatttacctcatagcttgatagtagatatattctggatgcctagcctgctcttcctttatagtttctgcccattgttaaacctagctctcaggctttcctattgattccatgaggtatctgatatccttctagtaatttatataattctacctaaagtaactagagtcactttctgttagttgtaactcagaaccttgaatggtctatagaccttgacttattccccattcttagtaagatagcttcattccattccccagggatcttgttcttgccctcttgtacagctccagtctatcaacccttattttactggctggttgtgccttttctctccaagactgtgaagctcttcaaagcagggactgagtctaattcttctctctgtagttctcagggaaatttgaaagcatgtaagaatgaattaacagatatcatgactatcagaaccataagatcaccattttcatcatcaaaattgccaaccttaactgagccattatcgtgtttaagcaacccactaagctccccacatatattgtgtcagataatcctcataacaaccctgtgacatagacactattcttatcctattttatacatcagaaatgtatggagcagaagatttaagagacttgctcaagggcacatagatagcagaaaggccagaattccaaaacgggttggaactctagagcctgtgcttataagcaattacttaaaacagtttgtatctgagattgtactaaaagtcataggaaatttaacagctcctgaccaattcctatagaatgtcaatggaagtacaatttcaacctctggataaggacagggtggatctattggggctagagaaactctatcctttgtcaaaaccagaaaagtcctcagagttggggtgagatttcagcgaccctctctgtggaatggcgttagtgtttctgtttaagtctaaggtgaaggtaaactgaaagggaaatgtccatatgacccagtgagaagggaatacctggatcatttgccaaaaattactcatgagtaaagcggaggagaaacctcaaaaagcagaaagcgttatttctactttagtgcaaaactggtaggtgtatatagaagcacagtaatcactggctatccaagaaacctcaacggtccttaggggatggtgtgggtggcctagaatgcttggagaaaacactgactataagaagacaaaccagagggggaagaacttcccaagagtggaatgaacatcccaaaagatggtaatgaaactgacatcattggagtagcccgcagagcctcataatgtctcaatgtgaaatgctgggagaaagtacaccatggtggcgatataagtttattcaaatatttttgttaatttattttagagagagtctgttactcaggctgtagtacagtggcacaatcatggctcgtggcagccttgaattcctgggctcaagtgaccctcctgcctcagcctcccaaagcacagggattacaggcatgagccaccattttataagtttaagtttgtatttgtagcatatacacagagtggctgagtttctttgcctttatcaagcctggctttggatactgtgggaccagctattttcaaggaagttgagataaatctgtttttttgttttgttttgttttgtttgagacggagccttgctctgtcacccaggctggaatgcagtggtggatttgggctcactgcagcctctgcctcctgggttcaagggattctcctgcctcagcctcccgagtagctgggactacaagcgcatgccaccacgcacaggtcatttttgtatttttaatggagacaaggtttcaccatgttggccaggctggtctcggactcctgacctcaaatgatgtgcccgccttggactcccaaagtgctgggattacagacatgagccaccgcacctgccctggaaggtgcagtgagataaatctggtagactatccaaaggggaaatattctcaggtttcggagaggaggcttgagtccagacacattgaacacccactttgtgctcagcactatatcagtcctgagcatataacacaaataaaacatagcccttttctataaggagcttgtgtgggaggcagaaaagtaaacaaattgattactatgtgttaggttttaggagcaggcacatcagatcatatattctacacggtagccaccaagtctggaaaatttacaaatgcataaatgatttattgatattaaattacattaaatgatgaaacaatatccaagtttccagatgttaggagcgactaatagttttaggatttctagaaaaagacaacatctgaagtgagacctgaagaacaggcaggtcagagggagtacaaaacacttgggcatctgcaaattgatttaatatcgctagaacataattggaggggcttgctatagggcaggcacgaagaaataagcagtgaggctgaccagataattttgcacaattaaggagtcagggtttcattctcaagggaatgagattatagtaccaaagctcttacactttagaaaaatgacggccactgaaagatcgttgagaacaaagtggagataatcacttgagacaactgagattaatgctagaaatctctctttaggtgcctgatgtagtaaaccaagaactaaaataggagtaaagatggttagaaatggacagatgtaagagataccatggaggttccctataattattagacgaatgatttgatttcctctgagaataattaagaagcctaccttgaggataaagacttctgaaatgaatcactttaagctgttagagaactttattacttttaatctaaaaatgtaaaagaaagagtaatccacttcttgtgatgtgaagctaaataatgtaattgaatttctgccaccccccaattaagtcaacagctaaatatttcaattaagataaaaagaaacatgattttaaatcaacttaacaaattccccatggcaaaaaaaaatgtgggggagggtaatgcaaagtgtaaagtgtcaccctccaaaatataaataaatgaaaatcaatttttttattgataggtagtattttaaacatgttaatctaagtatcaaactcctataaatttgtagatacagatttgactaaagataaatatgttatatcgaacaactgtttatagcacctcaatgccccaatctgatttacgattacctgaaattttagaagatataatgcttcaacataacgctaaatttaatactgaataatttctacagttcagctcatttgtctgaattgttcatcattatttgttctcattttacttaccatttttcaatgagagtgatacttctttttccctgtcttttttccatggagggtactgaaataaattctacagttccctgaaaacaaatcatttctgcaagtatcaagaaaaatatatgtgttacctacccttgtcggtccttgtacattttgttaactttttcccattggaaatcaagctgggagagagcttcctgtagcttcaccctttccacaggcgttgcactttgcaatgctgctgtcttcttgctatgaataatgtcaatccgacctgagctttgttgtagactatcttttatattctgtaatataaaaattttaaaacagtaaaaaaatgaattagctgtctatagaaagagaaaaatatatatatatatacaaatcccaaaggtagcaaatggtgttgcaattcttaattattgactttttaaagttaataaccatgaagtccagtgactttgacatgttcaaattcaataggtaaatcacagacctcatcctgagagagtggatcgctccctacatcttaaaactgccttcatttggcttctgtatcctgacctcttctgctttcctttgctggatccttctcatcctgatcttaatattagagtgctctgactcagtatttgcacttcttttcttctctgtccataatccatcccatttgttctcataattttaaatatcttatataagacaatgacacccaaatgtgtatctcaagcccggacatctcctccgaactccagtctaacaaatgctaatttctcaacacttggaggtctcacgagactttcaaacttaatatgacgcaaacaaaattctgaactgcatttcctaatccttctcatcccatagattccctcatttcagtaaatggcaattactgatttcaattgaattatagtaattcaattaacaattactcagattgacaactttggagccatccttaattttttcagtctccagtattcaaattattgggcaaatgttttggcttgactttcaggacatatgcagaatttgactgcttctcactacctttcttgctacagatctgatagaagctattattgtctctcatctgggttatagaactacctatctaaatggtcctcttgcttccgctctttcccccctactggataattctccacacaagagccgaaaagattcttttaaaacataattgggatcatatcactcctctgctcaaaatcttctggtggctcttcatcacagagttcaatcacagccaatttcaaaagcctacatgaaaaataattattcttgcaacactttatacaaataatcaggccaagtataataaagcaaatcagtcctatgatgatccatctttagtaaaaatgggagactggagagagaaaaaaattatgttttaagaactatggtacacctgttattagtctcgtcagctgtttttgagttttttcctgcaatatagactgatcctgcttattcctgtgaacctgccagtgatctctgactgcacctcagaagaaacaagaaggatgggtaatataaaaacctggatcagtattctaattctgggcatgtattggaatcagctagcagccccacatcactttggttccaacagctgcccagttcacggaaagccttctaatttagtttacttgggataattttacttattgtgttttactgttgtggaatatatttgctgttttactttttgtataggaatgcagaataagcttactcaatgttttcttagattgaaaacttactaatcttccagatatcaccatttatcagttatgaatggccctcaccaagctgatgcttgctgactgagctcctctctaccctgaatacaagagaccctaatagttaggcagaaatatcatcacccatattcagcctgaagaagttacagaagatgtattacccttctactacttaatcctaagggtaactctactacccttaggattaagggttcccttgtaaaagaaagaggggaaatatgtcagaggcgttcgaactagaacaactccatcttgaataggggctgggtaaaataaggctgagacctactgggctgcattcccaggaggttgggcattcttagtcacaggatgagataagaggccagaacaagatacgggtcacaaagaccttgctgataaagcaggttgctgtaaataagctagtcaaaacccaccaaaaccaagctggtgaaaaaagtgacctctggtccttctcactgctcattatacactaattataatgcattagcaggctaaaagacactcctagcagtgccatgacaggttacaaatgcatggcaatgtcaagaagttacccaatatggtctaaaatgggagaaaccctcagttctaggaattgctgactccttttcccagaaaactcatgaataatccaccccttgtttagcatataatcaagaaataactacaagtatcctgagtcaagcagcccatgccactgcactgcctacggagtggccattctttattcctttactttcttaataaacttgcttttactttttttaaaaaagcataatcttcactatgacctataaatctctacatgacttggttgtatactacctaccattccaagctcatctcttcccagtctcttcatagtccacaacacttcaccctcattaggtttattgcattacttgagtataacaactacattcttgcttcaagatttctgcccttgctgttctacctgccaaaaatagttttcctaacccacatttctatcagtggttcccttacttctttctcacgttaaaggggccttctctactactctattttaaatagcaccagcaatcactctttattcctggcattactcttcccttttctttatagtacttattactaacattaaaatatatatcaagtagccggtatataccactaatttgaaatctatgactacagggatgttgttatctgttgggcttccaaagctcaaacctgtgcttggcacatgatagatggcaaaagcttttttgttgaataaatgaatagatggtcccataaatttaatccataatgttttgtttatattctatttaacggaaaaatcacaaaccacaaatgggttatacgggaagaaagaaaaatctaaacatatttattctcaataaatttgctaaaaactacattctggctattcttcctagtacgaattttgttattttgatcatctaaattatacataaggtccactgagcaaaatttattgagttcttcccatgtgtaaggagcaatatagcagaaacaaaggtgggtgaaacacagtttagtttgcctttaagaagttttaagtaggttttattgtagtagtaagaaaggatatggtttgaagaattgaagaaaaaaatccaagtatagaagccttagctggatgagaagaaggaagaaatgagtgttccaagtggtaccaaacattttctagaagttagagaaaacatgtatcatatatttggtcataggctcaggaaagaattcacgaagaaggtgcaaattgcagtagacatatctgagtagtagaagtgggaagaacattagagctagtaggtaacacacacgcaaagctaggtaacaagcgcagtcatatttggctgccttttcagtaacatagaagcttaggggaagatggggcatgaaacagaggctgaggatgttcaataatgtgctttgaatctcaacagaaaattctgcctgtacttcagtagctaatggggaactatgatttttaaaaagttatcattatgtaagatttcaaatatatttgaaagtaggaaaataatacaaatagctcccataaccctataatccagtgccaactgttatgactccatggacaatccacccactcacctcttcaactagattattctgaaacaaactgatatattattttctccataaatacttcagcatttttctcttgctgaaatattctctcatgagaacttttttcggaaagtacatatataataccattaacacacctacagtcttaacaaaagttcattaattgaatcaagtatctagttgctattcacatttgagctgaagtgggaaggaagtttaggaaaacagctcagcagaattcagtgactgtgtgttgggtgaagaagaggaagaacttgaatgagtcttaggtatctggcctgggcatccacatgatttgtggtgtcattgggtaacaggatttcagacagatgaagaggttccatggttacatgcttgtgtatgtgtgcataagtgatcagttcaattttggacatggtcattctgaaaagcctttgaggcatcaaactgtagatgttccagaggcagttgaaatcagattttgagaagaggagtaagatggcagggattgctgagccatacatattttcacatttggatacatggactaggctttctgagcaaagagttgtagtaactgtcttaaagggtgactgaatggcaagcgtaccttggagtttagtgcattgctctggagagatttaaaaacttttatctccaagagccctttgattacatttcaacttatattccaaaaataatagacctagatcattggtttatagcccagagcaaagtctctgtcttcctgtatgtctgtctctctcactttctctcctcctgatacatcaggtgctctatataatctccaagatccacaattctgggatttctctcctgtactacaacccctgcactcacagataaacatcttgccctgagatgcttttgagtaattaatgatgtattctctcatccagagatcttatgtttcctgactagataaatataaattttaacaaatatcaacaaagggaatattcttttttttttttttttgagatggagtctagctctgtcacccaggctggagtgcagtggtctgatctaggctcactgcaagctccgcctcccgggtttacttacaccattctcttgcctcagcctcctcccgagtagctgggactataggcgcccaccaccacgcctggctaattttttgtatctttagtagagacggggtttcaccgtgttagccaggatggtctcgatctcctgacctcgtgatccacccgcctcagcctcccaaaacaaagggaatattcttgcctattttcagtcaaaattgggaagcattttaatcatttgtaagttggagactgtgttagatagggagtgactgctgctgatcgtacagctttccagatgacgggctctgaagaaaacttcacaatcagagagggaaacaggaaagaagttaacaataaaacttagaggattttctgccttattctaagatttcacgtttgtggtccacgaggacttgccttgagcaagaactaagctgaagaggcaggtgagactacagataatgtcagttgtaaaaggtaaaagtcaatgcttacaatgggaaccttataaaaagcaactgtgttctcgtgtcttatttatcagctcagcaacaggataagatacaatggttatgggtgatgtgagtgaatttcagagaaagaaggtgtttttaaaataaaatttcaaggcattctcttccagtctatgtacaccttgtgatggaaagctttcattatttcttttgtttcgcacctcaatttaactctgtggaaaaagtacttatctgacaggtcaggtattaccatacaaaagaaagaacaagccaacacagaaacaatctgagaatttacttatctggaggaatgcaggttaaaactgtcttttagcaatttcacatagagaattgatagtcattggaatgtgtgtgatgttgaataagactagggatggtcagattgctcaggaaaggtgtttagggtgaaaagagtgagaagaaaggtagcataaagatgaacctatgtggaaagcatgggcagaggaaggagatgagtatccctaaagaataatagtcatcagacccaggaagagaaccagaaggagggagggagttgtcaacaagtcagatgcagccaggaccaggagggaaaagtcagctcgggcaatttaggaggtcattggtgatcttatcgagagcaacaacagcatgttggaagtggaaaacataaatgtaggcagaccagactgtcttttgctgtcatcatctttcactataaaatagaaaatagctttgtacgacattgcagtatgctgtatttgacatcagaggcttgcttattgaagaaaagtttcatattgataaaaacaaaactcataataaaacagaaactgttggatactatgctcactgcctgggtgatggggtcattcatatcccaaatctcagcatcaaacaatatatccatgtaacaaacctgcacatgtattcctgaatctaaaatacacttgaaattataataaaagagatacaatggatgtaatacctgttattaatgccctaaaagccattgaactcaagcgtatctctagtattatttctttacttttatttacctggtagaattttactaccatcttctgatggctccaagcctggagtcttgggtggaatgtttagggctactccgctagcctgattaggtcaggtaccagaaacgtgcaccaacatatcttcttggctgcttctgttaacttgcctgacctgggcagcctgatttcacaagtacttgattcaactctgaattcttttaagtcactgtctccatcattcttgcttggctgccagtccaatggcaaagatacataactctgccaagtcctccacctgataccaagactccagctgaatgaaaggctgattacttaaattcacattgggcaaccaatcacatttgttagtacatagcaggcccaaaccctttaaatgcatagctgtaagcacccatggagaaaaacattcaagggaagagataaaggatcttccccatcagcatataaaagttatccagttatggctttgatatggtatgcgtgtgtttgtgcgtatgtgtgtgtatgtatactctctgaggatttgagcttgcaaagcttcctgattttaatctgagtctctggggagctaccaattctttggaatgctgtagcattgctcagcatcaagttatgaacggttttagcaatgctgtacagcatgttactaacgcgggaaaactttctatcttaaaggagaaaagcaaaaagcaaaaactggggcaggggatgtcacactccctggatatctagataatagctccttggtgcattctcagagaatgctgtcaaaattggctggagtccaggaaatacatcctttttaaagtccctgcacatattcgtgtcctcaaggcactgcacacagaaaaatggtatgtgcaccaaagaaaatgctgtagcactttccatagtttaaagtcagagatgagatctctgatagtattttactattttagtttgtctagaaataagtgatctttatagtttctgaccctctaaaaaggaagccatagtcccttgtagttgctatggcgatataaacatccctagaatcactatagaatatagcatttctatttctctccctgaatagttccttatcttatctgaaaatatgatgtcaaaatgataaagtaccaactttttagtcaaatcccttcttaattttgacatgcccctatgaattgaccacttcactattccgctgaaattctgtaagatgtttatttttggccactctttctgcaaaaggaaattctaaatatacatacaaatggaattttaatttctgaaaggcatctgtacacgaatttatacaactcgagtccttaatattttaaaataggatatttgcatctctgattcacagtctccaataagttaaagaagaccctgattatgcactgtgaatagagaaaaattagatagcacagtaacttttacaaccggcagatgaaatccagatacctaaagtaaggaaaagcagaaatctataagccatgtggcttcaattcatttatctgtttgaaaagcttattgtttaaataagtgtttattgataatacagacataatatcagcctcaaatgtgagatatgaaaataaagactttaaaatgtgagtctctcccttaagaagataattggtttttaaaggagacacatacagaaataatttgaacataaaaatgctttgtttattcaagtgttgtggagtatgtgtctttaacaggataaaaggagaagccagagaatacagaaaatttatctaggaaacaaacaagggacctatttgccaactaatcagtttaagataaaggtatgaagcaacccttaactatgctccattctttatcataagggatagacttctactgtttagtttttcttccatttaatgtaaagtgacaactactcccttgctgtcaaagattttcattgcagagcctgcctttaccatctaaatggtaaacttatgtgtataaatgtcaaagtagatattgcagaacctgaagagaactagagtaggggagagtaatatctgacaaattgaacttactgttaatcacttttgatgaaagtaaacttaaaataatttactgaagttttaaatatatttttgtacctatagcaaagctcgttgcttcccgaatactgtgaaaagtgccaaagttctattatttaaaatagcagccgggcgcggtggctcacgcctgtaatcccagcactttgggaggccgaggtaggtggatcactttaggacaggagttcgagaccagcctgaccaacatgtgaaaccctgtctctactaaaaatacaaacattcaccaggtgtggcggtgggcgcctgtaatcccagctacttgggaggctaaggtaggagaatcacttgaccccaggaagcggaggttgcagtgagccgagactgtgccaccgcactccagcctgggcaacaagagtgaaactctgtctcaataaacaattaaacaaacaaacaaacatcacttcctctgtcccgtctctgtggtcattcaattcagccatttcttcatcttcaacatccaattactaaataaggatgtctataatttacaagtgtctttgctcccttatttcatacctagaaataagctcacatataccttcacaaatctacaactctttccaagattttaaataatatgtccactgtgggatgtatatacaaacattaattggctaatttgtcttctgtttaacagtttttcctcagtaataaaattttacatcagaagttgtgagtgttctctcagtcaaaaatttcaattagaaaaaagtcttcaaatgaaataaaatttcaaatgtataaaagcataagttaaaatataagataatatgaaattgttgtttcagggcattttcccctgaaaatgacttcagtatttcgatgatattctggtttgaaatatattgaactttattttttaaaagaagtgataaaattgctttctaatggtttctcagttttcatttctctgaaggactaacattagcagacagctggaagcacttataattcacatttttaaccatatttatttcctgaaggaaattcctattcactcacttagtaatagcttccccatttcatctttccctccttggcaggattcagtacagttaggcacagttttcatcatacagacctagccacactagttttaactagtaatactatcttctaggtttctctctctgtgtctgacagctacatcgctgtattcattcattaactcaagaaatatttgttgaaaaaacctaccatgagacagtcatattttatttatttatttatttatttatttatttatttattatttatttatttattttggagacagagtctcactctgtcacccaggctggaatgcagtggcgcaatctctgttcactgcaacctccacctcccaggttcaagcaattctcctgcctcagcctcccgagtagctgggattacaggcgcccgccaccatgcccggctaattttttgtatttttagtagagatcgggttccattacgttggccaggctggtattgaactcctgaccctgtggtcacccgccttggcctcccaaagtgctgggattacaggcgtgagccaccgcgcccagcctgagacagtcatatattatatcttgggtatatactagtgatccagaaagcaaaagccccgctctctggaatctcaccttctacaggagaataaagtaaacaaatagagaaatgactaaactatatactcagttagatagtggttaagtgctgaggagcaaaactaaagcagggaaggaagaaatgaaggataaagtgggggtcagaattttaggtaagaggggtcggggaagaccttaccaggaaggcagtttttaagtaaagatctgaaggaaatgcagaaattaaccattgaaagaaaaatcatgagaataatattccagacaggtaaagcaagtataagggccctgacactggaatgtgcctggaggagtggccaaggaacatggaggaagtgattatggctggagtgtatgagctagcgactaccagagaaatatcagagaatggggtgggtaacccatgaaggtacttatgaacataaggacttccctgtttactttgagggggatggggagcattgggggttttgaacagaagcagaaagggggatataatctgactttccatttaaataggtatctctggctagtatattgacagtagagtctacaggggagaaggcaatgagggggaaacttgttaatagacaactgcaatcatccatgctggagatgatggtgctttggatcagagtggaggcagggttgaattccggatacattgtaaaggcagaatccttaggatttggtggccaattacatgtgtgttggtagagaaaggccttaaggataacatgaagaattttggcacagacaagtggaataatggagttgccattaactatagtgtagaaaactgcaggaggataaggttagggtgtaagattttaacatgctaaatttaagatgtttattatacttctaagtgaatatataaaaggcatatatatatatgtcatgattcaggagaggaatcttgactagagatataaatttgagagtcactaggggtaatttttaatctcttccaaacttgctcagaaaatactgatgttttgctatattccctttccagacctcttttcttccaaacccaaccctgtagacaatcttagccatttctatcacttaaatcaaactttgacacaaaggaattttatttaggggaggtgggaaaggggataagaaaaatgtcaagttgggagcatagattcactgctgctggggcccaacagagaaggcacccagcaggaggagggagttagccctttgatggttgattctgcttaaggctacatcaaggtgttttggggataacagaaatcgaagaagctagaagaaagtacagggaaaaaattcaagtctacaggttggtagacagtcagagactcttggttctgttgccatggtgggattatatacaccttccagaaaacctttccttaaccaatcagagtatttatttaactagatagaaatatgtatcgggaaatccagtccacattttgcactaacacaggaaaatgggtgatctaggatgttgggcatctcctgagtgaactttaataatgagagtcctggtacagctactgaatcaagggtatggtttataaatcggtccagctatgctgaacacaaatatctccttacttattgttttatctctttatttttccttgtgtccaatttatcctgccattttaaggattatccctgaccaaaatccatccatgatgacatatagctttttggacactttcaagcccatcttttagcccatctttttttccaggaaaaaaaagaaaaaactggattcacagtttttatccaacttgatttcctagtgctttgccagcagagacacttgaaaggataatcaaagtgaataacaaagtgaaggattaatctctttgttattcttcagacacatccttctgatacaattttttttttttttacccttactgactttgtatctttaactttgaaaacattttctgcatcaagaaactgtatagcgtagtgcttaagagcagaaactctggagcttgaacatccagagtgggacttcaactatgatatttaaaaatgatctcacctgagcaagtcacttaactgctcaggacctccgtttctccatctgagtatgggtataataatacagccttccttgtagggctgttatgatgaccatacaagttactctaagtgtttagaatgtgtcctggcacaaaaataataactgtcagctattacattcaagattagtccagattccagttatattcacacctcaagctaaggattcctcctctataaaattcctcctagtttctgctttttgtgctgctttcttcttttcatgatttcagttacactcatgtcttatatatttttgcttggatgatgtccttaatgtctttattactctctaacttgtttgtataactataatatgtatattcaataatgttatcaactaccagagtacaaggattattccttaatatttctttcttatcttttagaatgttaagcatagcacttgtagcattaataaatatctgttgacttgaagtaaaaagttgagttgaacttgcttatgaaaatccaatttgaattcaatcattgaac

SEQ ID NO: 530 - DNA, 24661 bp, Homo sapiens
ctgactcccagacctcagaaattcaaaggtcaagaaaaaagtgccagatatgctggcccctctctcaggagataccaactgttctgctatcctcattgggaacacacaatgccccatgtcatgtgtgtagaacccaggctggtgagcaaggaggaaaagaaccagatgagggacaaaaataggaaaatcagcagggaagcaccaatcccaattctggaaacatcagaggccagagagataactgcatgaccacgagcaaaaccaacctcccctttacttcccaccctggttttcccaatctaaccaaggacagggctattcgtgggagtggggatcacgaagagccatgcccagggacacactgcacatatgagggctgagactcccaagcacagccagcagctacgtctggctccagccctacagccagggctggccagactctagccaacacttcttgagggacttggctcactccttttagtctccccagctgcacccaagtcgatatctctccactccaacaccccctgccatccctcactgcagtactgctggagggctgagacctgtcagggtccttgaaggaagagacatcagattcttccaaacagccctgggttcctcaggctgttcacagccaacctagagactcacctcaaatggacagaggagaagaagaaataacaggaagcagaattggccaatcttccctggatagcaacgggagcagcatggggaagaggaaccccccacccccaccgaaacatatgagcagagagaggcgaccactgtgtggccagaggtaggatcccataggtacctccgaaaattacccaacataattccttttatctttagagcccagaccaatctgctgttggctaattccaactggctttactggccaagaatgctgtagtcatctactcgataggagagagacttcctagtgatgtgtgggcaccgagagtctgctttgtgaattgtatcaatgatgccactgacctccctgattctgcaggccgtcatcatttttcatttttaatcaccattgctattactgtgatcggcagcaagtgaggcagaagaaaagcatttctttgtcaacttcctagagatgctttgcaatggcttactggaccagggattttgttttttaaggcaaaggtaatgaaggcctagaggaagaaagtggctcattcaaagaaaccccaaaattagggagagtcccaaagctcactgctcagcccagtccaaactccagaccaccaacctagactaagccccctcaaggcaaaatgtatctagagttaagacaggccatccactgagactacacaggggagagaatccccaggcaccaggaaggctcccaggattaccgaggggttaaacccagaacctcctgctggatgctggagccaaagagagtttctattactgtgggaggcccaaatgctctgccaactgccacacccagcaacactacccagctatctcccacacgtccgcacagcccgaccacttcagctgcccattctgcccccaaccctgtgctggttactaaccccacacagaaaagccagaaggagaagaatgcaaaaaagagaacaatcgtttgggagattctgaatggagacgtctgaggattccccggcggaataaggaaaatggtgttcgtgggaaggaaggaggatgggggaaggctggagggagcagcccacactggacttacctgggaggcagagagcggttaaatcctatttccttgctgcatccagtttccagtaagcagcctggtgatgattcactgacaagactggggtcatgtcgcatcagtcagcacttgtggtcacaaaaccacaaaaattggtggctcaacagcacctatgagaggaaagaggggaatatccaacccaccctgccctgaaccagccaacacaacatgctcacccaccaccaaaactcctccagaggacagctgagccctctctgcccaactggagccagatctccagaaaccccaaatgggtaaggatgaagagtagacacagacccaggatgccagtcactgtgtttgccctcatatatcctaaagaaaatcaaagggaggaggaagtggtggaggaaggcagggaatgcaagaggtccgaaagaaggaagagagaggtcaaaagacatccttaggcaaagcatggcaaacaggaaaccaggaagagaaagcggaggcagggctcaactgtaccctcagccatgtcacatgcccctagcttctctccctctaagctcaatatccatcgcagagctattagcccttcctggccctcatcccacatcagcaccttcatctagcacgacctttcaatctatcagcatctgcaatacaggaggaaagtaagcagccctgaaccagacagacagacacacacacacacacacacacacacacacacacacacacacacaccccttcccagaataaaaggcccttggagatggctcatgctctctaggttctggttctctgatagaagtgctccactcccacaggggagggcagacacgtctgataagaattgcttagcacaatgctatatatagtctaggttcctaccagcctggagatgtggagctagaacttggcagagaaccatgctaggtgctggcaaggaccatcctcccactgccagccaatggggagcctcacttcccggctgggggccgtgagggcacacagggtccttccaggcagcccattaacactccacactgagggacacaggctgttggctccattttagggaaaatcaacttctcccaaatgtgagggggatgtgtgggggctgaacagcaaattctagcttctctgcagctatccagtagcatgagaaaatcaatctagtcctctcttctggaggactaagggtggggtgtgtgggagaagaatggagaaggcatagcaggtggctgggctcaataaacatctacccatttctgatgttcgaagaaataaaggaatgtaaaagaatgcagatgaatacttactgcagagagcggggctgccaggcatctcctttttttgttccaaatacatgcaagtgagccactctatccggcagtatgacggctgtctccggcacactggcaccatcctcagctgagcctgagtcgccaagaggttgtcacccactcacagagcaagctgcactctcctgagtcctctatgaggaagaagagaaaggaagataggtgggctcagctcacagagccaaccaagcaatgaatccagcagatcccaaccaggggcccatctgggttagtatgtggctctgggatgatgacccttagctgttgcccgccatccaatgaaagacgcaagacaatgttgggcaaaatgacatgggacctatgtcctggagaaaggccagtaacagaagatgcagggtctgatgaaggagggtctgtttaccacctctttcagaaaatgaacctgagagaccacagagctgcctgaagcccgaaatccaggctcttatcatatacacagcttgggacaaagaaaatgagacacgaaaggttccaacgtccatatacatacaatctttttaggtcaagctgctctctactcgggtgcaaaacatgacatgaagcggctgtgtctgcctttgcactctgagtggggatggctggctcccaccccctgccctgcttaactctctcatgtgacctcggtcacatctccctgccctgctctggctcccaaggcccaggagccactcctaccagagatcccaaatgagtcaccctgggaggtccttggagagaagaggaggtgctcagtgacaaatgtcactgctagcatcatccgcgggaaagcatgagactgaaaaatagtacccagtgaaaggagggagggggctgcggccaagttgtccctcatcctcataagcaattgtttgtccctctgccccacgctccagcagagggggtagagaagagaaaggggaggacggtttgtccgcattcagtggcagtggaggtgcatcttctctctcggtcgcaagaaggtggggtggggtggggcggggcggggcggggcggggcggggcggggcggggcggggcggggcgggacgggacgggacggggcgggacggggcggggcagggcggggggatcacgcgcctatagcgcaaagctgcggtatggagaaaagcctagaacccacagccgccatgatgacgcaaacaaaattaaaagggtcaagaactcaaggcccactgtttcacctaagaagaaaaggaagaagatgaaggggagaagagaagctctgatttgggtcaatatggaaaggggaggctgacgcaggctgcccaagagccagcctttagcttagtgacggtgatgcggatccgccatcttgaagcgccgcccggcagaggactctcaagacgccacagccccaccacggccacttctcccaaggtacaggtgcgcccgcattcactgaggtcggcctggcccacccctaccccaagaagcgaatcgcccttcattcaaggcaatgaccagcaagactatcacaaagagaaccacggtgaaaaatcccaaagggctttctgggccctgggaagatgtctgtcatctgggactagtgggaagaactcaaaaagtgaccctatttgccaagctcatctaataacacatacagctgttattttcttttcagactctaaaatgcaagggttcccagagccctgctgagttacctggtgtcgctcccatcctgatgcccgggcggtggccgccttctctgtccagccctccctgaaaatgaccccaggctaaggatcagctcagagccccgagctgtttttgtagctttcatgttgacagaacatcctggccactctgctgagagctccatctcccggctcccgatacactgagtcatcttccaaagaggaaaaaaaacaacaaagcagccgtcaccagggtccccattgccgtcgactgacgactcactggctgtcgtcacactctgctccgcggcccccgaattggtaacgaggggcttcagggtgcccagctcccctcccgtgggactcagcagcgtcagggaagcaggcagccactgctgagattcagaaagaagggaaactaacctggcatcaaaaggctcccaggaaagctcactgaccctccctctgccgtcaccagcccccaccactcagatgccatggcatgttcctgatgcagaagtaaaggggtatttatggcaggtgggggacagtacaccttgcaggcttgaagggcgtaacgcctaggttacctcctctgcgcccctgctgtgataccacttagggcacaggagctcctgtctcccccatttcttctctagccccctgctatgctcccattttaagtccctgataaaccactgggtagggatgggaacctatttgctgccaatatattaggcatttctgtataacagttgtagtagctccatctcactgaaaacttaaatcatatgacttgtctaaagtcactcagctaagaagaaggatcacaatgaaaacctaggtctgttcaagtccagtgtctctgctccctgctctctaattctggagcttattctggctttgaagatgctgtatcccactccacctctccctcctcttgtacgaggaaggcaaccaggataactgagtcagttaatccatcaatttcagctacaagaaaaaagccatcatcttgagtgaacctgaccacaaaggaagaggagaaagttaatgacagtgtcaaggaacagctgagggacccagaccatggacacaagattgaccacccaaactccctcagagcattagggacttacaaaattccttaaatagacaaattttggggatctacttcataacagccatcttgtaaacaccagtaattcagagaggaaaaatgtaaaggctttggaagaccagggctctagtcatgaccaggccacttactagacatgggatgctccccacagggctgtggaaaggagtaaatgaagtaactgcagggaaagtgtataacatggtatctgtcaaacagaaggcaccaaataggtatttgttttccttctcctttctctagcctccctcctggagctcccaatctgataggtgacataagacttatacacaaataatcataacacaacaaaagtaccataaaaagggacagactgtatggaagtttggctgaaagggcaggggtggttatgagaactgcttcttgccaaggaaatcaggagaggtccacggagaaagtgagactgccacaggtggatgcagaggagaagaggcatggaaaacatcactggtgaaaacagataggaaaaggaagttgcctggttttgttggaacctatggtccaccaaaagaaactgagagaggtaagactgtacaggaaacctaaggccagttacggccagcattgagcatcacgctaaagggaaggaattttactctgggaattatgagaaaccattttaagtttctgagcaagaaagacaagatggccgctgcacgcagaagggcctggagagagggggaacgggcagcggggagcctcacaagaggactacagctggaaccatggcactggcagggggcatggaggagaaagagaagaaaaacagtaagcaggcaggaccatccgaacagatcctcaaagctgccatggacctcacttccctgtccccacagggaggctgctggagacagagcctatttggggaacacaaaccacgggtctgacacgtctgagatgagctgccgagcctctgcctccactctcattcagacactcagcttttccgaactactccaagcaccaggctgatgaggacatgggaaacccacgctctggcaaagccgggcccaggtgttgaacccctacccagacgccttccacctgaatccccacccaggactgtgtccaagggtgggactaggcggctctgcccctagagccaccttcattgcggcagccaccactgtgcctgcctctgctgtgcttttgcccccccttcccctcctccgtcatagcccccgccccccgcccactctgcggaactggcacagcaggacagaaaaaccaacgccaccatgtcggagaccagcagaaatggctccaaaatggcagctcatcagaggagtccagaaagatcataaacccacccagggaaaagaggggaagccagtgacaaggggagtaaactgtcaaaactacctcccaaccaagcccccgataatcatcacatcttttccttcagaaacatcctctcaaaaatcagatgggacatgagtgaaagaagggtgccaccccctccaccagagaggccctaggggccataggtggtatggggcactcagaaggatgttctgtagcctcttccccaagatgaggctagaaaaccaccacttttgtcctcaagcttggctcctgccagtaactagacaagagttagccctcccagggattgcagtccttcactgctacccagtcagaccctccccagctctatgggccctggggagcaagaaggtagggttgcaaggaagggccgagaaggcgcgtgccatgccctcagttatgtaataagaagggcggtgctcgtcctaggccagagacccagggcgcactgcgcttccagatgcgcagtcacgggtgggggccactgcgcatggcgcagggcttggtaaaccccctccccacaaacgtgagacctgcgacaaagacaggttagagagccgggaccctgatttttcgaggcctccctcccccaaccaaaggcggacagcctgctgccctagttttattctgattctcctcattccctagactgacaaacctttctaacccggggcctccaaacctcccgtctcccactgacttttctggaaatcccaccagatgcggagtttcgagcaatttcctggggtcagtcccccatcctcacctttccaagcaccacgtagtagtagcttccagaaggtagatctttcccatactgggctcagctcacaactggctcttgagggcctctggacagccccggacgtcaatgcaaatctgttgtccccagggagtagcccagagtcagcaggaagcccagggtggtggcagtatcagcagcagcagctctgccctaccttgcccatgcgtttccaggggagccaagaattattttgccgcaacactgaggtgtggctgattggaaaattcccttttccaacaccaaactacagaataaatattttcttccaatttggtcaaccctctgcatacccatctccctagcattcttccctctaaataaaaagttttgggagccctgagctcttcctccttatagtgcgtgaaattttaaaaggcataggaagaggcttcaactgggcagtcaaaagcaggcatagacacaggagcctacgcacacccctaaagagattttagaaagctgctgggcttctccccgctcccctttaagcaagtgaaatgcaaattcagatttgataccctgccctgagccaatcaaaaaaagcttttcacctgccattggcccacccaccaatcagaggaagtgtctggagggagagccctcccctggccaatggaaggccagctcagtcacttagttaatgatgcagcagtacagggaaggccatcacatgtgaactggaagggagccaacatggagacacagagagcgcaaggtaaacaactttccaacgccaaaaggatgacatttaatctctaaatgctagcttcccttcttagctcatccttaacccctctcagctggccacagagaccccaggagcctcactacctgtccccatagagctcctaaccagatgcaacagtgactgcgtcaccattccccacttttcccaactacgcagtgacaaacctaccagctttaccccacttctcccagcccacaccccaccctggccactcggctccccaccagcctcagaatcccagggccagacctttcaataaggcaacccctgggaaaaaactgtccctctgtcttcctttcggcacttctcactcccttaccttccacataagacctgcacggacagacagatggacgctgacacccaaacaacttggagaaccagtctgtctgtccactagaaggaaatagggtaaaagctgggaggtcaggtgggaagcaggggatggttcactcctctcacctctaccctggtcaggcttgagcagctgacactagggaaaagaaattaaagtgggaaaaaaccctccctcagagaaataaatagcaaaaatcgagaaagaaggtgagaaagacagagcacccacatacacagagacagcgcccctgatcccagcaaatacatacgtgggggaagaagggggttacgccatcaagtcctgaagcccgtcggaccacccatcgccgcctgcgcagacccaaatcttggtcccgccgtaaggtgccgcagtcccgaatgttccagaatttggtcccatcaaaccctccaccgtcgccccacaacctcttgctcccacccctgccccccaccaccaccccacctcctccccacgggaaccgcccgtgccaccttgcgtgtcatctcctagcctaggctacccagaggcctctggccctgacagatctctgaacgctcagcaagtgagctggcagaacctggtgcccggtgttgctatgacttgtttcttgatttctctctctctctctgctgcagcacggctgttgctagcagacctatcgacggagcttgcttgctcgctcgctctctcactctctctctctctctctctctctctctctctctcagctctgtgacgcagatctaaattctccagtctgctccttgtgttgcaagagcagaactgcagcttttcccctggagagccggagggcagtgccaaggctggtcaaacaaggcaaaaaaagttgggcctacactctgcttccttggccacacttttcagctcacaccctcccacctcacccctcctgcacctcactgctctggggcatagaggtccctgtcctttcaggctcactccttccctgaggccttctcaggcataagagtagcttaactctttgagtggcagcccccagtgcccagacagggctgccctgtactaaatgttgcaacatgttttcttgagccatatgggcttctccagccctgagaaaaaatgttcctcaccctgaccactgtcccattaactctttgtgccacagacaagtccaggattacagtcatagctgatttctgttgttttttgcctttttggccaaaaaccaggacctttttctccctggaatttcttaaggacaaaaagcgtaattaaaacattgcctgcctaccccacacatgagatccttctatcagggcaggaatttgaaaaaccaaattgaactgcagcctgaagaatccagagtaaaaccagtctggatatccatccttcctgggctcaaaattttagggcctaggtaaatacgttcaattacttttcaagtaattggccacacagtctcagagatttgggttgctgagtcatttgttcccaagaagatctgacaacatgaaaaacagcaaaacagagcaacagccaagcctggacctgaagtggccaatgactgggttctcctctccagcatgggcagtcaagcaagatgagcatccacgagccgacccccaacccctccacaatgttcatgcatggatgtccacactcctggaaactcttccaggaaggggtggtccaccaatgatctagagatggagtggggttgtttttggatactcacaggtctccactacagcaagcaaagagcccccaacattttcctgcccctccccccagacgcaaaaatgcttccaagaacaactgagatactaaatcactagaccctacatacccagatagaccaagggagtgttgggttcccacactgctacatccaaagaatgcagaaaggttcccgacaaccagttgtaccatatgagcctagacttgaccagaagtgagtgagatattcaggtcctgggtcaggtaacttatgaagtctatgacatcaagaaccttgcaacttccaggaagatgaatgagaatgcgaggccaggcagctaccttatcccatatctgcttcccaggcagccttcttcaagcaactactctgggccaaagtttcatccggcagaaagaaggaccacttggaagacaagcatggcactacacagttttaaaagaagaccagagtatctgtgccaggctcccagcaggggggaaagtgcttcaaattcacaccttctgggctccaaggttgagcatgccaataaagaagttacctactggtctgatgaccaaaggaacgtggccttgatggcactaaagcaagtcccccagaaaggtcctctggttacttaaatcccatttgccatagtttccttctccatggaagaaaaacatgcctaagttcatgtcaggacattcctgatttatccaagagcccaggatcaaataaacaaagggctctgagctctgccagggagcctcctccttcaggaggcagaactagagggaagtaggcttggtacagagctggcccatcaccccatgaacttggtgagtgacgtggctgctcactgccatggcgatggggatgttacgggtgggtggaagtgagagaagaggcaaataagtcatgagagacgaagcgaaagcgaggcagggtcacaggaggaacctacaaagccacagaatttgtacagaggccgactgtagtctatgaccgcagcaaaactaagctgagtccctgcaaagataagtccccatctcaggggtgcggcatgaaccaactatgactcgcaaaaacctatgacaacactacgttcagcaaggctttgtttcctttcattttccctctaaatcttttccttcccatgaccccgttggtacggctttgatgactggaagaacactagggttttcggttttgctccggtttgaataaaatgacacagacatacatggagtggttttaaagagtggagaatttaataggcaagaaagaaggaagaggcttttcctgtacagagacagaggggggctttaagccgaaagagggaaccttgagtgcggtggaaaacagccagttatatgaggaggctggaggaggcaggattaaaacagtcattttaggtacctctgcccaattctaggtcttccttctattaacctgattctacaaggcaccaagaacaaaaaaacccgaatgggatgaccaggaagcagaaatgaattcagttccaaaaacatgggaggatgtttacttagcaagcacgctcgagcctacaaggaagcagttttacagggtgctgcatgcagtgtttgatttcagggggtaaagataacttcagagtggggaaaaggtgctggctccttctactcaccctcagaggcttggggaggccaggccagcacaaacttgaaaaggcaaggcttcagctcaagcccaacaggttgccggctctctttggctcctcggcagctaccggactcaggaactaaacaaactctccagacttcatgagcattccgtggcctccgactgatctgggtcaaaacttcgaaatgccaaagacaaagaatttttttctttaaaggggaatgagctgaactttgacccgcccttgttcagggtgtggaatgcaagcactgtgtaccggccacaaactccagttcggcaggcaacagccagaaaagcagtcttcatgccggcttcatgccggcctccctgtcctgtttcctctttagggccaactcgacggggtctaggtctttacctcgctctccagacagggaagctgtgcagaggacacattccaatctctgttatctagagctagagtggatgttctagataaatctggcagcgatctggtctcaggtggaactgacaggcccagtccacagcaagatggcatttctgttcactccctgggagctggtggacaacaggcgcttggttaccacctgaggtaaatcatttattaagtacctactaagtgctaagccaagatacagcacaggaaaagcatcagaaacagtccatcatggagaacacacacattccagctgaggctaagtattcccaaatttgcattgctgatatttaaaacatctgcttactttaaaagctgagatccacttttgcaatgaaataatatcaaacatactgcttggttcccaggctagctcacaaaagcccattttatccactccaggaagtcatcaactccagtgtcttcaggggccatgcaggtaatgaaggagtacagtggcctggggaggggatgtgcccagtggaaggaccgtgccactcctgatgggccaccctcctggctctgcctgctggggaccatctgggaacagagacccaaagagtccagatcatccaggttttcagggcaaggcggaaaactagctttatgttaaactcctgattttttttttaacactgtccagatattttaatggtcagaacatacctatagagcttccagtttgttctcctggttgtaatgtgtctaaaatacaatacgtttgtaataaaaaaaaaaaaaaaaaagagcaagcattgccagagtgaggaattaaataaaataaagaacatacccaaagaggaaaactttacctcacacatctgccatttgaggaaaataataagcatagaggaaaatgaggaaaatttaaaacttccctgagggctgcaggtggagaggtgtatcgaaatgacttccaagtatacgtgatttaactgaagtagtaataatatgtgtgcatcctgacctgccagctaggcagaaaagtcatgctgatatactggctctgtctcccagttgagagcgcttctctggacatccacaaaacgtccatccagggctttggtgataagattggaagggcttatcataatccagctgcccattcaagacacagtaccctccacaaacaccaccgtgaccaagtcatggtctagccccaacttgattcaataactcccaccacacctttggagggttcagacaagtggaacacaactgagatgaaatctctctgcagggaaatattagccttcaggtctccactctgcctctggagccccagagaacaagcctactcccccaaagacttggagacactttaggatggtttttacaaccagaagtttttaggctaaacaagaaggtacaaaaagggaaattaaaaaggaagggcggggggaagaagccagagagaaatattctcgaaataactgatcaaaagttaacaagccaaaggaaaagaggaagagacacaggcattcatgagacaggagcctcttgtggccaaaccaatagcaagtgaagaagcacatgggaaaggaagggcccacagtccatacacaaaagaaaatgccaagagccaccagatcagacagttcccaaggccagccaccaggctgtgccagtgatccaggacatactggttagaaccttgcactgggagaagaaaactgcatacaactcacaattgttcagtatggaacttttttctgtccagggggaagggtttcttttactgatggatttgttggagttatttatatattctggatatgaatccacttgccaggtataggtactgagtatatcttctcctctctgcttggcttcactctcttttattgatgtcatttgataatcagaagctcctcattttaatgacatccaacttatcagtcttctcccttagagttagtgctttctgtgtcttctttaagaaatgtatggctaccccaaagttataaagatattctatgctatcttgtagatgaagttttgttttaattttcacatttagattgatgatcgctttggaatttatttttgtatatgatcaagattcatttctttcctgtggatatccagttgaaccagcactgtttattaaaataaccatccattccccactgcccagcagtgccttcttcatcataaatcaggtgtccagatacatataggtctgtttctgagctccctgttccatttctttggtagaaataagacaaacaaataggtctgctattacggtgtagatcactaattgtaaatctggtcattttaacatgtttacaagtaaggtttaggaaaatacactgaggggccaattgtgagaagccagcttgatgtggacatgcatagtctgagaagagaactccagcctgggcttctgagaatgaataggatgagcaagaactggtaaagaaatagcatcactagctaaggaaggggacagcaagaagaaaagcacagaaaaataaaaatcagccttatttttttgtggagagcaacatagtgattaagagtacagactcacacagtttaggagacagcttgcatccaaatcccctaatactatttagctgtgtcaccttgggcaagttaccttggcctttctggcctcagtttcctaatcagcaaaatgggggtaatcttcctcattgagctataagattaaatgggttaactaatgcatatcttttagtacagagcttaccactgcaagcattcattcaaaaaatgctgtgtgctatcatcatcattagtgacaccatggagaacagctggactgtcagagcaatcttgccattcaaccaacatttatagagtacttaactaccaaacaaaaatattacatttagtggttaaaaactctaactctaaaatgagatagatttgaatctgaattctagtgcagcctcttgactaattatataaacttgaacaacttacttaacctttctaagtttctagtttcagcttcatctatacttcattgggattttcttggagaggatgtgagatacagaagtaatgcagcacaaggcccaacacagaataagtgctcaattaatcccagctatcactatgatgatgagaatgacaacaatggtgacataaagattttgcatttggtataagaaaaagcctaccaacacctcaaaagacttagaatacctagcattctcagatcttccatccaagtactaaccagacacaaccatacctagcttcatattgacgagataagtagacaagatcaagtgtgttcaagtggtaggcccaagacagataaggagcttagagaaaaaaaggttgcagaagccaagtaaaagctaaattactgggatagttcaacacctggtaaggaagagatgaatttctaacatcaagcaacttcaagaagaaacaaaaatacagaaatctaagtatatataatcacaaaaagtatgagaatgtgctcgatgttggggtggggacagaaatggtactcatagagtagaagtctgatggcattcatggggaaaaggctcctaaggagcagtgccattaatagttgcagaccaacagcagtgatcatggtgtggtcagacctcagccatgaagaccacactgtgccagtctcctggaggaactaccccagagccactgaggagctttcccccaacccaagagaccatgacacttccacccatgtcactgagctgaagcgaaacaaggcccagcagtgacaacgaacactccaaggacacaatgcagtgccaggtgccaagtgaaaatccgagaggcaagggctggggacagcctgtgctggagggtaggttctggcagaggtgaaatgcagacacacactcagaatgccgccacagacagggagccggagccaggcggcagagagtgagtgacctggcagacgctggccaagaacacagggctccccgaccctcagggtaaaggaagacaagcaaaggccaagttgagtgctgaattcacagcacaaatggaagtgaaccccagcaccaacagggactcccgtgtgaaatacgcccaagggctgcacagagaggggcatgtttgcatgggggaaggtcaggcctgcaacagcagatattgtgactaggatgctctgtttgtaagtagatgctttttcctggacagacacagtcagtctgtctctcaggccagaaatccaggctccaaaatgtcctgcccaagctggctcccatcacctcttgggaaagtgaaacaggccaaaacatctatcttgtcttaggccgctaatcattaaatctaagctcccaccccagagggctcacaactcagccataagcaaaacccagactggcaatagcactggcacctgctatcctgactatgggctggggctgagtgaatgtggccactctgctaaccactggtcacagctcctgctgcctaaaatacaggaggacaaagtcttcttgggactgagggagtaacccaatgtgcctcttggctggctgctcaaaatcttggccctgccaatggatggaaataatttccagagagacagagtgtggttgggccatgtgagagggacttgaggagaacattactccattcctcaacagcggaacctgtagcctgtgccaggccagacatggccgggattgaggggtcttggccagactccctccaggcacaggttggtgccctcagacgctgctgctgctcttgtgggcaggaggagatgtctctagggtaggaagaacctaggcctctgatgatttatgggtctgtgctgacctctgtgtgaccacatgggtttagcaccatgtgacttaaaaatggagtcgctttcctgcctcacaacaaacttctgctctacttaactgagtcagatctagacagcaggaatcataaacacaagtggggcaggggattccccaaacacttctgacttgaactttcatttccatactgccttatcccccaagcaggggcacgtccgtacctgcagcctaggacagaggagaaaagagaccagggccattatgcatggcctgggtgcaggtccgagctttcagcaaagtgccagctttgccaggagcagggacaaaacttccagggccgagactctcattcaggggtgggagaggagctggggactgtctaaaacataacagttaatatttgggatacgttttcataatgtgaaaccataccaaaagtaaagttccacaaaacctttgatgatgtgaatacttcctctgcactgggaggggatgttgaccagaatctttgggggtgggaggcagtcctgtggttgatttatttactgaaggtaggtgttggaattacactcttttagagggttcagctctctgaaaccccctgggaccactggacagccattattctcaggctaggatttgacataggcctccgaggccaatgttctttctccaaaagcagcacagcaacaacagctctgccttaaaagacagaagattacacttagaagatttctccaacgccacatactttggaggtgagaggagtaccccatcactctccctctgaaaacttcaaaaccttcagaggccagggtgaatatttagaaagcaggcgggtccaacagaaagaacggccattgatctattccaaaaaaataatgtgtttggggcccatgtgtcaggtacagcgcgaggcactttttaaggagctccacccttggctggcaggaactccctcggtcagcagaggctggtaaactaagaaagcaagatgctaggaggacagctggctccttaatcccaccctggccccccaaacaagacagctcaagtcttgccggccctggaggcccaggcacttggacatcacttgctctatgcctttcttgggaggcagagcttagtgggggttgaggagagatctacaggctgagtgcgctcatgacacaatcaagaagtttctggggccaggtgcggtggctcacgcctgtaattccagcactttgggaggccaaaagaagccaaggcgggcaaatcacttgaggccaggagtttaagaccagcctggctgacatggtgaaaccccatctctactaaaattacaaaagttatctgagcatggtggcacatgcctgtaatcccagctacttgggaggttgagtcatgagaatcgcttgagcctgggaggtggaggttgcagtgagccaagattgtgccattgtactccagcctgggtaacagagcgagactctgtctcaaaaaatatatatataagtttctgggtaggctgacatgaaaaaattaccactggagcttctgagagccctaaatcaccataagggtagaggaaggaagacaggaggaactgagatgctgagataagctgggatgtcccagcccacttccctagagaggccctttcctaacagccagcgggagaaccctgttcacggagccctatcactgacctcgagggcagcaccagcatccacagtcaggtcatcccgagagtcgtaaccactgttcctgccccaaacccaatgaccctctcaaccccatccaaatagcccaggatgagccacaagacagggccttagaaccctgggggtgtaagacaccctgaatgtcatctggcctcaccttccactgagacaagaagattccgccttgggttagagtccaaggtgtgggatcttgggtgagttattccatgtcttgcctaaattctctcatctataaagtagggctgataagctcatcatacctcttcacagtgttgctgtgaagattagagtctatttgagtaaagcactcagcaacagtgcctggtacccaacaagtattcagtaaggaaagttatggctactgttttcattattagcacccctgcatggtggacattcgctcatgtgtaaacactacagggcccacggaaggagctggagacctgacagggtcacccatcttctctccctcacatccttcacagcccataaagcaagacaggaatccagctcccaacaccaacgtctgcctccctgtcacagctacccactggccccagggctgccccctgaggtaccacagggtaactctgacacccacatcacctgacagtgctttaagcacacaatactgtacctagcaaaccccctctcaccaaaatctctacctctctgggccacgcagtctcatgtttttaaccactcttcacgtgccagcagctctgctctgtacttcaactagtagtttgacattttccctcctaattgagatcaggaactggagcggccctccaaaagtggcctgagaaggccaaagggcagccggctctgatctcccagagaaccttcttcctcccttaggagtcctcactccctgtcttgcttaatcttcccctgcccctcaactcccaacccagccctcccatacacacaataattaaaaccttgctatgtgccttcttcagaccctctcagtcttgagcttaggaatctgccaataagcctttgttgaattatttctgtatgacacacactaagccatttcacatatattatctccattaatctgctcaatttcccttagctgggaatcaatcccaatgctcacctgctcctttttcgagagttagctggatagattctttccacgtggccaaactccagcaaggagaaggtgctttgatactcttgatgttggacaagagtctgagacccatggactctactagactaagcaatatgtctacctgtatccttcactctttcccagatgagatagacagcaatcctgcaggccccacgtttgccatgattgttcttccttctccagatgccaacagtttaaccccttgttacaatttagagccaagataataggctgtcatgtctcatgtcacacgtggctcatctgtagcctccaattagagtctgaacttttcaaagaaagggtccaggcaagcttcaaaattcttttttcattcttgccaaagcgatacttctagcagcactcaatcaatacttgctgattgcctgattggactagattaggcctgtcaacatgacaacccctaaatccccaacaaacacactggaaatgggctcacttgatgtgaatcccttccctgcccacccacacaggtcctctgaggtttctcctactctctccttcctttgatctaaatgtatcaaacaagaatgtgctcttctaactgcagcttctggaaagggtccccaagcaaatatcaaagggacactcaacctgtagtgtcacaaacaccagcaatcacctcacccctctgcctgacggatgccaaggacagctggctctggactaaaaacagtgcaaccccaaatctgagccctggggatcttttatgtgttttccttttccctgtgaccccatgtgaggctgagaacaaaggagacagaaatcagctgtcctcatcacacaggtgggaaggccactgtcagacccaccctctcccagggaatcaaagaccagagactctaatggttccccatggctaccaactgtaaatttcaactaagagtagaaagtggccttacctgatacggtaacagaagaagaaaggaaaggagcagaggagtgccacccagggccctaggaggtaggtggagaggtggagctttgcatgccttcaagtgcctcctgcggtgggctaaaactcttactgttattaagaacatacagcaaccaaggaaaagagggggacaaaccctctactttatggcctagatccaggcatttcacagattctgatgcgctccagacagaagctcagggtccttttgagacatgaagagtcttgactgcacaagagaagaccaaaagttctttggagatggttctaggtccccactttagttaattaacaagcttttaccaagtacctcctaattcttctaagtacttccaacacctacgacacagccaggcacacagtgtggatgctgctactgaatccaggacaggagggaaaagagaatcaaaattaaatataagatacggttcataaccaaaggcgttcctgaaatagcttccagagctaacatgatttgggaacagttataaaacagcctcactgctaggaagcttctcgtgggcctggactgcgtcttacagccctttaagccaccacatggtgcacatccatgtccagtaaccatccactgggcaaacaggccgatgaacacaggaaggaaacacagcacaacttccgtgaggcctacttctaaacattcgaaataccaagtttacccctcatttttggaatcatacaatgctgagatacaactgactggccacttcctgcctacctgtaggctatccccagagtcgtcatgtatcacctttgtataagaaatgtgtcccagcaagccaatctcaacatttaacctccttcccacacccatcccaacacttggctcccccatctcctttttctctctcatatgcagaaccaagtaacaagttaaaaaatggcaggaactctttctgagtaaactttgctccttggccaagatgataaagctgagcttcaccgtggaatgcgtccctcctcccggtgattggtaacctgctcaggcacagaatggaagctggccagctgacctccaggactcagccatctccctggggcctgcagaaggaccagggacagaggctacctccctgcagcccttgttgggccccacggccctgaccaccaccgacccccactttgggagatgaggaatagaactagattctccatctggctgagagcccgtttacagggctctggcttcctcccaaggctgccctcagtcccaccagacctctatgttctccttgtccccctctgggagatccttcaaataaggccaaggcccccaattagcatgccccttgccttttatctgcccaagcagcatcctcctcatcacgaacatcaacttccacattccacaaacctgccacgttgtcaggcctggtggttggccccgtgctgcctcaaagctcattcagcattccacgacagcgggacgaagctggcactgttatcacctctactccacggataggaactggggagcctatacgaggaggcacagctggtaactagactcagagccctgtctcttaaccgctgtgctgtacatgtggatgacatcccttctcctctgatgagacctcctcctaatgcctgtccttggcagatgaactactctctattgtcatacttgaccatctctggcataaaaggtggggctaaccaggtttccttagggaaaaaaaaaaaggcccaatacacgtgacttttttgtacataagtattttttaaacaagtttttactactgactcattgaaatgaggtgaaatgtatggttaaccccttccagtttacaaagtgcttttgtaacaaattaacttcattccccatcaaagcctagtgaagtacatgcaattattcccattttacggaggagaacatgaggaaagctaggagactcatccaggatcacttagccaataagcagcagagcaacaaattgaacccaggactcccaaaggctaaatcctgacttttgggtacctagccattgagagaaaacacagcattggcattcagagtgggagcgtgggagtcacaaagactcacactggctgtgtgacctgaggcaagttaattaacatcatcttgtatcactaaagcagtgctactaacaagcgtgacacatggttactgtggggattaaataagataatgtatgcaaagtacttagcatgatgcccaacacatagtaaacacccaataaatggccgtgatttttattactctccactgtccaggcagcgactataacatctccttaactctctgtgtgcctattatagtggacatgagatacaaaactgtatgtagtaggtacttaatacaggttgactaggagcaacttcctgatatcccagccactgtacctcacaaacagctgtaggcaagaataacaggacaaagccaagctcccaaccacagcaactagaaggaagcagtgtccacccctgaggaacacattccaggactcaaaagaaagacagaagaaggctcggagctgcagtctctagacacgaataaaatggccgccagcccgtgccctgtgccagcctgagcacagctgtggctcccaagggcaggggtctgtgttttctccacatcctgcatcaaccaccactccttcccagggctctgggtctctgctcccggggcttgggaacatgcatgtccttggtgagaagaccacataaaagggcatggcctacttccaggagcctccctgattcccacttcgagataaaaataataaacacacacacatacagagggcggagagtgaggggggaattaagtggtgtagaagctaaggcacaaggatttacaaagcacagggctgcggtaacctggcaacctacgaaaggtgtgtcagaatgagtaggatgcaaatagacaagcaccagggctgggaacagtcagggctggacgggggaaggtcacaacgtgctggcctggttccttgtggcgctgagctgaggagggagggggagaacagcagataggacgctgctgcccacgcagcttgtgactcccagctgtgtgttcccaacaggctcccaactggccactctgctagcttcaggctctcttctcca

SEQ ID NO: 531 - DNA, 25220 bp, Homo sapiens
cacaccttattcctgtatggttctcccaagaatccagcaagaaattattcttttctcttagccagcctcaactatgtggccaattgatcttgtgaccttggggaactttctttgcctttctgggccttaacatccccatttgtcgagtgaagggtttgttgcagacggtcaagacagcatggcgattaggagcccaggcattgatataaaagtcatctcattcaagtcctaaaggtgcctctttctagatgtgtgaccttgagcaggtcattcagtccttcccagccagattccttatccgtaggttggtgataagatcgcccccttgtgctgaggactaaatgatgcagtcagtacatctaagtggactgatcctggttcctcttcctgttggtgaaaattgggctagagaataaggaggaggccaaaatatggccttctcatttaggacttggactctcagatcacgtgagccattctggcagagactgggccttgtgcaccagcaagatgctaatcttgaatctgcacggtgtggttcccatatttgcattccctttgggttgctgttacagtgaggcgatggtggagcctggatttgtacccagattcgcacactcataggcttcttcatgcaaaacctcagaacctgtgatgcttggacgccttggctgtgtctaaagttctccagctcactcggtgaggggaaaggtatacaggggtcctgttttgagccagccaagtcctaatggagatgtcatactaggcaaataggtgggaagcagcctcttttagaaggcccatgataaaatacagaaaaatgttcctgtgtgagccaagatgtgaatttgtggaaactgcctcctttccaagaagtaggaaggagaattatatttccatggaggtggcatagattttgaacttgatctgcattaaatattatttatcttatttatcctacagctttcctgagctggcttcttcatctgacaaaggtctttgggggattgttagcgtgctctgcatccccaaaataagaaagatttattttttgtttattgatatctcactctgttcccctttccacctccctgtgggtgctctggctgaaccttacccctgcagtggggaaaatggcttggctccatcttggccacctgctgtgtgtccttggcaaataacaccacctctctgggccagagagtgactgatggttcagatggtgcagaagtctcagtttaacaggtcatctgatctggaagaatggctctgacatatacccctgtctgtgaaacaagaggttgggactccatcattccccaagtttctcccagctgtgaccctcttggcccccaactatgggttctactcctgttctgagaggcctaactgagggtttcaactctctgatgagtaaggggccagcctctggagtttgtgcagccagaaaattccatctgtctggtctttccttttccctttggacagaatccctcattccaggcacttatgaatctccccaggataccccccaagcaaagttcctatttcttcatatttgcatgccctcctctcaaaacttagctttcttgtgatgccctctgctctgttaccatctctaggcagaagctaatttatgttttgatgccaattgcagatagcaggcattacctttccaggtagattagcattttatgtctcagtctaactgtggaagttcaggcagaatgactatggtgaagggaaaatttagaagtcagtaatacttccttgcatctctcgatgcttaatcgaaatgtagatgcagctgcctcctgagtttgctgggcccaggatagagtgatgcctccacattggtagagttctctgtttcccgctttggcttctaagttcagagtggcctgggatggtttcattttggttggattgtttgtggcatgattaccctatgggtcacaaagcttggttctgagggctgatgaaattccgggtaagccctgtgctagactcactgattcccacactcaagggtggctggacccaaggccctttcttaacagattgaaggttgtgtgcaaacctatctggcctcaggcaattggctggtcagtgtgggctgtttgctaggagctggtgtttgtagtagctattctttggcatcaagtggcctgttaagtcaaggactcctctgcaccatcagttactgtctggtccctactgtcttacctcacctgtcccaggaatggacaggtagatgggggactagctaagacattagggaagcccaagtccatttctaccactttggaatttggggctgaatcactcctcctctccgagtgatttcagtttcctcctcagtgaatggatcgaataacatgtttcttgctgaactgttgtaaggacgacatggatcccagcccaggacctgacacactgggactgctggatcatcaccctcatcacaatgcttccattcagaggcagcaaatagtgccccttgaatgatgtcaccaacagccaatcagaaagctcctgagctgttccaacaggagggctccattatgattgggtctctcagaagtctgagactttgaatgatagtctagtattaaggaacactggatagtcttataataagcgagactttcttgccaccaaaggccaaaccccatgcccacttctgccatatcaagatctctggaacaatgggacttcctgtttgggccaaggggaagtgactgaaagtcacaccttactgaggcttggcaaagccttctctatcggtttcctcacctgtgatactgccaggaggctgagacaactgaacagagtgacataacatccaggaggggcttctcacccagtggtcatcacagaagggcaggagggcccctaacaaggcattaattccctggatgactttcagtaggactgactagtctttgtgttttctgcttgagaaacaaatgaggacaagaatgtataaatgtccatcattttattgataatcagcatgctttagtatggcatatgagagtataagccagacaatatgttaaaatatgaaatgtagaatatcctcattctacttacatccattcgtttgttcattggtcaggaaatattggaagtcaaatggggcctggtagatttaaggggccttgacatatgctggcagaccagatagatcaggtttttgggttggttttttttttttttttttttttttgagacaaggtcttgctctgtcacccagactggagtgcagtggcacaatcatggctcactgcagccttggcctcctgggctcaagggatcctcccacctcagcctccagagtagctgggattacaagtgcatgccacgatgcccaggtaattttaaattttaaatttttaaagtttaaaaattttaaaaatagagatggggtctcactttgttgaccaggctggtctttaactcctggccccaagtgatcctccttcctcggcctctcaaagtgttgggattacaggcgtgagccaccatgcctggccacctttaaaatatatcctttattctatatctgtatatagttttattctatttttattcctgtccatatatttttattagattttagggttagcatttagattagcattttagtagggagatgatgggggcagcagaagtctcagtctaacagtggaaattcaggcagaatgactatggtgagggagaaatctagaattataagtatatcgaatagttctgtggcaagtctacctcaaccctaaaaattgctctgtggtttttcagattcccaccctacatccacagccttacgtaaaagcattgagaaaaacttccaacttctcatactttctctatctctcttcttccttttgctctctttctaatggttcttgggaaactagcggcctctctgcagcccctccctgcccctgcctcaatcactcccctgcccacctgcctacggggccctgacacgtgctctgctttgcacaggtttgacctgcagctggcccaggccctaggtgagtcagtgtttgagaagggtctccgtgagaaagtgacccaggagaacaccagtgtccggtgggagctaggccagcttcagcagcagctgaaggtaagggatgggggacacagagctatcttggctcttggtggctaaatctcgggaaactgcatcgtgcacctgctgcaaatggtgacagagagaaaacttcacaagggtatcctggtctgtcaagcagctgaatcccagtgtgtcttaataaaatagcaaatggtggctggtaaattgataatcagactttgagcaagattgatgtcttgatcttgcttcagttacctgcacaggttccgaggtgcttacctgggaggtataacaggctcagcagagaatgagttagctataaccttgtccaggagcaatgtcctggtccaagcaggctccaatgcagagagattttactaaaatacaacacgggtgcctcactcagctgctcctcatccttttgtggttctctactactcgcaggagaacctctgagcgctttagcctggcgttcaactccttcacgatctggcccaaagttatttgatcctggagctgactttgtaacctggaagagtcatttctgagcactttgcctccctgctccaacatctcaatcccagcctcagacggcacacagggaagctttagctgtgtgcctccacttcccttacaaatggggtcaacccttcctgtaggtgctctgagatcgaactctagggacaatttattccaatcctacctcccacccccaactccatgcctgtaggagctataccaagagcagcccttgctggtgtcccacagggggcgctgtgagggacggtggggtccaggtggaaatggcaggcattggaaagtggaaaacgccactccagccccagttggttgtagaggtatccctgggggaggagggaggcatactcatgtgactccagatctctgtcctctttgtctctgtagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcaggtaggaaagccctgtctcagggcaacaccctgtcccatgtctccaatgcagagtgatgttattaaaatacaatgtgggtgcctcacttggctgctcctcatccttcaatggctccctattatcccagggaacctttaagctcctaagtctgacattcagatccttcctgatccagctctcccctgcaaggttcagtgtcacctcctcagagaagcctgccttaatcatcttgcaaatagctcccactaggttgcattcatttcccatctccttagctgggttgctttactctctggtacctgccatcgtattagatagtattttttaaaagtttgctttatgcctttctctctcattaacatataagcttcatgaagtcagattgtttttctctttctcttgcttcttagtgcaatcctagagcctagaatgaggccaggtacatagctgatgctcaataaatagctgttgaccaaatatctaacattcattgagtactgtctgtatactaacctcagccctaagctctccccacacatctcacgaatctccacatgaaccttatgtagggagatcttagtattatccccactttacggatgtagaagttgagactcagagacatggagaaagtatcagggatgggatttggaacctgtgtcatctgaccccacactgcctcgaatgtctgctatgtgctaggcattgtgcacagcttcggggcagattgaagtgctactctttggggaaaataaaataacaaagggaataagacaaaaatatcaaatactcttgtaccagtaccctctgcaaagtaccagatgaatactttatttgtctgcttgcttatttatgtacttacttatttacctcattctataaataatttgaggcagcttacaagatacatgtataatagaacacaaaaattgtaaataaaacaatccaaaccacaaaagtacaaaataaaatagacactaaggaggagggtgggggcagtgaattaataggcagataaagcataacatatggtcttacacacataataattttagctctaaaattcctggtggccagaaagaaaaaggaaatgtgagttacatgcctgagataaaaaaaaaaaaaaaatttctaggggaagtaagacttcttctgatgcttggctctaaacgaatttctcttgtgggattttgtaaaaggcaattattttaaagtgttttttttaaaaaaaatgctgaggccaccgttatgcgagaaaatgtgaccaggtgtcatgaatgtgtaaagcagatgaactctgagcagctctgttgaactgaagtggggatgggtgggacaggggatgggggaaccaggggtcagctcttgcttcttgctaaccactgctccaacaagatggagcctggtgagtatcaagacatgtgggtggtgggtgttggggaacaagatccaggaagtcttggatgctcactaaggagcgataaggaagacaagtcttttactcagtcagcctgtatttattaagtacctcctctgcatcatgcactctgtggatgctgagggtgcaattgcaaataagacagacacaatctctgccctcccaaagtttatagtcatgcttagtgttaggggaatgttgaacttgaagatctggtcgtgacagcagggttgggggagagatcggggaaaacttcctggaggaagtgatatttactgaagagggaagctggaggatgaatcagaattggctgaatgagagagttctaggcaggggaccagcctgtgcaaaagcctgaagacagacaggatagtcgtaggatattcaaggagctgtaatacggggtctttgaggcagcttgttgcctgtatgaccttaggcaagcccctgttttctccagacatcagtctccttatctgtacaatcaaatatggagccttatctctcccctagcttcctgccaaccacagctatgaatcagtgaaggtttgtgaagaaggtggaatatctgtgtaggtctttaaagggcatggatgacggtgcagtgccatgtagcaccccagtgttccttgtgttccttaaatgagcaggatcttcacagagccaagaataaaacaagccctcttgaaaactgtgttaactctttaagataccactgggggaccacttagtgctcggaagcaaaaatgtattaccatggcctcagggacccaaaacttaatgcagctgcctgaatttccatgctcagttcacccaggagatgaggctgactcaacactttcatccgtcttcagcttcacccataacctcaggctgcattgtgcccttgtagacatccagtggatatttattgattataatacaacactttttccagggaattttatgttaactcgtataagtttgacataaatggtattgcagatgtcaagaatgtccaagaggctagaaaaaatgaaaaagaaatattatagttacttgctcaggctccttggttttggattatcttcccacaacccctgtcattttaaaggaaaaaaaggcaagaagttgacatttaaagtgagcctactttatgccagaaactgtaacagggcctctgacgtacactatccttttgctcctcaccacggcatagcagggaatattatcaacattttaaaagacccagattgtttttttctgtccatgttggggacagcacttgttaagttccaaaagcttgatgagaggtgctgggacagtagagtaaatgatcagaaagttatcatttctacaatgtaacccattgtattagtctgttttcacactgctgtgaagaactgcctgagactgggtaatttatgcaaaaaagaggtttaattgactcacagttccacatggctggggaggcctcaggaaacttacagtcacggtggaaggggaagcaggcaagtcttacatggtggctggcaagagagagtgtgtgaagcaggagcagtcacgtataaaaccatcatatcttaagaaaactcattcactatcatgagaaaagcacaagggaaaccaccccctgtgatccaatcacctcccaccaggtccttcccttgacctgtgggaattatgggaattaaaattcaaaatgagatttgggtggggacacagagcctaaccatatcacccatctacgctattgagttccaaatgctttttcatgatccagtaacattaaagagtatagacagataaaggaaagcttcaaagctttcttgggccctgtaccctggggattctaatccagtaggtctagggtgaagccctgcaatttgtatgttttaaaaatgcgtttgtaattctaacgtgccacaaaatttgagaagccagggcttgggccaatctgtaaatcatgcagatcaggaaagtgaagtcttgaactagacctagaactcatgacttttttgccttccactctagaaccctttatacgacttcacacagttccaacattatgcacggctctatgcctgttgcatgtgttttggaggttcttgtttgaaagacccagctcattcatgggatcacagctcttaattatgtcaggttgccagggagggaggggatagtcttttctgttttcgaaataatggggaaagagaaagtaatatttatgtatcagatactgtgctaggtgctttatatcatcatttaattctcatagtagcattctaagacggttgttttctacagagaaaggggactgacctagaggtaaagtgaattgtctcagataacattttgggcaaatcatcttcttttccaggctttcatgtcttcatacacttttgtcctaccattcatctacctatccactcacccagaaaaccatcgctgttgcctgctccaggaatgagaaatatgtttcatcttaagagtgttgagaagggggccgggcccggtggctcacacctataatcccagcactttgggaggctgaggcgggtggatcacctgaggtcaggagtttgagatcatcttgatcaacatggagaaactccgtttctactaaaatacaaaaattagccaggtgtggtggcacatgcctgtaatcccagctacttgggaggctgagcaggagaatcgcttaaagccaggaggtggaggttgtggtgagccgagattgcgccgtggcactccagcctaggcaacaagagggaaactccatctcaaaaaaaaaaaaaaaaagagtgttgagaaggattctgaggctgcttctaaactcagtgggaaagtgtgattgatgagtgatgtctgttataagcacaagaatggatagaggcaatatttaatctatttacccaccatttgtgatcttccaggatgcctagggcaataacttgactctcatttatgtattccaaaaatgagaaatgcaattggaatgccaaggatgacatggagggcttggagagttagagtgggtcaccctcacgtgctgtccttgctgcccccgcagctccgccagcggtttgagctggagatcgagcggatgaagcagatgcaccagaaggaccgtgaggaccaggaggaggaactggaggatgtccgtcagtcctgccagaagcgggtacgtgagcagtgaacacagctgtgcccttggatcctggcaggtctggcatggattccctcttccttagagcgaggagtaggacagggtctgggatctggggacaagctctttctgcaatcatctgagaccttagcttcgaagtgacttcaaaggtgtaggagcggaaatgcccatcttaaatatgatcttggaacttccagaagcctctggaactgtccagcataatggctcagagatttctactaagtccccgtaatgccatgtgactgatgccaaggacttgtaaatttcaataatagaaccaattctttcttactattttctttacaagtcaaatcatttcttaacattttatccaaagtctttgtagccattccgaacagtgtgtaagaaagcaataaccccttgacatgttatcacctagaagccatcattattactattttaagtgttcttttatagctctctttcactctctgtacacacatgcagatttgcagagatatcattttcactaaatgaggccatgtggttctgaagcctgttgtctctgcagtttgtcatggcctcttttcatgtctgtaaatacagatctaacttatatgtttaatggcttaacagtttttcacccaaagcttatcctctaacttatacagtaaatcccctatcactggacattaggttgtttctagttttctgcccttataaccagtgccgagataaacattcttagagctgtattgatggatttgaatgtaggatcttcaaagtggaattgctggaaagcttcgggttaagcctcgtttaacaggttctcacatgtactctataagaccttccctcccttctcgtcccctgaatcatacctatgtacagaatacactcaattttgccttgcttgatatatagttttgttattttgtgtgtttttcaagatgggttttagcttttccagtctttattctaaaaacagatataaagagagcgccttgtatttctctccatcctaaacgaaatttctgaaacgaacttgctttctatagaagtgaccatcactcagtactttttccccctccatgggtcaggagatggaatctctcagtccctgcccatattccttcaggtgaagattgcacacatttctggtttattctaagaatgcctcaaagtatggtgtgtgccctgagccagggctccagtgagttggagatgtgacccagactctcctgaggcttttctctggatagatttataaaaggagagagtgaagtcagagaacggtgtttttctccttataacaaatactgatattgacttctcattctggtgactgctctgttcagtctatctctcacgttggcaggaaatcaatagttagtgacctgggtgggaatgctggggctgtctggggtggcagaaagagctggggtcaggagagaggacactaactcctctaaacagcaactaattgcagagtatgcacttcggattttccctgggtcttagtttgcccacccgtgaaataggatctctgatggcatgaggtggaaatggaggatggataatatatacaagagaggctggtgggggtggtctgcaaagcacagccacagtagggtgtttgctctagtggggaatgtctgtgtttgctgggtaattgctgagaaatcagagccagttgcaaattaaatgagtcgctcatagtcagatgtctgagttcaggctgctgtagcagaatattattgtctaggtggcttaaatgataacatttatttatcacagttctggaggctgggaaatctgagatcaaggtgctggcagattcagtgtctggcgagggctgtcttcctggcttgcagaccaccacctcctgtttgtacgctcatgtggtggagaaagagagtggaagacagctttctggtgtcttcaggcactcaccccaccatgaaagctctaccttcatggcctcatttaaacctaattacttccctaaggccccacctccagataccactgcactgagggttagggtttcaccatatgaattgtggagggacacatatagtttataacaccaaaaaatctcaaatgcaacttttttactgcatcattgtgtatttaataatggaggggatgcatttttgatatgttggttataatattgttcagagcctttaaaaatcaaagtgcaaaggtttgcaaatattcagcagtggccatggctgcaggagagaggcatctcttctactggggacctgggggagggggtttcacagtcaagggcaaggggttccccatcattgaccagccctccctactgttgtccagctcccaagcttttaggctcttaaattctcccacagagacactaccacccaatcactagggcagcctcatggaacaaagccacaagctctacattcctccgccttctgagggtccttgccttgtaggatgtgtctggatggagttcatttaccctgtgatgtttcttccctgtgtatccacagcttcatcagctggaaatgcagctggagcaagagtatgaagagaagcagatggtcctccatgagaagcaagatttggaaggcttgatcggaaccctctgtgaccaggtaagggggagacattggcagacattcagaggagtatctcagggacctatttgagagatgggctcatggagagaacagcctgagggataccctctcctccatcagctctgttcccaccatattcactggctcttcaaaggagaccttcaggtgcctgcaaacagcagggtttttgtaagaacccatggggaataaagagagtggggccagccaggagcaatggatgaggctgtctttgccttcagcagctgttgggatcagagtccaccagacagtccttcctttaaggggatgtatgtgaatggccactgcacacatgactgccctcctgagaacatgacttttgctagaagcagtcagccttggagccaggcaaatgtagctttaagctccagagggaccacttctgtctgcacggctttgagtgagctagttaacagctctgagcttctggagagtggagccttatggggttgtggctatcactgtacaccagggttctcgactgtccatcagtgtacaccagggtcctcaactgcatcactatgaacatttggagctggatcattccttgtggtagagggctgtcctgtacattgcgggatatcacgcagcatccctgacctctacccaccacattgcagtagcccacacctcagttgtgacgaccaaaaatttctacagacattgcccaatgtcctttggggaaaaaaaatcaacttccctcactactgagaactgttgctgtactaatgtagccagcagagctcagaggcagcttccgatttcagagttgcaaggaatgactcttccacctcctagatactctattcccttcctgtgctgctgctgcatgaaatcccaacacgggagagaaatgcctgtggcttctatgatttattttaaagtatcaaaggagtgtattttaatgtatttgcttaacatgggttcgatgtctattaattagtaatggtcttgttatcaatatccttccctaaattcattaactttattcacaaaacaatgtgggtgcacttcaggtgatcatcttgggcagccatgccttggacaaaataaatgcttattatgtattaaaaaacaaattgatttaatgagtgaattccacagcagggacacacgcggcaagagtaagagttggaagctgagggagtcaatataatcttccttcttctctgggttttctaattttccagccaaacaattgagaccattgaattcagagccattgaggtgactttccttcagcatcagggcaagagagcacagcccagtaccagattctagaatgatagaggggaatcactgcgagaaggttgcattctattcagcatagtctgagaaaacagaatagataatctagtaaagcaaggtttttatacaaattgcaaaaataaattttacatgtaaagagaaggtaagtttaaatgaataaaaagccatctttgtgttagtcaccaagttggatccttttaataaattagcacttttgatgattttaaatgtttttgttatgacctttgccaaacccatggaaaagcagaacaaataatgtaatcggtgtttatgaaccaagcactcagggttcacataaattaacattttgccatttcttattcagatgtttttaaggaaacaaaacgttttaagaacggttggtggcctctttatgtcgcttcctaatctcaatcctggctctgcttttctctttctttcctccctccccagatgaaaccattccccggggtttgaggtgtataattcccctgaatgtatatttcaacttcagccacatgcagcaatatgattctgcactttactttgtccccctctatgttatgtttttgagattagtctataatgatacatgcagttctaattaattcatttcatttctacacagcattcatttttttaaaatctcctacttctattggtgggtagttagttacttccaccctaaaaccccaaactgcagtgcatagtctcgtatctgcctcactgtgcacacgggcgagtgtctctccagggtatgtagctggaagaagaattgctggctcctgggaatgtacaatttgggaattattaaatatcgctcagattattccccaaagtgattgcagcagtttccatcgtcactagccgtgtctgaaattttacttcttcatgtccccaccaacatgtggcactgtcagacatttttaaacattttttccaggcatcgggtgctaaatggtattgcgtggccctccacagggatgctgtgcatttttcacatgttgattgtggctttttcttttcttttctttttttgagacggagtctcgctctgcctcccaggctggagtgcagtggtgtgatctgggctcactgcaagctccgcttcctgggttcatgccattttcctgcctcagcctcctgagtagctgggactacaggcgcccgccaccacgcctggctaatttttttgtgtgtatttttagtagagacacagtttcaccgtgttagccaggatggtttcgatctcgtgacctcgtgatccacccgccttggcctcccaaagtgctgggattacaggcgtgagccatcgtgcctggccgattgtggctttttcttatgtgaattgcctattcatagaagtttgtctcctttttctctattgatcattcatgatctttatacaagatgcgaatccatttttggttacgtattttgcaaatatctcctacactatggataattgtttcactttgtttataatgtccttagcttaataaaaaatatttttaatacagtcgtgttaatcaagcatgttttatggtttgcgcttttatatcttaagatactgttctttgagttcacaaaaatgtcatcatgtgtcttaaaagttctaaagtattgcttttgacatttttaggtctctaatccatctagattttattggggtgcatagtgtgaggtaggaatctatcttcctcaatatggataaactatgttttagttcataatttttttcctgcaattaccatgtatgcctgggtgtgtttatgaactcctcattgtggctcattgggtttttttttgtctatttctccaccatatggtcttcatggctgggttttgataactcgtaggacagcttaccttgactgtttttaaaattgcctgttttattgaccctttaatcttcttatttaggttctacaacaaaacctgatgtaatttttattggaattgcattgatttacaagttagttgggaacaattgactttttttatattgaactattatattattgcatatgccctctccatttatttgtggctttcagtaatgttttattatatttttctatacagatcttggacttttttgttagatttattttcaagaaacttgtagtttctatggctattatgaatagaatatttttctgtattctatctatatttcaactagttattgtggcatatgggaataccattgattatcatgcattaatcttgtatctagcaaacttcctgaacgtttattatctttcatacttcatctgtaggcttttttgtattttctgccttgacaatcttatcatttgaaaataagaatagttttgactcttttttttttttttttttttttttttttgagatggagtctcgctctgtcgcccaggatgaagtgcagcggcgcgatctcagctcactgcaagctccacctcctgggttcacgctattctcctgcctcagcctcccgagtaactgggactacaggcgcctgccaccatgcctggctaatttttttgtatttttcatagagatggggtttcactgtgttagccaggatggtctctgtctcctgacctcgtgatccacccacctcggcctcccaaagtgctgggattacaggcatgaaacaccgcgcccggccagttttgactcttgaccatggattggggcaacaaagatctcaacaaatttaaaaaaaaaaatgttatactttctacttcttgtttctttttcttaccttatttcatttgcctccagtataagattgaatggtagagaaagatatttgacatccttttcttgttcctgaccttaataggagtgcttgtaaagttttgtgatacacatatttgcagtgtctttgataattacagtgatggattgcttagtgacagggatactttctgagagatgcatcattagacaatttcatcattgtgggaacatcctagagtgcactcacacaaacctaaacgggatagccttctacatgcctaagctatctgatatagtctattgctcctgggctacagacctgtacagcatgttactgtactgaatttgggaggcaattgtgacacagtggtaagtatttgtgtacctaaacatatctcaacatagaaaaggtacagcaaaagtatggtattataagcttatgggaccaccgttgtatatacaatccatcattgatggaaatgtaatgtggcacgtgactgtaactttaataaggttaaatcagtcttgtatttgtaattttctaatatcttaaaaaaagatgttttattattgaatattatatgttttttctgcaattgttgataatctgatgacttgtctcaatctatcaatgtagtatattttagatacttaaggtatcctgatatatttcccagataaacctttcttagtcatatgttttcaatacacagctctttcggattgctaacagtttatttaggatttttgaaaccaggcacataagtaagattgttttataatttttttctcttagactgtctttgtcaagtgttgtactaatctcataaaatgaattcacaactatttctgagacaattttttgtaaaatttggatcatgcagttcttgcagattagatacaatttgcttgtaaccctatttgattactgtgtcaaaatgctgtaatcataattgaacacaaattcaggtattattcttttccttattgagtgaactttggtaactaatgtttctagacatttattatttcatctaatttttcaaataggttgacataaaaaatattcatggtattttctcgttatttaaaaaattctactgtatcagattattttctttttaatcataataatgtttacttttgagttattttgtggttgatgatgattagtcttgttagagttttgtctgtaatcccttcaaataacctgcttttgttttattgtttctttgttgtgtatttaatagtgtctgaccttatgtttgtttctttttccttcttttttccattggtttagatttttgttcttggtcttcagttttagtattaaaatgtttaactcaccttcaatattttttatcccacttaaactgttttctttaagataatacatttaagataatacatttacctggaattgctgttttagtgccatctactaagtgtcttgttgtatcttttgttctttttttcttttaacctgtaagttatctagaacttgagtttcaagtttattaacatttaggatgatttggagtaactttctattgttaatttttaatttaatggcatttaggacagataacatggtagaatgcataacatcttttctttgaaattgttgagatctctttgttgctctagttattggtagagtttaataaaggattgtgtgtggctgggcacagtggctcacgcctgtaatcccagcactttgggaggccaaggtgggcagatcatttgaggtcaggagttcgagaccagcctgaccaacatggtgaaaccctgtctctgctaaaaatataaaaattggccgggtgttgtggcgggcacctgtaatcccagctgctcagggggctgaggcatgagaatcactagaacccaggaggcagaggttgtagtgagccgagattgcgccactgcactccagcctgggtgacagagcgagaccttgtctcaaaaacaaaaaacaaaacaaacaaagaaacaaaaataaactactgagtagaaaataatgtaactgtttatgaggcacagggttcaatacatggcaaatgaatcaaccttgttaaatttttatttcaacattacatacgaatataaaagcataaaccataaaggaaaagttttaaaatacatgattatgtattttttaaaactacctcctgttaactttggttttgagttcttaatctgtttctaagagagtcctgttatatccttaccatgagaatggttataccaaagtttgttaacagttctgtcatagtttctctttatgtattttatggttatatatttaggtgcatctaagttttgtattgctttattttcttgaagatcattgcttcgattcttacttggtgtctttctttctccatgaataagttttgccttattttatttcgcttgatttattttagtcagtttacctgcaagactttttctatttcattttaaagctttgtaggggtgtgtgtgtgtgtgtgtgtgtgtgtgtgtgtgtgtatgcatgttcatgtgttttctttaaacagctggataattttaatgcaatattttagtctctagcttttcatataaaaatttaatttatttacatttgttataatgactgatatatttgaaactattttgtgttttgttagtttcttgtccctttacattgctctccctctattgctttcctacttttggatagattgatgttttctatgttctcttttgacctattgattcagaagctataaactctatttctgttcttttggtggttactcatacatttccagatatatgcttaatcataattttttactaacattaattttcacagtaatgctgtgggatagatattattatttccttcatataaatgaaagaagtgaggctcggaaaagtaaagtaaagcaacttgcccaggattgcatagcaagttagtaccctaggcggattctaaatgaggtctatattatttgaatatctgtcattttaaaaacctattatgattctgcttaaaagcgataaggtccacttagctagaaccatatttttgtgcaccatctttttttcatagtgttctcaggcagccagttctgccattaatttgtgaagccctcagcaacacgcattctgtctccaagcctcaatttccccatctgtaaagtggtttggttatccctaacggcacttctagaccatattttaatagtgtttggagattcctttgacaatggacatttgacaagctccccaaacaatttgcctttatgataaatggtgaaccaactaaggttggaatatagttactcacaacaacactaaacatcatgtagatttattagttaattattcaccatctttatcaaagtttgaatctttgtgctttaaaagggaaactcgcagaatgacatttatttcccattaacctaatgagtgatattttttgccctcctctctgtagcaatttgttataaatgggaggatgactggtctgagattttcttgtgaattctgtttgcagtgcttcctctggaaaggagttagtgccagcattttcagggcctttcaggcagtgaagatcgtagaatctgagccatctctactgcatggtcagtgtcaacatcagggaatgtccctgatgctaactcgccccacaggagaattaaaggcactttaggatatatgcaaaacaaaaacagacacaaatataagaaatgtgcaaagcccactgcctaagcatactcatgagtctgggttctagagtaagtaaatctgagtttatgaagcagctccactaggcactgtggtgcagtagttacagacttacatcctaatgctgagctgtctggattcagatctctgcacagccacttagtagcaatatgacattgggcagatcatttgctctttcatatcagttgttcctccatgtaagagccctggataacctctttcactttgtaacctgcccctcaactcggggttttataccctcatggcaaccaccccgaaatgcatagcccagattatttcttgcctctccgcctttgctcattaagtgctttctacctaaaatgctcttcctccacctcccctagctaggagtagctacctcctacttcccaattccatcccagcctgagctgggtaatgctcttctgtgcccccataatatatattttttcagaattaaagactaaaacacacctatctaatgttatattttactaaaattaccactttccagccagaaaagctggattcatattccaactctgccacttactagctgtgtgatctgaggcaaattacttcatctttgcatacttcagtttcattatctgtaaaatgggaatcataatactatacacctcattgattcatcatgatgactaaatgcatcaatagctataaagtgtttagaatagtatatgacacttaaaactgtctataaatgtaagctattactacatttgtaaaggcaataataataaggtctatttaaggagattgtcacaggagttaaatgcaataacgtgacaaagagcctggcacaatgcccagcccttaactcagttcagcaggtgagattgtgtgtgtgtatgtgtgtgtgtgtgtgtgtgtgtgtgtgtgtataatagaacagcattttgaacctaccaaaacaatacatttcagatataaagaccgtattctgagaaccaactcgtttttcaaagaactcaaaaccagcagtagagaaatagaaatacaaaatctagaggaacacattcgaggtcttcagacaatactcataatcctttatatttgcaaagcactcaacagcttacaaagtgctttggaatccattatcacatctgatccttgtcttatctcaacacgaaggatagggtgttttttttaacctctctttttgtggatgagaaaactcaggttcagagatgtggcgtgactcagccactgctccatcatcagcaaatggtgagccagggtttaaagcctagatctgctcattctcaaccccatgttttttctagaatattccaggacattctgagcatcccaggaaatggttagcatttcatgtggagacacagatttccaggtgtgtaaaaaccacatcccagtgttgaggcatctgcaccctgttttccttgaaactccccatctgatggacaggcccgtattgtatcgtctggtctcctgaagagtccaagaagggagttgttagtttctttcagagatgttaacacgttgtcttttaagtcagcactatttctagagaggtgaccagctgtcgaaatttcatgtagggccctggtgtaattctgcacctcttctgttttggcttaacctgtactttttggccactgaaggctgtcaaggagtctaaggtcacactcctggtgcccagtccaggatgcggcttctttgggactcccttgacagctgtccctggcaaattcaagattctgggggaaggaatgtactcacctctgggtaaggttcctctgcagaaaatgatctcatttgtttgtcctccaactggaaaagaggaccaaaggacagaaaggattgacttcaaaaggagcacatttacaatttactgaggtgtaacacaaatacagagtactccgtatcccacgtgtacagctcagtgaattttcataaactcataaaacaacacccagatcaataacattaataactctccagaagtccagaggctctgtccagtccctgcccacccaggactgtcctaactgctgtcagcagaacctggccagcagcagagggattcacctggcacatgaggctcttacaagatgaggtgaggtcacactgatgacttgcgtgcaagagatgggatgacagagtggctttggatccatacgggctatgatagcagcaatgatagtaactcatatttcttgtacatttattctgtgtcaagcattaggctaggcatgtatttaattttcacagcagcccaatgtggttggtgccaatcccatttctcagttgaggaaactgaggctcggagaggagaatggtcttgtccaaggtcacacggtgtgagtggcagaggcaggatttaaaccagggaacctgattccggaaaacttagaccctggccactgctttgccacctaagctcatgggtctccctttggctttcagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccaggtgggtgtcacgggatccccttgagaatcaggctggggaggatgctacgacctgcagagaattgctgtccctcccaggtatgagcggaaccatggtgccaacctccaactttcacagatgtgcagggagatggggggcatttcagggctgtgagggtcatgtggagtgtaggtgaggaggaggggtctaagaaggagtcctgttccctttttcagagatgaggcagaattcttctgtctggaaggcttgggcagatcagcactggccagaatggctgagtgcagtgtgcctgttgtgtgtgtgtgtgtgtgtgtgtgtgtgtgtgtgtgtgtatgtgtatgtgtgtatgcgtgtatgcgtgtgtgtgtggtgactgccaggactaggtatgagccaaatagcaatagtgtgtgtgtgtgtgtgtgtgtgtgtgtgtgtgtgtgtgtggtgactgccaggactaggtatgagccaaatagcaatagtgcaatagtgccagtcatgcaaaaccaatgcttaacaatagcaacagttatacaaacgttggcagtttgactgcctattagtatgctaatgatattgatcaaggcatgatgttgaccactggctgctaccagctggagccctcactaggtactgggtcctctgtatctctgcacatggtgctgcatggtgttctcaggattgctgagtgaggtgagatcatcaacttcatttcacaagtgcaggtgatcgggtggcagaaaggtacgatgacccacccaaagtcacacagcttgaaagcggcagagccaggatttgaacccaggtcttcaggctctaccatccttgggccgactcaaaggaggacaggaggagcggcaggtctgagggtggtagggaggtgaggccggagcagagactggggacctaaggagatgtgatgagtgtgggcggttgcggtggcagactgtggcccagggcagctagtgttgagaagtgtgaatggatcccacagggtggtgcaagccttgcggagagatgtcccaaagctgaatgatgtagcaggaactcaggatttgctaccggtccccatggggagctgaagacacctggggaggctcagagctctgttggaagtgttgtgtccatgcaattgatgttaccttccctcggataagtcattcttgctaagcccagatgccttcgccacctgccttcttggagggttactgtcccttcctccagtcagaggctgagctgggcctgggacccatgtttcctgactccaaacccagtgcccttctctcttccttctggagacacagcccatgatgaccaacaggtccccaggaagacagcaaaaggcagcagactatagcgccaagggttggaaacagcgatcccacagcttcggctgcttccagtctctggtgtcagtttctatctgtaaaacaaaacatttcagttagagcttattcgcttaactagaagacctcaaccaaaacaaaacaaaacaaaaacctaaatttagacttgatttgaatttcaccagtctctcccatttcctctcccgggatccaacccgggaccacactctgcattttgctgtcatacctgcccagtctcctctggtctgggacagtttctcaggctgaccttgctttttatgaccctgacagttttgaggagcactggacaggtatcctatggcatgtcttctaatctgggtttgatggttttctcatgaatagagcgagtttatgtgctattggaaagaatatggcagaagcaaacttgttaaaccagaagacactgggagggcccttccatcttgaaaattctgcgactcttagccatctcctttatcaaatcattctcttctagggtgacccaccatcctgacttgtctgagactttcttagttttagcactgccagtcctgggtcctgggcaagccaggatggctggtcattctatcctcttcatggccatgtcaggaagccagtatcacctgtgcttgaacgcattgccctgcttaatcctcatgatacccctaggggaggggaggtggcattgtgcccattttacagatgagaaaatgttgtccagaggtggcaagtggtgtgtccaaagtaacacagcaggtaagtggcagagtcggggatttgaataccaagtttgtgattctaagtgcagaattgagagatgcttttgactcacattgcgtcttcctgtctgcttggctgaccaggtgggtacggaaccttgaggcacctggcttgcttctaggtaggcagagttgctgtgtgattgcccagccaggggccaggcattttgagttgagcaactcccttggcagaaggccacatacctgcccattttccatcaaaatgtccccagtgccacagcacccaagcttcccttccc

SEQ ID NO: 532 - DNA, 26209 bp, Homo sapiens
cactgtggtgataaggaacttaactataagcatgatctagtaggaagaattacaacgtgatttgtatttaatctggaaatgggtatctcatattgcattaacataaaatgtcctgggtaacagaagtaaatatcctctaagtgtagctcatggcatatttgttcatcttttcctcaaacctcatgtgaactgcacaagctaaaggacacagatttttcatcgtaaaatatccttctcacagcttgaaaaatagacattcaccaattcacacagaaagaccactctttaatggtatgcaaatgcaaaaatgtttattatattaccaccatggcctctgcacaaagaattctggactcgttaaaacaatgacagtgaaatatagacaaataaatactgtataattatttccaaggatgccttcaaataacttccactaggatagcccttattactctgtctagttgaaaccagttttgaacacttatgaccacaatataactgttttatgagttttttgttttccgcatttagaggcgaaagcatggagcgtagagtcaagaacaaacatcagatttacagatagagcccttactaatgggggtggctttggggaaagctctcacattgtatgagctcatttgcattattcataaataggaatacttgttagcaggctctttccccagaaggcttcaggaaccgtgcttaagtttagggagcaagcatgtaggctaaggtggtaaatgaccctaacctgtcagtggcttagcaaaggaaaagtttctgtttttctcactcacactgcaggatggctggtacatgaagctgtacaggggctcaatcagcttctatgttatcactccatttcctttcaggtcctggggaggctcttttcagctgatagagagagaagaaaatgagaatcacatgggaagttctaagggttatgcctgaaagtggggcacgtgtctcactcagtttttacttgagcaacactaaactacccttagttcagaagcttgcatactatcctggcaaaacagggatgggagtggagagaggaattctgttgaggggcatcaaagtctaacaggaagaatggatggatccaggaacagagatcaacttgtaaatagttctctttggaatttgaatgagcctaggagacaggatctgttcaaagtgtggttacattcttggtcttacagggaggggaagaaaaaacaattgttctttattgtgggtccagacattaggcatataaaggaacttcagagaacaacttcattctggcttagggacagtgagtcagggagagcttgaagcttttttttttttttttttttttttgagttagcatgtggaagagtagtacttggggtattggtttctgagccccaaccttacaaatcttctgaagcagatcttttagtacccttcaaagaaaacagaaccttggaacagtaatgaggccaggtttataaaactcataaatagcaaagccaggattttaattaaaacctccttggctaaaacacttctctcttttttactgcacaccacgaactcaactctcaacaacagtatcacttggttgtgaggtcaaggcttacaaatatgaaacaaagtgtgaacctcctcacacaggatatggatctgcttctcaatatatggtcctgaccaggagctataaagaaagaggactggagaaggtgggtctggaataagcctcaggcaacttcctatagtaggacttctcatatatactatttaatacctggagaaaagaggcaggacttcctcacttagactccctgctcactagatggcgatttcaataccaaagccaaggatcaacgaatgagctgtgctatcttatctttagagattattttctagttgtatgactcaactggcaatttgtactgatgatttgatctgttcaagtccccaaattttctgagttattgaggttttgttccatgtaatataacaacaatggcatgagtcagggtcgctgagcccctgtaagcatgaggacagcttagctactatccagcggagccaggagcgggtgctggcctgcctgcaggacacatgattttacctctctgagcttcaggttgagttgctttcctgtttttgtttttagcttttttatgtataaaatgaagaatacaataatatcctcatcttcaaattcttaaaagtcatttcttatttaaactttcacctctttacctttttagcttagagataggttagatgatgtgatcaagtcagaggcctcagagaaataaaagaacaaataatgttatccatggggagggtgtgtcaagagtgaagtatcacagcaatctaaaggctttctttgctatgcatcaagctagaaagttgcaattgggtggatagatccttccagggcaacctccaactgtgtttggaagctaactacagggaacatttgaaagtttgtaaagatttcctggagactctgatactgaaataagtctctgaatatcatatccgattttttatattaaatgtacctgggtaagatgcatgagctcctacctctgtgaaggggaaaatacgcagagcaaagcctggcctgggttcagataccagcttcctgctgaatggtgagtggacttggacaagtcagagtcctgttctgagcctccttttacttccctgtaaaaatgaagctcaaccctgttgtatgagattcctgactgtatgtgagtcaggcactataggatcaaatggtaaccactaactcaagttgtaactatagtatcaaatgctaactattgttatcagatggtagctactatgattttgtctttagttccatgtgctataatcatctgttccatgaccatctccctgtgctgaatacatttctccccctcattatatactgtattgtgtagcatcctcaatttattctgagtctttggataatttgaaatggattacaatgacagatgcatttaaggcttaaatcttaccatagtattgaatcaacttgtaaacaattttttgccccagaaggaagaaatatttatatttttctttgatgtctgattgtttccatatgttatacccagatatatggagtccaagataaggtatagaatagttgtctccaaattctagtgtgcataaatatgtccctctgccaaacttaggtctcttttttaaaagatctcttattgcctctttctggctcagatctttattcttcctcagggggattgttgcaatagtctcctcgtcttttggggcctttgtatagctagttccactctggcttccagaaaggtctctcagaaggccacgtctttataaatcatcagtgatgcttgaattcagagtaatcagcctccaaaaattatttctggaaagacctcaggtggtaagatgataaaatcactagtcggagcagaattattgaataagtgagttgggaaacattcttaacttacatagttacatgatgactatttcccctaaaaaaaagtaagattactaggaaaaacaaaagaggagagaagaaatatatatagagacttagggttctgggaaaaggtaaatttattgttttgactagtggtatgttgatacatattggaaacttgagttttcagcaatgggtttaaaagtgtaaaaatctcaggcctgtcacgatttaataagagttaattttcaaagtttcctttcccttccctttctctttctttctttcttttcttccttccttccctccttttccttccttccttttccttccttccttccttccttccttttccttccttccttccttccttctttctttctttctttctttctttctttctttctttctttctttctttctttctttcttctttctttatttcctctttcttcttcttttctttctacaatgcttctgaaattttaacttgcaaaagaattacctgacactattatgaaatgcaacttccagatccctatccccagagattctggtttaataggtcaggatggggcccaataatttgcatgcctatcttgaaagctcagagtatgccaattgtcgtcggtctgaggaacatactcagggaaccaatactttagaaggtgtgtgtgcccactgagaaggttcaagccttgccgtatctttacataccaacgactttacttccaggcatctgatggcctagactcaattcagctttgaattactgggacagtttatattgagcttgcttatgtatttatattttaaatataaaccttattattatgtaaatctcatagattaatgtatcagatcatggagggtcagggtgacgtcaatgtaataagaatgttagtcacaacaacattctctacttatatttagcaactgttgctacgttttatcttaactaaaatgtgtggtggtttttaagaagaaaatgaagtacagatgccggcttgggtggtggtgaagctctaggcaggcacagtgctttctttgcctttctcacagagccagaggtcatctggctcctgtgttgccctaatcagacaccacaggccaaatcaagcagacaccaggctctggtgcagtgtgtcccgggagcctgaaacatcttttgggacctgacctacaacataacatcccatcctttaactttttttcaggtttattgaagcatatttcatagaccatacatttctcctatttaaagtgtacaggttagtggtttgtagcatactcacctggctgtgcaagccttcttcactatcttaattgtagaacatttcgatgccccaaaaagtgaccccatacatggtaagtcattcctcatctcccctccaccacccccagcccctgcagtcactaatgtactttctgtctctataggcttgtctaatttggacatttaacataaatggaatcatacaatatatgctctcctatgactggcttctttcatttagcacgttttcacgatttatctgtgttgtagcatgtctcattccttttcactgcctagtaatatttcatggtatggaaataccacatttgtttatccattcattggttggtaggcttttgggttgtttccactttttgactattatgaataatggacatgcatatgtcagcttttatttgggcacatgtgttcatttctcttaaatatatacctgcaagtgagattgctgacttaacctcctgcctcctttttcgactttgtaccttgacataatttatagtaaactttgaacaaaaaaaagcactgtgaggttctgtgtaccccagtttcccctgtgctaatatcttacgtatttatggcacgatatttaaaaggaaattgatgtcggtatactatatggagcttactcagattgtatcctttttacgtgaactcagttgtgtgtgtgtttagttccatggaattttaaccacatgtagacttgcacaatcactgccataatcaagaagcagaatagtttcatcatgaggattcctcctgctatccttgctgtggtttgaatgtgttccccaaagttcacatgttgaaaacttaatgcttaatgcagcagtgttgggaggtgggacctttaagaggtgattaggccatgagtgctctgacttcctgaatgggttaatgctgttattatgggagtgggttagttactatgtttctcatcaaaggatgagttttcccctccctctctctctctgtctccctgccattccaccttctaccaacggatgatataggaagaaggtcctcactagatgcagtcccctggaccttggacttgcaagcttctagaaccataaaaaaataaaactttgtactttataaattactaggtctcacataccctattatagcagacagcgaactaagacaatcctgttatggccgcacctgcactctcctatctccatttgtaacctgtagcaaccactaatctggttccatctctaccaatctccttttaggtaatgaaaatgttacagaacctatgtctattttcagcctgtaccagctatgtgcagactgggacaccaaaagatctattttctaatttaatccccagacacattgtttgaactaatttcagcactcccattagttttaacatatttatttttcttttcttcactgaaataaggccaaggcaaagtccctcaaacctaccgcacaaggggtttgataaacttaattaaataaatggctgctaaatgcaaaatgcttcacaagcatttacttaattactagaattaatttgatcctattgatgtccgtaggctgtgcatggagatctgtaactaaatatgcagtcatgtggtaaatattatattgctggggacataggaacaaaggaagaaacaggactgatacatttttaaggccttaaaaatatgtactcagcttcttgtctatttctatagttttacaataggaatataaatggcagtgcagaaacaccacatctctgaccttgatacttgaaaaggtgaggtctaaataaaactatttcgctgtctgaatactatcattatctttaatgagagtgggcatcacaaggacatttcaaattgtaccttaggcaataaattagctgccagaactatattcagactattttcctcaaaaatgaaaacactgatccatctgctctgtccagctacattatacatctgttcacattaatataaaaatctattctgaagagacttaatatgtctatcgttgtccttttcattgaagagcacatatctttctgagtacccctaataccagaccttcaaatgcaacaataggtttactagttactgttttttctaatggagacaaatcttgttactgataatgtttattttgcttttccttcacactcccatcttcttcccaacagaaaatgtgatgatttcctcaaagatgaccttcaatgctaatttagagcttgtgtaagatgtagcaagtcatttcatatacagtggatggtaatctctgtcttgagctttactaggtattgcagagaacaaagatattgccatacaatttttaagtttagctcaatttaacctttaccaaaggttaaacaagagagatcaaaatgctaatccaaggatttccatacatagcagtggagaaagagaaaggaagtctacctaactcagactgatgatatggaaaggctttctggaggaaggaagccttggatttagtcttgatgaacatacatattacaccgatatgtcaccatgttgcacccttgttgcactgttgctgttctatactgagaaggagccaccctgcactcatatagtgaacacctactcatattttaaagcttaccttaatggtgggaacatttatggtgtcttctctacctctgcagaaaagattactttataattacaagcagttcaaaaaatgcttgtttatggaacaatgtaaaaccaacaaaataagtcttcatcaaacaagtcttgcttttattcttattccttcttcctcttcctttccattctctatacataacctttataaaaatgctgttttcttaaaaaagataagcaaatacaaataagttcatacccccatttattagataaacattagcatagtatacatgcattgtctgtgcttttctctcatagctatatattcagaagctcagcttgtagtgttacgtgtggggatgcttcattcctgttcaaagctgaactatattccatgagtgcaacatagtttattcaactagtcctcaattgatgaacaccgaggatgatttctgtctttttgcaagcacaaatggtgtttttaaaaaaatatggaaacatcttttttcccccattttttaccagtgtttcttggagcagatcactagacatggtgtttctgggtcaaagtttaaatgtatctgtaattttgctagatattgctaaattccacatttaggatttgtatgatttttgcattccctctcagccacatatatatatgtatacgtgtgtatatatatatgtgtgtgtgtgtgtgtgtatcaaaataaaaggttaaatggacaaatatttatatataattagcaatgatccaatatctatgctcatgatatgagtgaccactcatagaaaaataaatgcaaataaatctacaacacataaaaacatgtctgaccttgcttataggaaaaaaaaatgctaaagaaaatgacattgaaatccaatttttcacatatcaaattagcaatgatccaaaagattgacaacactccactgctaagcctgctagggaaaaggcctttcccctataatataactaatattctcattttcattagcacttatttttctataagtaacgtcagacatcttttatgtgttttagatttatttgcatttatttttctatgagtctccactcatatcatcagcatatattcctataggttgctacctattgtgtctttatttttaacttgtaaaagtatattagaaatgttagtgctttgtgatgcaaattgtaatttttcccagtttgtccatttgccctttttttgtttattgtatcttttgccattcaaaaatgtttgtttatttttttaatttattttgaatattaggaaatttatctatatttttgttcattgcttctggattttgaatcattgttagtaatacttttgctgcttctaatttacatagaaattcagccttgtttttctctagtacatgtatgtattctatttttcaatatttatttatttatttatttattattattattatttttttaattatactttaagttttagggtacatgtgcacatagtgcaggttagttacatatgtatacatgtgccatgctggtgcgctgcacccactaactcgtcatctagcattaggtatatctcccaatgctatccctcccccctcccacctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcctagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtttctgttcatgtccttcgcccactttttgatggggttgtttgtttttttcttgtaaatttgtttgagttcattgtagattctggatattagccctttgtcagatgagtaggttgcgaaaattttctcccatgttgcaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcatcgtttattaaatagggaatcctttccccattgcttgtttttctcaggtttgtcaaagatcagatagttgtaggtaagtggtgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggcaatggcattgaatctgtaaattaccttgggcagtatggccattttcacgatattgattcttcctacccatgagcatggaatgttcttccatttgtttgtatcctcttttatttccttgagcagtggtttgtaattctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacaaggacaatttgacttcctcttttcctaattgaataccctttatttccttctcctgcctgattgccctggccagaacttccagcactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttgtagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgctacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagagttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagacatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttctgatctttgttggtttaaagtctgttttattagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttattcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgaactttttctctggctgcccttaacatttttttccttcatttcaactttggtgaatctgacaattatgtgtcttggagttgctcttctcgaggagtatctttgtggcgttctctgtatttcctgaatctgaacgttggcctgccttgctagattggagaagttctcctggataatatcctgcagagtgttttccaacttggttccattctccgcatcactttcaggcacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacttagttctcgagccttgggtttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcatcaaaatcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaatcaagcctgggcaatggcgggcgcccctcccccagcctcgctgccgccttgcagtttgatctcagactgctgtcctagcaatcagcgagattccgtgggcataggaccctccgagccaggtgtgggatatagtcttgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcacgcacggtgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccaccttcaatatttaaatctctgattcaattaaaatttgatcgtggtctgcagtatgaggagtggatttaatttcatctttttccatatagtttcccaattatctcaataccacatgtaattttttttgtttttctactgatttgagttgcctttatcaacaaatatctatagttgtgaattatttatttaaatatttagataaattattaaatattgaacctctcttgattttttggattaaacattcccttggccattatgtaattttaaaatacgttatttagttctgtttgctgacactatatttaaaattttgtgattgatattcatgagtgattctataattttggttttctttctttatgatgtttgtcaggttaaggatcagctttgcatttactttacataacaaatgtggaagatgggaagatatctttcttcttctgttctttggagaaatagaagtaccagtgagatgatttgttctttaaaaggttcatttgagaaaccatttactctcacaatattacaatcttactctattatctcagggagtttttttgtttttgtttttgtttttggagatggagtattacttactcagtgacccaggctggaatgcaatggcaaaaatgtggcttattgcagcctcaaactcatgggttggggggagctccttaaatacttttcctattttttataggaacaggtcgatttaaattttgtgtcagattgaggttaatgttggtaagtttaagacgctgaataacttgagatttagaaccatgtcttttttttttgcatgtgattttctcagagcttaccttagattagtgaaaaacaagtgcattctcaataaacgtgtgtggagtatttgttccataatgtgttaggcaagcaatgtaggccgaataatttagtaaacaaaagtgtatgcttgtacttcctgaaacagttggtgaattgcacatgtgtgtttaactttgtttccttacactcctcatgaagaatagtaaatggttttttttttatttttattttttaatggctctgtaagccagcagcaaatcagaggaactctttgtcgtttaccatctccaaaacagcaacttcagtgatggggtgctcataggagactgaaaattcacctggctagaaattaggctagaaatgagggaagctgaaggagaaggtagcccatctggagtaacgcactagtaacatgtatcagtagatgagcccatctggctgccacacactagtaacatgtatcagtagatgagcaatgatgtgtgtaaatctacagtagcacatcctgcccttcattgaccttacacacatggaatcaatgtctgtgctatgctcttgcacctgccgcatctcatgtaaaatgtctgttgtgggatatgctgaccagagctatgcaaggaaaggaattctggtaaatgtagttccagtttggcttaaattgacacaactcgaatccaccacaatggcatgacaaaaggagacaaatacaggggcacacacacaaaaacccccaaaatacaacaacaatactcagagagagagagagagagagagagagagagagagagaaagagagagaaagagagaagcaaaaaccacaggggaaaagggcaagaaaatgttgaaagcagaaagtgagtagacgaataggaacaggtaacagattaacataattataatgctgaatcttaatttacatgcagtgaaatccaagaaacaaacaaatccacattacaaaatcccccaaaggcacagaagtaggaatcatcagtcacctttgcaagtgaaggtgaaggtaagataaatacaggaagagtaaatctacatctgtgtaagaagtagttagattatcaatcctctttccagttgtggacacttggtgattgctccttcaccactgagagagaagactggaagtttttcttttggagaaaacacaattcctaaaactgagagaaaacatgtatggttgaagaaggttgtaccatattgaaaatggggtaaggtatgaaaacatttatatagaaagaatgctaagacctggccttcttctcttcagctccgagatattccacagccaagcatacatcctctaaatcatagactctaacaagagcaagagaaagacaaaagacactaacgtgagcatttctcacaaaattcttcagccagataagcctacattaaagtccttggaaggcaaaccacagacatttgtttacaaataccaagtagtatttcagggaccactatcaaatacgagagaacatcccagaaagcactattacatgaaatgtaagatagagaccaaaacaaaacacacaacaattaaagcaattaaccaaacaagcacagcttaaagggaacagcctatacggagcaaagaaaggatcaaaggtactgtaatatgattaatattcttagagacatgaatgaagtattgcgtcaatgagtcaagcatcacgtgctattagagaaaataatattcaaaggaaaaaaaccaatcttctataattttaaaaatactacaactgaaatagcttaaaacggaaacaacccaaatgttcttcagtggattaattattaaactgtagtatgtccatgttatgaaatactactcagcagtgaaactggaattgacaactgatacatcacaaagcttgaatggatctcaagggaattatttttagtgaaaaaggccagttttaaaaggaatatccagcttgagggtgaggagatgctttggggagacaactgtaaccagacgggtagctcaatatcccgtattacagcaagtcagaagaatccagaagatacttttgattttcaaacacattttcaaacatatgaaaaagataaaatcggccaggcgcggtggctcacacctgtaatcccagcactttgggaggccgaggcgggtggatcacgacgtcaggagttcgagaccagcctggccaacaggtgaaacctcatctctatgaaaaatacaaaaagtagctgggcatagtggcatgtgcctgtaatcccagctactcgggaggctgaggcaggagaatagcttgaaccaggaagtcggaggttgtagtgagccaagatcatgccactgcactccagcctggcgacagagcaagacttcaccaaaaaaaaaaaaaaaaaaaaaagaataaaggcaatatcatgtaattgtcccacatgtatccttcattcaggctcaacagttatcaatattctctcatttttatttcgactatcccctcctcacttgtttgatgcaacatcttatttatttgtttgtttgtgtttttttaaactgagacagggtcttgctctgtcacccaggctggagtgcagtggcttaatcatagctcactgcaggctcaaactcttggactcaagctactcttctgcttcagcctcctgggtagctgagactataggcacaagctacgcacccagctaattttaaattttttgtaaaaacggggatctaactatgttgctcaggctggtctcgagctctcagcctcaagtgattgtgccacctcagcctcccaaaatgttggaattacaggtgtgaaccactgtgcccagctgatggagaattttagaaacaaattgtggacatataattttactacaactacagtattcatagtgaacaactctctaacacaggacaactcatcttttaaaacataatcacactgccataattgtaactatcaaaattaaaaatacttaatataatctgttataaaatctgatctataatttttgtggttatcttaaaacatcttccctctctccctccctccctccctccctcccttctttccttcctaccttccttccttccttcttcttttcttcctttctttctttctcatcttttctttaatgtgtttgaattagggtctaaacaagatctaagcatagtgtttgactgactgatatatcttttgcatttcaactccatttttgccatttttgttgaagaaactaagtgaaacattccagtattgtagatttaactaattgcattcttacagtgtggctgggcatgtgggcctctttctgtaaattggtgtttagatcttggggctcgaatacatttatcttcaatttttgtggcaagaatgtgttttagatggtgttacatatgtcttattgtgccacattagaggcaccctgataatcacttttcatgatgttaagattgacccatgagttcaggtgttaattgaatccactgactaaaatatcccattaatgtttcaactaatggtttggcagtccttgatgatcattgtttaatcctttatctcactgggcattactaaaggatgattttcaaattctattattcttttgcagattctggtttggttattctctaaagacttttttcatggactgttaagttgcattcaaatacatttatacaagaaagacaggatatgatctctgttctttctaatattcaggacatgacttcattctctattaaacttcagaggggaccaatggacttgagtagagagacaagatagatgctacgtaggtagatagatagataaataaatacatacatacatatatacatacatacctacatacatacatgcatacatatataaattgattgatggatagatagaaactaataaattgtatatatttaacaatcaaagtgactattattttttatgcccaaattgtcccatcaaactaactcctgggctgttttgagataattccagtctttaataaaagtcttgtttttaggcaaagcaagacattccactttcattctgtacttttcatggtcccaaaattgactcagtaaaatcttttttccttttatgtgttaacttttatttagagacaactctctgtgcattaatttgcttcttgcactttcagtggtccaaatgtgaaaatgcatcattttttgaaagcattaaattataagcttaagcttattaccaattctaagatatattgcagaattttatctgtttgcattttatattttatcttttatgataagtaatttagtttctgttgataagacaattattagctttttcttgctatgtttaatagtttcataatataatagcaatatcgtttaaaatgaggttattaaatgtatttttatattttaaatttttttggtaggatacatcctactagtcaaactactgtttcaatatcaaatatgtttaaatctatacattcataataatactaaaaatattttcatccgttactttggggcaccctagggaaacatttcagcatttcgaaactgatgaattaaagtgaaagcatcaaccatgtaactcgcttttcccaaataatcttgtagtttagggaaatcaaacgatgaaggttgtttcagttttgtaaaacattcccattaataaatcaggaagggatgatagcattagattaaccacctacaagctggtttgtctttgggcaaagtacttatattttatgaactcatttacagtgtccataaatggcaatgctgttaccaggctttgccctcagagatctcccagttactgagccagcatttaaggaacaagtatatcaataacagtaggttaactaagatggtaaatcaccccaagatctcaatgacttagtgaaataaacatttattttatgttcacatcccatgctgtgtgacctgttcaatgaagtcaaacaatgataaaatccatgtctaccctattgatccatttcatttagcttcttgggatttttttctgagaattttggatgcctcactgatttgccttgggcaatggggcatcagcaaacatcatgcaagcagaggcctgacaagtactttgtttcttgctgttctgggaggctgtaccatgtaaactcccctgctacagtgtgagaggccacgtgggccgaagcaaagaactacagcttaccaccacccagcctggctgacccagcagctgactgcagatgcatgaactgcccagccaatcccagactaaatggctggcctgcagaatcatggcttagtcatgacttaaagtcaaatttggagttttatgtgtgtttgtttttatacagcaaaagaactgatgcactgaggatatagatgatggaagattagcaatatactgggagttgctgaagctggttgtgatgctagcaggatcctctctgtgctctttgtatttgaaagtttctgcaatgagaaagttaaaaagaaaatattaaatttcaatattgctttaaataattcctggttaaattatcttgttttcattttctttcaatgtttaagaactattattctaggctgagtgtggtggctcacacctgtaatccctgcactttgggaggctgaggcaggtggatcacacggtcaggaatttgagaccagcttgactaacatggtgaaaccctgtctctactaaaaacagaaaaaattagccagatgcggtggtgtgtgcctgtagtcccagctactcgggaggctgaggcaggagaattgcttggacctggcggaggttgcagtgaggcaagagcatgccactgcattccagcctgggtgaccgagcaagactctgtcaaaaaaaaaaaaaaaaaaaaaaaagaaggaaagaaagaaagaaagaatagaaagaattattatatttaacttttaaaaattattgaaaatagttttatggtttcaaaattaaaaatataagacattcagaaatgtctcactttcatctttgtcccctcccacatttttctctctctccatagttatcctcttatgttaattcttacctgaacattttggtagatattttagatagttgttagtaaatttggagttaaattagcaatttatatgtagaaaactaggcaaatgagaaaatatgacaattttaaatttcaagaaaaactaaattttgttcagaaaagaaaaagtaatcacattataatatgtagttaatctatgaatagcatttacaatgtcatatcaccaaaatagtaatcattgatgtagctaaaattattatacaactagactggatggatgggggaatggaaagttgtttttattttggggatggggggataaaaagggctaaattcccattttccaactgttaaataaatagataacttgtaaaagtaaaaaaaaaataagaagtaacaatatagacatgctatttagtcattccagtcaataacagaaaaatgaactaagaatgaaaagttatttctgtgcagaagggaagttggagctactgatcttttataccaaggcttgtggtttatgatgaaaattgaaaaaaaaaatcaggtatacaaaaactgtattagtccgttttcacgctgctgataaaaacatacctgagactgcgcaatttacaaaagaaagaggtttaattggactcacagttccccatggctgggaaaacctcacaatcatggcagagggcaaggaggaacaattcacatcttaagtggatggcggcaggcaaagaaaaaagagctggtgcagggaaactctcccttttaaaaatgatcagatctcttgagactcgttaactatcatgagagcagctcaggaaagacccgccccctaattcaattacctcgcaccaggttcctcccacaacacatgggaattgtgggagttacaattcaagacgagatttggatgaggacacagcgaaaccatattaaaaactcataaaaaaaggagaggcaacaagtcatgaaacaacactactactattaataatataggctcatattaatcaagcactttctatgtgccatatgtggattgtgtctttgaatccttactacaacagtatgagggaggctctttttgagttactgtagtctaatgagacaatttatacttcgagagttgattagctacctattgtaatgaaggattctaaaacaacacctggaaacaacagacattatcatctcagagtgtctctgggaccgtaagcaacttagctaggtggttctgtcttggtctctcatgcagctgcaaaaaagatgtccacagggctgctttcgttttaaggcttgatatggggatcttgctttggtgcccattctcagggcatgctaccaaaacttccaggctcactcctgtgggcctcttgcaagggctgccttgttacattggagttggcttctaccaccgtgagtgacctagaacacccaagatggaagtcactgttgttttataatctaatcttggaaatggtatctaccacactatcatattctatttgttagagcaagccagtaagtccagcccacttggagggaggatgtgattttgtcagcagaacatgaatcccaggaagtatctgtccatcacgggaattaccttagaggttgcctagcacaggtggggtagcttgtccacgcttccacagggagaaaggggtagccctgccaggaaaaaccacccattctgattccaaggtttatgttcttaactactatgcaactgctcacatgctgtggggtggtgtttcccttttgtgggacaacagcaactccttccacatagctgtcatcccgggaatgtgggagtggttgggaggtcaacatagacaacagctgattttcacctttgtgacaaacacccaagggcattatcaggtttaggcaaacaaaaataatctgtacattatgctcacaatgtggggcacagattgtggcactcccacatacctcctgctgcggaaagtttgctggaatgcaagagagaatgccatgagaacaaggataaccttgagttcactctaatttataaaaagtcaaaccctctcaggcttcataactttcctggtaataaattatttgagccacccctcacatttgatcatgacaaactgcagcttcctcttcctgggatgggacattagtcacaaggggcaggagttggctaggagaggagttggtactatatcttgaaagctgttgggagccactgaaatgtttaaagcatcatagggtgacatgattggagatgtagctgctgctctgagcaacagcattttgtctgaagcatcagacaacattctatattctcatatatgagacagtagatgtctcctttatacccccaacagatttattcatgttagcctaataaaatttatatatttcccaaacttgcagatttatcaaagctccctatctcaggacacctgaacctgcctctatctgagcatgcagacttttgtggctgccaatcaagctgtgagctttctggggtagagatttattgcctcctccatggttccatcctctggtggcaacctcatctgttgacacgtattaggaactcagtaaatgcttattaagtcaaaataaactgaacttcgttgtgcacttactacatgttatgtactatacttagtactaggtacataaaaataagacagtctgggccaggcgcagtggttcacacatgtaatcccagcactttgggaggctgaggtgggtggatcacgaggtcaggagttcgagaccagcctgatcaatatggtgaaaccccgtctctactaaaaatataaaaattagctgggcgtggtggcatgtgcctgtaatctcagctactcaggagtccgaggcaggagaatctcttgaacccgggaggcgagtttgtagtgagccaagatcaagccacggcactccagcctgggcaacagagcagactctacctcaagaaaaaaaaaaaaagaaaaagtctttaattagtaaaaagccatactgtatgtaagcagtaatttttttaattcatgagtcaaacattggctcaggccctgctgtgattgttgcactctgctagatgctggggcacaacatcaaatgacacgtgaccactactcttacaggttctgtaacccattgaaagagacacaatggtatttggatgatccaagctcagtatacagtgggagcaaggaggaaggtcatagagataagcaaagaggagggccatgtaagaggtgaggggccacattttgagaggcattacctctgcactgattttaaaagaatgaatgaatttaaataaatggaaaataaggctgggcctggcggatcatgcctataatcccagcagcttgagagactgaggcaggagaatcagttgaggctaggagttcaagaccaacctggataacagagtgagaccccatctctataaacatttttttaaaaaaattagtcagggtggtggctcacacctatactcccagctactcgggagactgaagtgggagatcacttgagcctgggagtttgaggctgcaatgtgccgtgagccgtgatcgtgctactgcagtctaaaacaaataataataaaaagagagagagagagagatgaatggaaaatctgaatgtcaaacatcagtatcaagccactggtactggtgtgttaaggcttggggaaaaagtcaaggatatagaaggagggaaatgaatacacatagagcaaatctaagtaggagttactgattcctgcaaagggatatgcagagccaagcaaagttttatctctgctgcctttgtctttccagccatctacgagcaatcctgcgaggtgtacaggcaccaggggaatacagccggcttcttctacatcgactcagatggcagcggcccactgggacctctccaggtgtactgcaatatcactggtaagggtgcagtagccctactcacacttaaccaccccacttcatggaaggaagcaaaaataaattcactggagggggatacctacgtgaataaaaatttgaaagaccaactggtctcctttggggaggaaatggtattctggtgagtaatgcaaatttgcagctaggttaattttcatgagacagaaaaaagaaaacttgttaatggtcttgataatgtttcactgaagcaagaattaattatcagtggttttctttagggcctccaagggcattttctctcctgaaactcaaaaacagaaagaaaaggtaaataagcaaacaaacaaacaaaactccaaatcagtgggaagccctgactcaggaagctggaaagcttgattccactctggccccaagggatgcatgacccttaggtgaatactatagtttctctgagctttatcagtgaaatgagaataatagtggctacccccagagctgtgagaattagatacaatcatgtgtattggagcagctagccaggctggttgttcttagatgcctaaccaaaacaaaacaaaatgaaaaggtgagttttttcatttttctctggaaatttcttgatagcttaaacttatttctcaaatgca

SEQ ID NO: 533 - DNA, 26425 bp, Homo sapiens
ggtgtgaaactaacacttttttgtatgtatttgtttgcaatttgctcgtagtgaaagacaactaagcattgtgtgattatctgttgctagttcaaattcaaatcttagggtcttagttcattcaggctgctataacaaaaatgccataaactgtgtagcttataaacaacagatatttcttacagttctggaggtccaagatccaggagtcagcagattttatgtctgttgaaggatcacttgctgcttcacagatggtggctttttgctatagcctcttgtgatggaagggaagaactccagtctttttagttccttatacaggcactaatctcattcaaaagggcactgcttttatgatccaatgatcgtagaaagttttttcttgtaatactaccatattgaggattaggttaaagcatatgcattttggggggataaaaatattcaaagtgtggcagggtcccaatcgtctctctaaatgttggccaactgagacttcacatgtagaagtgtttgcagggggtgatgggagacagcaacagatcatcaggcattagattgtcaaactgagtgtgcaatctagatcccacgcatgcttagttcacaataagacacatgctcctatgagaatctaatgttacctctgatctgaggaggcagagctcaggcagtaatgcaagctatggggagaggttgtaaatacagatgaagctttgcgtgctcacccacggatcacctcctgttgcacagcccaatttctagcaagctatggaccagtaatggggattggggaccccagctctacaccatttattacataacttttccaggagggtgagaagcagcaccacgtattcaagcaccaatgttttttgtgaaaaattatgttcacattcacatcaagtgagacaaagaacaataatatgatttcattggcactggttgtgtttattgccaaatgagatattacttaattttcagcttacagatttttttgaatgcagtaattgcagataatgagtatggatctgcatcatactgacttaggtaccaatatagtttgaattttatccccttcccctctcctccaaagaaaaaaaaaaagaaaaaaatatatatataaatcctaacctccagtatctcataatgtggccttattttattttttaaattatttttatttatttttgtacttttagtagaaatggggtttcactatgttggccaggctggtctcaaactcctgacctcaggtgattcgcctgccttggcctcccaaagtgccgggatcacagccatgagccaccgagggaggtgggaggtggatcacctgaagtcaggagttcaagaccagcctggccaagatggtgaaaccctgtctctactaaaaatacaaaaatcaggcaggcgtggtggtgcatgcctgtaatcccagctactcgggaggctgaggcaggagaattgcttgaacccaggaggcggaggttgcagtgagctgagatcccacctctgcattccagcctaggtgacagagggagaatccatctcaaaaaaaaaaaaaaaaaaaaaaaaaaggtctttacagaagtaatcaaattaaatgacacattaggatgagccctaatccaaaatgactggtgtcatctgacataaagatagatctgcatagagggagaagatctgaagactttaccaaatgaagagagagttttggaatgattcagctacaattcaaaggatgtcaaagtttgtcagcaaaccaccagaagctaagaaacagagagaagcaaggaagattctcctctacaggtttcagagggaggatgaccccgccaaaacttcattttggatttctagcttccgaaactagaaaactaataaaagataatctttctttcaaatcttcatctcatttttttctttcttcctcattcacattgttattaccttagttctggcccccattaattcatgactggactaccatactagctttgcaatagtctcctgattttatatattcataacatcctgtgcagtctctttgatgtctctctctttctctctctctctctctcctcttcaatccagcttgcactctgcaacaggattaatcttcctgttacaaagcactgactaagctattctcctgatcaaataccttctatcactcaccattgtctaatgaacacattccaaactccataaagcatttactgcctctataatttaatctcccttctttattgcgggatccttgggtgagagcccaactggatggcttactttttctatcactttccccaaatgtatgtgtgctttttctttgtttaaaagacaaaggccctaggtcatgactctaaatattcaaagtatacccatccttcaggaccaagttccagcagtatttctagaatttttgtttgtttgttttttcagtagaatgaagcctcatttcttcccttgtctcataaataaaagatttttagcactgattatgagccagacactattcagaattctttgcatttatcaggtaaattaacttcacaataatctgtgagataaattctatttgcaccccagttttacatatttagtaactatggctcagaaaaactgagtatcaaagccacatggtttctttaaattttattttatatttattcattttaacgtttgtgggtacatagtaggtgtatatatttatgaagtacatgagatagtttgatagaggcatgcaaagggtaataatagtcacatcagagtaaatggggcatccatcatctcacacgcttattctttgtgtcacaaccaattcaattacacttttaaatactttaaaatgcacaattatttttcactatagcacccatgttgtgctatcaaacactaggtcttacacattctttctagctgttgttttgtgcccattaaccatccccacttccctccatcccacctctacccttccaagcctctggtaaccatccttctactctttgtctctgtgagtttaattattttaatttttagctccccaaaataagtgagaacatgtgaagcttgtctttctgtgtctggcttatttcgcttaacataatgacctccagttccatccatgttattgcaaatgacaggatctcattcatttttatagctgaatagtactccattgtgggtgggtaccacattttccttattcattcatctgctgatggacacttaggttgcttctaaatcttggctattgtgaatgctgctgcaacaaacataggagtgcagatatctcttcaatacattgatctccgttctttggagtatatgctcagcagtgggattgctggatcatatggtagctcaattttaattttttgaggaagctccaaactattctccatagtggttatactactttacattcccactagcagtgtctgagggttcccttttctccacatcctcaccagcatttgttattgcctgtcttttggatataaggtatattaactggggtgagatgatgtctcattgtagttttaattggcatttctctgatgatcattgatgctgagcacattttcatatgtgtgtttgcacttgtgtgtgttcttttgagaaatgtctagtcaaatcttttgcccatttttcatcacattattagattttgtcctatacagttgtttgagctccttacatattctggttattaatcctttgtctaatgggtagttttcaaatattttctcccattgtgtaggttagctcttcactttgttgattgtatcctttgccatgcagaagctttttaacttgatgtgatctcatttgcccatttttgttctggttgcctgtgcttgtgggatactgcctaagaaaattttgcccagaccaatgtcctggagatttgcctcagagttttattgtagtagtttcatagtttgagatcttagatttaagtctttaatccattttgatttgatttttgtatatagcaagagatgggagtctagtttcattattctgcatagggatatccagtttttaagattatgcaatcttgctagcacatacaccaagtaccaagaactggattctacctacttaggtttcattgttaaaatatcttttcatttatagaaaccgatgaaagaatcgtttccatggtctttcctttcatcgtccgctccctacaacctaatataattaaaaagaaaaattcaaagtagagcaaaatctatctacttgaaaaaagcctttttatttttgcaactgaggagacaaaaagtacatttcatatttccatacattagaaatacacaggtcttttctatatatactagaacctactatatatttatatattaacaagtctatttttatattttatatagtaatatttatattctatatatatattatatataatacatatataaacatgtatttatctttatatattacatataatcatttattttagacggtaaggttttatgcttgttgaagcatggttcccagacaaagagaaaggaaattatcactttcagaagaataaagtacaaaatcatcacaattcaatacccagctgtcaataattgcaatgagagaataatatagcagaacttgctatgtatagaaaatacctgtgtatttcttttgtgtatatatgtaatctacatttatatataattatataaatgcacaggtcttttctatatatagtagaatttactactgtattcctaatgtgtgtatatatataaaatctatatttataaatatttatataaatacacagatttttatatgaacacacaggtctttatacagaaaagatcggtgtatttctaatgtgtatatatatataatttatatttatccctagatatttatatacatataatctctatatatttgtatatttatgtatttatatatctatttaatatatttatataaatagatctcagatatagattttgtatatatttatattctatataaatatttaaagacatctataaaatatataaacatatttatatttatatataaatgcataaatatataatgtataaatataaatatatattatatataaaatatctattctatatgtgatcatttattttagaaggtaagctgttagtattgttgaagcatgcttctcaggcaaaaggagaaaggaaattatcattttaagaagaataaagtacaaaattatcacgatttaatttccagttgttaataattacgcagacagaataactcatgccatttaatcttacaatgaatagcacgttaaacttttatgtgattctgaaaatacgaatttccatataataagggtttgagatgtaaagcactaattttataggcagttttcacttgttacatagattgttcttagagctttaaagatggtaaaattaatggtggctttgaagagatggtagcatcatttgagaaacaataaatgggttctgtttcatcctttccttggtgcagtcagggcttcacttcattagcttaggaagggatttcagagcttttcatgttgatcttgtagttgcctactatggaatcctacgaaacctaggacgctataccacagaaacagggcgttgccccatgtcctgaacaccatcattttgtggtatatttcttttgtatttcttatattgaaataccataaaaggatgagcatgcttggtataactcaaagcctgtttatttgcaaggctgtgttgacccttaacaataaatatgtgtatgttatggatgggaaacaagtcagaatgaaaagctcctgctgtcttttaggaaagcctattggctgtggttgtatatctctttccaaagggaaattggtgaactctctgctatagttttttccataatgacagcataaaactgaaataagctgaatcttgtcagtggccacttttgggtttggtgtatattagggagcaattctgcagtgtgtttcaaaattacattcaaaaattaatttcgtgcaccttattttaatgccttatttccctcaagctctgcatgtcacaacagtctgtgatgattcttttggcattgaaaaaattatccatggctcttacatcgtgttcctttcatgatttcatggcagttggagcttcaattgttatttgttgggaacccatcctgactagctatttcactggggcttcatgttttattgtgatgattggcagaactgtgtttcaggaatttttggctttggaaagttactatgattttgaaattatagatgcaaaaatgtcactgaatttattttcacaaacttttaattcattatagacaataagtggtttaatcagaaatcaataatttaaataatcttttaatttgttggagcattcacaaatactacatcttcctttaagtctttctttattctacatgttatatacacagttaaattaataaataagagttttaaatattttccctccttctccaactacccacaagctcaggcttaaaataaacagtggaatgagtaaagacccaaagtaatatagcagcaaagctgtagttgatttttataataaaataatagatatcaaagcttcctgacgtttttaggcaaatcttcctgtgtccctaaaaggaggatccccttgacaacagtcatgaacaacagctgatcttgagattctcagctgtcaaagacggtgggagaatttgaaaacaccttgtacatattaaagagctaagcatgagctgatgcatacatacatatgtctctgtctcattagaccgcaggaaacaggacacatggcaggaaggctcacgtcgattccccttgaccatgcagcttcctccgctcctgactcctaagaactttctgacctattggtcattcccagcttcagatccccacgcataccgattgtttttggccccacgtcagtgatacacaggacacagaattgctctcaaaaaacactctggaattgaaaaatgacaggagaagctcaacgcgatggctgggtaccagagggaaggccttccgctgttttgaacactgatgctaagctctagaataactgtagctgcagcctattggacctggcatgtgtcaggcagggtgtgaaatgctccccaagcacgacctcatttctccctcacgttacccctgtggattaatcggggctctagagagacaccaccaacaggttatcagcaaagatagatgagaggggatttattaggggaattagagggtgaaaagtctcagggcaggctttctgcaagctggagcccctgggatgccaggagtgtgactcagtccatacccaaaaacttcagaaccaggtaagtggatagtgtaactctcagtataaaaagagcctgaagttctgatgtccaagggcaggaaaagaagagtctcagctccaggagagaaagggaggaaagtgcctttcctctgccctgtttcttctatctgggccctcagagaattggatggggcctgtttctattgaagacatcttccccactccgtccagcagctcacaccaatcttcatgggagtatctgcacaggctcacctagaaacaatgctttaccaattcctgatgtattccttaaggcagtcaccttgacagtgaaattatccatcacaccctgtaaaatgaggagtgtccccactggacaaatgagacagacagtttgagtaactttcttatactgcttgtaggttatagagtcaggattaaaactcaggtctgcaaagatcaaattctaaactccaccctcttaaggactgctgctcaacactgtggaagcagtactgcattagacactgcacaaggattgaagaggcattcgagacacatcccctgctttagggaccacatcctagcttgcattcatgacaggagtcatgtttctgtgactctactatagaccccggaaccaagtgtgaattggtacgctttaggtgtgcatacgctctgcagaaatcctaagaaagagccagataattataggctcaattcatatagggaaatttttacgaaaatagcttttagccaattcctgaaagaaaatatttttactggcagaaaaatgttctgctggagaataactagttgaagggctttgggggaaggggccctggacatatgtacacagaagtaggggaaaaagacacacagaatagaaacagaattgaggacccttcagggagagaagtaaggaaaagtgctagcccagcaagctgataaaaatatatctgccctgtatttaaagttaattccatctcttgattttttttcatattattcattttattatatttgttagtatagtattatccatcttattgtcccatatattatggcatttccccctatatgtgaatatattaccacatagaaggaaatgacctcattttcctaatacataattagacacatgagtttattcctttacaagcaaaaatgtgtctcctccattacgtattaaaatgaataaaaccatataatattccagagttgaatcttgtagctcaatacttggacagaaatgttgctaatttgcacattttatgtggtactgatgactcccacattaaggagtgtttttattgtctgcttggtcagagacctcagtgttttgatgaaagttcattcttaggaggccactgtcatcaaatcaactttgcatatagaaaacttatgaaaacacaaaccattctgtcctcacaacttctgttcacaacattggtgaatggagtcacacctgcatgctcatagtttatcaccacaaactatgaaactactaaaagaaaactgtggggaaatgcttgaggacactagtctgggcaaagattttttgagtaagacttccaaagcacaggcagtaaaagcaaagtcaacaaatggaaaaacatgaagctcaacagcttctgcatggtaaaaaaaaaaaaaaaaaaatcaacgaagagacaacctaaagaatggaagaaaatatttgcaaactatacatctgacaagagattaagaaccagaatatatatatatatataatatcatatatatatatatatatataatgagctcaaacaactcagtagcatcatcatcatcatcatcatcatcacctgtgtgtagacaactgaatcaggctccgtggctcctggaaactggaaatgttcacataaaggcagagaaaacccttccagaatatttctacactatttcctacacgaatcactcgagaaccatttccaaaagcaataaagtatatctggccaacccatgctcagcaccatgctcttgcagaattttgactttgcctttttgatactgacctttgattttttaaaataattgttttgtccttttgcttcagaaatttacaaagcaaacagaaaacattatttaggaatgactgactctgtattactgaatcaattattaaattttgctgaatgattgatcttggaaaatagagatgtaactacttcttgatgtcaactgtaattcaaatctcatctcggtaaagaattaatgaaatgcttagccaggcatggccaatggaattagaactagcccagtcttgccataactttctgcttccttaccatcctgagtttcagtgggcaacagattcatttttggagattactatggaaatctctgcaacagtttttccactcataacttaaggcgttcataattattgcagaagtttctcagtctctccatgtgaaatttctcttagctattggattttagatatttcacagttccttttgtgcttttaaacacacaagcccaattctgcttctttaagtggttttgtgttccagtcgcctgctcagaatatgcctgtttaatcctcctcctatagtgattgatctgtttacactacactatactagactggggaagttttcaagttgatttgagctttttaggatgtagacagcagctaaattcatgacaaaaatgagatgctaccttaaaaagtctgtccaaatgtaccaaaggtacttgctgtatgaggcatcataacttcctgtgaaaatgaaagctatgcactttttgaattaaaaacaatggtgcacagatatacatacactcctgagcatgcatcaggtgtgccgcacacattcacacacacgcctcctcccccccacacacacattatcttagagtgtgccttggcatccttcttcacatagacataggacattgttgaagagacccagctctgtgtggtcagtctgtgtgcccagcatcacctttgtccctccacagctatgtgcccactttgtgtggtctttatatttttctgaagaagactcaggttactcattcactttatttgtgtacacacttcaaaaaatatatattataacatttctataatatccaataaaaggatgaaattagaggatgtgacttctgacccaataaaggacaaaataaaatggtaataatcaagctaaaataaaacaaacacaaacaagatagacagaataaaagtgatatgaacagcaagtatactaacagaaagtacaatataagatgatagaaatgagtccacaaacacaatggatacaaacagattaaactctataatgaaaagataaagacacaaaaggtttgaaaagaagatgatggaaaaccaaacaccaaatatatgttaacccaaggaaaagaggcttaactgtatcaacatcagataaattaaatattaatgctaaagtcatccttatggataaaacagtcatccatttgagaaaatctgttaagttctcagatagctataacaatttaaatctatatgcatctaattaaatggcatttatatataatatacataaaagaaaaattaacagaatgaaaatagaaatgaacaaatccgccattatactgggataattcagcatatactcaccagctgtgagaatggtctatgactggcatagagatcaaactaatataaatataaaagatttaacagtttaataagctccttgtaatggacatatatagaaaactacatgaaataattggagaacacgttcttttcaagcgttccagaaaattttctaaaacttggttacccacttgacataaagtatgtcttctcaaatttcaaagaatctgaaattttctaactataatacaaaaattaaaaagttaatgcctaaagaaaaccttcaatggccctgtatatttaaaaatgtaaaaagacacacaaagatcactatgagttaaaagaaaaatcataataaaaataaaactgtgtctaggagagtttgataataataacaaactccctttactccattcataatttaaggcttttataattattgcagaagttgacaaagtacatatttaaaagaaaaattttacctttaatttttatgcatggatcttatttgggccataagccaagcacatgaatatgtgtctgtgtgtgtgtgtgtgtgtgtgtgtgtgtgtgtgtgtgcatctgtatatatacaagatattctactctggggcaggcagaaatgtctaggagttgggatgaaatggaattggccatgagttgatgactgcggaagcttggagaaggtctgtagctgtttcttggaccattctctccctctcatccttcaccccaacgagtcctgtatctagtcccatataacaacaccacacactgagacaaatatttttgtcagcttcttacctacacgttgagatgactttatacatttacaagaaacaagtaaaggcatatatgtattttcctttgttcacataatatatagtatatcgtacacgtccatttacaacccacttttttcacctaacatcatatctcagaaagtcttccttatcatttgattgtagtggcattcccaccatttggacacacagtattttattgaatccttcctctcctgaggaacatctagggtgtttgtaactctgtgcgaaggctaggactgccgtgaacaaaactgtgcatccgccacgtcatccatgggcaagtgtctctgcaggaaacattctcaaaaatggaacagctgggagagctgggtcccatatctgatcattaatacatttttattactggtagatgttaccaaatatttctcctcggggattgtaccaatttatacttgtaccagaagtgtgcaggagttatttgcaatactttaataacccagtgcctttgcctcctttgcctggaatatgcatcctaccctcatcagatgccatcctctgggagatgatttaagagggatgccttccaagacaatacctcctgggctgcactaggagacagacacgtgcccctaggggtcccgcaaatgcatgtctcacaacacttctcacactgcattgtgattgccagggttcttcattttctcaagctccagaataccagttctgtcttatttgtcttctttcacctgtacttcctaccatgccggacccacaggaagctattgtaatgtttgtaacatgaatctttaaaaatgggctgaggtctctatggattacatatacttcctaaatcaatttccaaatacaaaaaaaaattcaagcaagaaataaaaagcacatgttttaaaagagcattacagtgtggagattccttgaagaactaaaagtagaactaccatttgatcgagcaatcccactactgggtatctacccagaggaaaagaaatcattatacgaaaaagatacttgcacacccatgtttatagcagcacaattcgcaattgcaaaaacatggaaccaaccctaatgcccatcaatcaacgagtagataaagaaactgttgtatatatacacaatggaaaactactcagctatagaaaggaatgaattaatggcgtttgcaacaacctggatgagactgcagactattattctaagtgaagtaactcaggaatggaaaaccaaacatcacatgttctcacttgtaagtgggaactaagctatgaggatacaaaggcataagagtgacacaatggactttggggacttagggggaaagggtgaaaagagggtgagggataaaagactacaaatagggttcagtgtatactgctcgggtgatgggtgcaccaaaatctcaaaatctcaaaaaagtaaagaactttcttgtgttaccaaataccatgtgaccaaacactacctgctccccaataacctatagaaataaaaaaattaaaataaatgtaacaaaaaagcattacaaaatcaaattcagaaaaagagatatgaacataaaaatgaccccaaaatagcaactttcaaattttgaacacaaataaggatggagctattttgtttgtttaagtgcctatagaaattgtattataaccaaacaggcttttgtagtcatttgtagaaaaataagtacaacataaagtgaatacagtaataaagaaagttgtatatctgttataaataaacatatagatttttcatatatgtctatagggcaatgtccatcattctggagaagtcgtatggagctgtttagtacattttaactaatgttccttaaaaaaaaaaaaaaagaggctgggcgcggtggctcacgcctgtaatcccagcactttgggaggctgaggtgggcggatcacgaggtcaggagatagagaccatcctggctaacacggtgaaactccgtctctactaaaaatacaaaaaattagctgggcgtggtggcgggcgcctgtagtcccagctactcgggaggctgaggcaggagaatggcgtgaacctgggaggcggagcttgcagtgagtcaagattgcgccactgcactccagcctgggcgacagagcgagactccgtctcaaaaaaaaaaaaaaaaaaatttctcctaagttcagacactgcttcattgattaattcatttgttaatccatccactcactcaatatctccgcaaatatttatggtggccttttttttttttttttttttttttgtaaaggactatgctgggccaacatggtggctcattccttgtagtcccagcaatttgggaggccaagtgggagaatcactggagccaggagttggaaactagcctgggcaacatagtgagatcatgtctctactaaaaataatagctaaatttcaaaaacatattttaaaaaaggactatgttagtgctataaggtatccaaaatttatctgataaaaattccaggctctgtaaatttatagaagaggggaagataattttcttttatcagtaaattatatcattgtacttaaaatgtttttcattggctttgattttaagaaatgtaaggaaaacaaaatggtttacattaatcatatattgtatatattcatatgcaaatatttacaatatgtatttaaatgtatatgtgatatattattcaatcttgtttgtggatttagaaaaaaaaagagattgatacattttaagaaaacttccctgtatgaaaaaaatttctggaaaccgtaagtgtgagctatctacattagtgtttctgtgtttggcaaaacagtattacagcccaaacgggaatggttgaggacagataacttggccaaatcaccctggctagaaaagtgaggagattgcatcaaactcactccgaaagccaatcaaagaataacttgaaaccgctttcagtcacttggactttgcttcctggtccttagtggcagctaatgaggtttagaaataagcacatgtatctgtctatactgaagggaagaaaataaatctactatggcaccagttcaaaacactgcatgagcagtcgagagaaacaatttaccagaacatgcttaatggtaaatcagaaatgacatgtatgaaaacatggggctgcaacttgaaaatattggaaaatgagtcatctaaatttgcagaaccaatcagatcttggactgatacactttgtaagttgcaactgctggataccatgtagctatgtgatcaagagcatctgtaatgatgaatgcttcatgttcacacagctttaaatgcctgatttctgaaatgatcaatcatttattagctgtaaggtaagggcaatgacatatgcaatcttctcctgtgcttagagatgttaaaattcatttatggtactacaaagataagaacatgcaataaaagttctaaactatgtaataaaatccaaggtaggattttatggattatgtattagtaatgatattttaagagaatattaacattttgttaagcaaatatattaatatattaattattcaataattttaattatgattaattttatcataagcattttcttttctatttacacataagacacttacaaattcaaataataaaaaaagatgtttttaaactgtactcaggaatagacagacatatgttttaaataaagagagtctatttcaacacggcaaaaccccatctctactaaaaatacagacattagctggtcatggtgacacatgcctgtggtcccagctactcatgaggcagagatgggaggatcacttgaggctgggggcagaggttgcagtgagctatgattgcgccactgccctccagcctgggtgacagagcaagaccctgtctcaaaaaataaaataaaaataaaatgaaataataaaaaacaaagcacataggtcagctggatgcagtggctcatgcctgtaatcccagcactttgggaggctgaggcaggaggatcacttgaggccaggagttcaagaccagcctgggcaacgtagtgagaccatgtctttacaaaacacacaaaaaaattagccagcatggtggcacatgcctgtgttcccaggtattcgggaggcctgaagtgagaggatcccttgaactactgtatacaatttgcagccaggtggaagacagtacagacttcaaagcctccattaactcagcgaacccattccccagcccatggacacacacacaaagacttacactcacattttttgcttatgggagccagcgtttctccttaggagtagcaagggatgagctttttattgtcactgtggcttttcagtttatgcaacaacacctttgaacaagggctgagaccaggatggaacccacgctatctccctctttataatggtgccatttaaaaaattattttgtagagatgagatcttgctatgctggccagggtggtctcaaactcctggcctcaagtgattctcccatccccgcctcccaaagcgctgggattataggcatgagctactgtgcccacctaaaacaatgccatttttaagatgaggtgcatttaaagaaagggtgtatttggtaggcaaaataagtaccctccaaagatgtccaggaactcatccctggaacctgtgaacatgtgagacgacaaggcaagggaggaaatgagttggaaggtgctattgacaggtaccaatcagctgacctgaagcatggatattatcttgggttatctctgggggagtccagtggaatcccaagggtctttctaagtgtaaaagaggcaggagaaaggaaccagaaagacagccacatgagaaggatccaaccccaaaaatgctggcttttaagatggagaaagaggccatgagacaaggaatggtgggagctttcagagtctgaaaaacacaagaaaacagctcctcccctacaacccccagaagggacactgccccactgtcatcttgaatgttaacccaaaggcactcagtccagactttacatgaaactatagaactgcagggcaataagtgtatgtttttacttttaattccaaaaatttcactaacttattttaattgacgaacttaaatggtatataccatctacaccaggttgctttgaaatatgtatacatcgtgaaatagctacaccgagctagttgacgattgctttacttcacctaagtataattttctttgtggtgagaactcttaaaatctaccctcttagcaatctttaaaaatacaatattatcattagctgttgtcacagtgttttacaatagagctcttgaacttactcctcctgtctaactgaaatcttgtaccctttggccaacatctccccaaccttccacctcccccagctcctggaaaccacattctattctctgattctgtgagttcaactgttttagattccacataggagtgagataatgcagccaggatcagtggctcatgcctacaatcccagcaatttgggaggccaaggcaggaggatcactagaggccaggaatttgagactggcctggacaatgcagggaggtttcatctctagaaagaaaaaacgtgtgtgtgtgtgtgtgtgtgtgtgtgtgtgtgtgtgtgtataattatataatatatatattatatatataatatataatatattatattatatatataatatataatatattatattatatatattatatataatatattatattatatatattatatataatatattatattatatatattatatataatatattatatatattatatatattatatataatatattatatatattatatatattatattatatattatatattatatatattatatatattatattatatattatatattatatataattaatataatatataatatatataatatgtaatacaaattatatatataaaatatatattatatgtaataaaaattatatatataaaatatatattatatatattatatatataaaatttgtattacatattatatataattatgctatacatattatatatatctaatatattagatatatataatatataaagcataattataattatgctatagatattatataattatgctatagatattatatataatataatatatattatgtataatatataatatatattacattatgtataatatataatatatattacattatgtataatatataatatatattacattatgtataatatataatatatattacattatgtataatatataatatatattacattatgtataatatataatatatattacattatgtataatatataatatatattacattatgtataatatataatatatattacattatgtataatatataatatatattacattatgtataatatataatatatattacattatgtataatatataatatatattacattatgtataatatataatatatattacattatgtataatatataatatatattacattatgtataatatataatatatattatattatgtataatatataatatataatatatattatgtataatatataatatatattatattatgtataatatataatatatattatattatgtataatatataatatattatattatgtataatatataatatattatatattatgtataatatataatatattatatattatgtataagatataatatattatatattatgtataagatataatatatattatattatgtataagatataatatatattatattatgtataagatataatatatattatattatgtataagatatatattatattatgtataagatatatattatattatgtataagatataatatatattatattatgtataagatataatatatattatattatgtataagatataatatatattatattatgtataagatataatatatattatattatgtataagatataatatatattatattatgtataagatataatatatattatattatgtataagatataatatatattatattatgtataagatataatatatattatgtataagatataatatatattatgtataagatataatatatattatattatgtataagatataatatatattatattatgtataagatataatatatattatattatgtataagatataatatatattatattatgtataagatataatatatattatattatgtataagatataatatatattatattatgtataagatataatatatattatattatgtataagatataatatatattatattatgtataagatataatatatattatattatgtataagatataatatatattatattatgtataagatataatatatattatattatgtataagatataatatatattatattatgtataagatataatatatattatattatgtataagatataatatatattatattatgtataatatataatatatattatattatgtataagatataatatatattatattatgtataatatataatatatattatattatgtataatatataatatataatatattatgtataatatataatatataatatattatgtataatatataatatataatatattataaataagttggatgtggtgcacacacctgtggtaccagccactctgaaggctcaggtgagaggattgcttgagcccaggaggtcaaggttgcaatgagctatgatcgtaccactgcattctggctgggccagagcgacacctggtctctaaaaataatatgacttcaagtacacagttactcatttgaggtagtaaggggtggcataaacatcaactgttccatcattaagtacactgtggcctctttcttgtccttccactatagagtaaatagtagtcagataacccaggatgtacaacagaactcagacatggacctctgcagtgcttattttggctctgtaactactgaaagagatctcaaataaggatctttttagaaacttaaagtagtacttcatagtacttagtagtaccaacacacgctttgggtaaaaggaaaatcctttatgaaaatgcaaactttaggaattaaatgctccccatagggactcacttattgctgtatacgtgactgcaggcagaaaaacacaatctgaatgaacttgttttttttcttaaacttggaaaacccagaaaaggtgagtggtatacaggggccaattaacataaatagcacgaggaaaaatgagaggaagtcactcctctcctcccaatgggagtactgtgttttgaaggattcatgaatggaatttcagaaacttggcaaaagaatacatttacttcacttactccatatatattctgaatttcatatttactaaataaagtgtttccaaatgaacatttctttttttacatgttacatgtaaaattgttttacatgtaaaaacatgtacatctttttaacatgttacatgcaaaaaatctttttacatgtttgttatatgttgttacatgtgaaaactgcacattaaaaaaaggaaaggcaggcgaattcatcattcaagtttttagatgtccatataaacttccacataatccacgaatattaaactggataaacaaagcactctacaaaatttaccttgccacagatgtgaaataattgtaagcatacataaatgttaacaaaatgctttcattcaattctaaggggaggtatcattgaatgatggaccaaaacaaactaaatagcattttgatgtctgtggaaatgacatacccacaaaccagtggctcagcactgatattaatatatcttgctcagttgccttaatcatttacagcagtataattttttttaagaacacagacagtaaggtgcttttaataattttgatatggccatagagtatatctattttttgaagtcctactttcattggaattgcctctttatcctaatgagtaaatacaaaagaacgcacagataagatagcttttgtcttcttcttcttgttttctgagaaagagtcttgctctgtcgcccaggctggagtgcagtggcacaatcttggcttactgcaacctccaactcccgggttcaagagatcctcctgcctcagcttcctgagtagctggaactacacgtgcgtgccaccacgcccgggtaattttggtatttttagcagagatggggtttcaccatgttggccaggctggtctcaaactcctgacctcaagtgatccactcccctcggcctcccaaagtgctgggattacaggcgtgagccaccacacccagcagatattgtcttcttttattagagaaaaatgtacttttctatgcctgtgctttctacatttttggaactgatacaaatccacagaggccaaatcgaaatctaaattatctttaatgttaaaatttaattgaccgtgtacataactatgcaatccctgctttctcacagaagtgtctaggattcattcaacagatcatagaaacgaggtctggcatttaacagacgagtgacagaggagctataccgatttatacaacaattatcaaaacactgtcatgtagtttactgtagctcaagttgtgcttgtatcatataacataggttcaagttctttcttcagtcatcagaataacagaggttgaagagacaactgggtaagtgccaacttttccaaaagctgtttcaaaaaaaaatttaagtaactgtaatacacatttctgcaaataaaatattccagtgctacatcaatcctgagtttttaatattaaatatgcactacttacagttctgacatgattttatttaaaaacatgtctagttatcaagttcactgtcttcatcggaaaaaactctgtcacaaaggtcttcaaagtcctcaagagcctaaaagaaaaagtctagttcactgacaaaccaccactttatatctcgcattttaaacagggttaattaaatgtcaaaaggaaacagcttttaatattcaaaggatgccagttattcatttcaaatagaaaaaactataatcaatacatggagctccaaatacccaattaaattttttaatgccagatttcagtgacatattattttagcaggtctaacagtcatgtactttgcttaaataaaatgggttgaagaacatcttaaggtcaagatggagcgaagacagaaaaagacgggcaggcttatatcatgaaatattatattttttttcagcaggtagcgacccatgtattatcagcaatagcctacataacatggtttccattgaagggataaaatggttggtgatatgacctcatcaagttagagaaaacgtaactgtgtttgaaatatatactctttactcaacaaatagttcaacagttcctactccctaaaatgttgtaggttaatgctgaggaagatgtaaaaaatgaatacacaatcttccgtatttctatgacatgagcaaatgcacaaataaaaaacaagtaatacaaaacttgtgtaactgctatggaagggcaactcactcgggcatgtagccaaaaatggagactgatgttgatttagttggcgaaaggtttcaatcagtcaaaaaaagattttaaaagtattgtgagggaagagcatgagcaaagcatgggagtaacggtgagttccttcagggaaggcggtcaacctggagaagtgggaggaaagacagaaggcggcaaaacaagcctaagagggggtcatgtaaaggggagagtctctgaatatctaagaactgagacggggcatcactgacaggctgggaagacggaagggctgggaagcattttaggaagggaagggttttagaaagataatattgccaatcaatgaaggatggctcagaagagaagagagaactcagaaaagagtttaatagtacaggtaaggaagaatgaggtcttggactagggtagccgcagtgggaatttaaagaaagaaattaaaggaccattgcagaggtaaaacttgcctcgtgataactacatgggaaggataatgaactcagaagagtccaagatgatagcaaagttcctaacctaagtggtaacatgaaacattaatactgacaggaaaactactagtctcatgttcataccaattaataaatggtatctggagaacattatagcaacatgttctctacttgtaacttctatttaaataactgtttgtgtatagataatcctcaagttgcttgaaaattttattttcaaactcttttcccagtttatttaacacatctcagttagtgtagagaagtgacatatgaacatgtcttttccaaggttattaaaaagaataccagatctccccaaaaaagattccactgcttcctaaattatctacatctacatgaagaagaggtcattgtctgatgataatttgctaatgtgctgtacaacagcagataattcgcaattcacaacgtgttaataatctgctggctttcccattctgttatacatctgaaccatctcttatgattacaaattgtcatgtagaaccattactaataattttgtaagtgaatatgccataaaacactcctgtgtttcagcaagaaataaaaaagacacacagtagttacgcttgcctacttcctatttaactaaaactcttgaaacaacacaagtaaaaaagccatccagaaaggatttatggacctcttgccttccaccatagatttgtcattgatgtcctgaaaactgaaaataaaatcttcattaaaacccatttatgcctagtgttccattattggaacgctaagcttgtgggaatcatatatatcctactgctcaaggtcatggccaaggtctgatttttcacacacaaaaaaaatttgcaacctctggcataaataggttaatgtgttaataaagtgtcaattttatacataagatgtgtatttctaggtaaaatttccaatttaccttttcctgttctaaataactcccacaaactattcatgaatcctaaaaatacatttaccaattatattatatctggaacaatacattcaaagtgaaaatgctaagtaatttgaaatgtataatcaaatgtctttccatacattcagaaacaagcagactgtcttctattatgcacgtgttgtattttataatgtattatgttaccaaatagaacagacctttacgaattggtcacgtagcagcttcatctctttcagcctctctctcctaacacttctatattgttgccacttcttctgttgttcttgaaatattctctagaatcccaaaacaaaatagtgataaaaattgggtaaattttaatacttacaaaacataattctgcattagctttaaaggaatactgtttaaatcaatacctctgaacactttcttttagacaacatttaggaccaattttaaacaattgtgttcaccaataacatgctaaaatgatgtattaaccttttttatcagtcattaagtaaagaattttcttacttttacacattcaacacatatgtcctaattcttgatttccaatgaagagtatttgatgaaccttcctataatttgttgaccacagataggtaagatctatacagaaattaactaagaaaaattctttctaagattttaagcatgtattaaatctcggtcatttcaatatgcacatagatgaaccacccaataatgattgcctttctgcaccctgacctaatctccaacaacagtgttctcctctcctctacgtggcactcactcacacagtcatcccctagattttgtcattcccaatgacttcaacacctacgtaatattaataatagcaatgataaagagcaaccatgggtcagatcacatcctgaaaaacttaaataaacctgttacacagaaaccctttgatcctccaaacaactctgacgtaggtactcttaccatgtctcctttcgtagataagataatttgcccatggtttccgagctagcaatggtcaagctgagataaataatttttccatggtttccgagctagcaatggtcaagctagaatcccaagcagtgtggatgcatagtcccagcccttgaccactgcactcagctgtttctccaacttcccaacatacagccactacctccctgccatcgtaggtcactcacttcagtactacagctcaggagtctgttgggacctgacacccactgaatggagcactttttactgcccattgcccactcccgtgtgctcagataactcagtcccagctgaaattccacagccagtcatcatatccccatctctgcatctattccctgcccaactctccctctatcaatctgctcggctacaccccgacccaggaaattccaaccctacagctgtgcttgcacaaatatgccaactgggcttactttaacttcttcatcgttatgatgctgacttcagttggacccctaatgctgcgtggcaattatattcccctagtccattagtccactaacgggcccccctctctgggctcatgcgctcttccttctttgctggatttctgcatgaactattactacctgagacactgacataacaggttatacataaagctaagcatgataccaacaattagttcttcctcttctccctcttcttcttcttcctctttctgctcgtctgtgatgtattcttcaaggacatttagcaacttcagagaatgtatataatcacgtttctgcctgtaacacataataagtaacacggtcatacgtcatagagagatgaaaaattaatcctattcaaacccaaactgacttgacataatttatactataaagtagcaagggagtaatagcagctgaaatcttctttttggaaaaaagtgaaatgagttactctcattttgaaaggattcttttcttcctgactactagagcagctatcttacattctttacctgctgaagacaaaggagggtttactgcactataactttcccagaaacattttctctaagagcagtttactttccatttcctcttactgaataacatatgggttctcataagtaggttcaagaatatcatagccattcatcccataagatttcccaaaagaaaaacttcacttaactatttctccactttggcacaccaatgattttgtaaaagaaatagtgaaaacaatttaactaaaatagataacttatttacaacataaggttatccctttctacataattgagtatcgttaaggatctacagactaaacattgagaacatttatcttatatgcagctaccatatttctagaaatggataaacattaattttacaagaaggctatttttatctggaaggcaaaaagaggtcatcttcattggcttctaggtaatatctcttaattctgttaaactgaggttataaaactaaagaaacttacctacttagagaacaatcaagtaaaatatgttgttcactagagacgccaatatgtacaggatagtttttgaaattatttgcaccaactaatacaaagaaatgatataaatatcattatgcaaaaaagccaacagtcataccttttaagttgctttttt

SEQ ID NO: 534 - DNA, 27184 bp, Homo sapiens
atggtgcaaccacaactatagtcccaaacctgacacaagaataggttcttaaaaagaagggaacacagcgacttcctggctttggagagaggggaaaaagagaggagaaaaggagatcaaacaggagaggggctcctacttatccattcaagaaagacttaccaggtagctactaagtaagatactgggctgggcagtgaggacagtgaaatgaatcagacttagtctccactcttgataagctcacaaactacttagcagaggggtagggaaacaggtaaccaccacaaggtatgaacaaggctgtgaaaaatgtaaatgccaggtgttgtgaaacagaaagaggctgggcgaagtggctctcgcctgtaatcccagcactttgggaggccgaggcaggtggatcacttgagatcaagagttcaagaccagcctggccaacatggtaaaaccttgtttctactaaaaaatacaaaaaaaaattaactgggcatggtggtgcatgcctgtaatcccagctaaatcaggaggctgagggagaagaatcgcttgaacctgggagacagaagttgcagtgagccgggatcataccactgtattctagcctaggcgacagagtgagactctgtctcaaaaaaaagaagaaaagaaaagaaacacagtcattgggccaggcacggtggttcacacctgtaatcccagaactttgggaggctgaggtgggcggatcacctgaggtcgggagtttgagaccagcctgaccaacatggagaaaccccgtctctactgaaaaatacaaaattagccaggtgtggtggtgcatgcctgtaatcccagctactcgggaggctgaggcaggagaatcgcttgaacccgggaggcggaggttgtggtgagccaagatcgcaccattgcactccagcctgggcaataagagcaaaactctgtctcaaggaaaaaaaaaaaaaagaaaaaaagaaacacagtcattaaggctagcacctgagaggaggtgccacctgaccaaaggattaaaacaccaagacctccaaaaatgcttgttaactggatgagaaatgaagtcacttctgccacgaagtaccaggaatgcctggagcccagcaatgaattcagtagagctaaagttctgggtagtactaggcaggtaagcagggaggaccaggaagaaagatgaactcatattaactgaatacctgccccatgccagatgcaaagggtgacctcgtttaattttcctgaccacagcccaggtggcaggaaacattaccctcactttacaaaggcagaaaggaggccagacacggtggctcacgcctgtaatcccagcactttgggaggccaaggcggaaggatcatctgaggttaggagtttaagaccagcctggccgacatggcgaagccttgtctctactgaaaatacaaaaaattagcagggcgtggtggcgtgtgcctgtaatcccagttacttgggaggctgagacaggagaatcgcttgaactcgggaggtggaggttgcagtgagccgagatggcaccattgcaccccagccagcctgggcaacagagcaagactatgtctcaaaaacaaaaacaaaaacaaaacaaaaaacaaaaaaacaaaggcagaaagagaaaggagctggagtttggataccagcaaagcctagtgtagaggcaacagggaaggcccccacgagccacagcatggaggacataccttgcagcccatccacagaatatcctggtttgtctctaaacatgaaagagacctgaataggcccctcgcactgcagggtttgggtcctggggcagtcaaactggcatccaggcttggatctagaggctggactgctagccacccactggctttgtcatcagcagcctgaggagtttgggctctggcccttctctttctccttttggggagaaaatgttgctcaggaagggctagtaggggtggggggtaggggatagctcagccatagataagtttaagctccaacaatgccctggcctgaggagattgtgaaccttgcaaactcatcgctgagcctatgggaaaatccctccatatctttgagcctccacaaaaaggctgagtaaagctccctaacaccagaggatcccaggagctgaggcaagattctgtaacctagtggtctaagggcccaagtgaagttggagcaggctgtggaacccaactgacttaggttccaatctagctccaccaattattagccatgtgatgatgaactgctctgagccacagttttccaatctgtgaatggggataccaagcctcccaataatagggatgctgggcagactcaaatattacagggctttgcccagtaagagaccacttaatgagttcccttcccttccccaggagggaaaaaagcctctctagtaggctgattaatagccacgcaaagatatcaaaccctaacccccctggaacttgtaaatgttaccttataatgaaaaaggtagggccaggcgtcgtggctcatgcctgcaatcccagcactttgggaggctaaggcaggcagattgctttgagctcaagagttcaagactagcctgggcaacatggtgaaatctcatctctacaaaaaatacaggccaggtacggtgattcacgcctgtaatcgcggcactctgggaggccgaggcgggtggatcacctgaggtcaggagttcgagaccagcctggccaacatggtgaaaccctatctctactaaaaatacaaaaattagctggtcatggtagcaggcgcctgtaatcccaactactcaggaggctgaggcaggagaatcgctggaacctgggaggcgaaggttgcagtgagccgagatagcaccactgcactccagcctgggtgacacagcgagactccatctcaaaaacaaataaataaacaccaaaaattaaccgggcatggtggctcgcacctgtggtcccagctactcaggaggctgaggctggaggatcacttgagtccaggaagtggagggtgcagtgagccaagattacgccactgcactccagcctgggtgacagaggccagcactgtctgaaaagaaaagaaaagcccgggcacagtggctcatgcctgtaatcccagcactttgggaggccgaggcgggtggatcaactaaggtcaggagtttgaaaccagcctggccaacatggcaaaaccccatctctactaaaaatacaaaaattagccaggtgtggtggtgggcgcctgcaatcccagctactcaggagggtgaggcaggagaatagcttgaacccaggaggcggaggttgcggtgagccgagactgcgcctgggtgacagagtgagattccacctcaaaaaaaaaaaaaaaaagagaagagaaaagaaaaaaagtgtttgcagatgtaattaacttacattattaaatctggagatggggggttatcttagagtatcaggtaggacctaaatgcaatcacaagtgtccttataaaagagagacagagggaaatttgatacagacagaaaaggaaaccacatatacagagaaggcgatggtgaagatggaggcagagattagaatgatgcagtcataaaccaaggaatgttggcagccacgagaggctagagaaggtctaaattctccctgagagcttccagaaggagtgtggccctgccaacactttgatttggatgcagtgaaactgattgtggacttctggcctccagaattgtgacagaataaacttctctctctctttttttttttttttttttttttgagatggagtctcgctctgtcacccaggctggagtgcagtggcgcaatctcagcttactgcaacccccacctcactgcaacctccaatccgtctcctgggttcaagcaattctctgcctcagcctcccgagtagctgggattacaggcacccaccaccacacccagctaatttttatatttttagtagagatggggttttactatcttggccaggctggtcttgaactcctgacctcgtgatccacccgcctcggcctcccaaagtgctgggattacaggggtgagccaccgcacccggccaacttctgttgttttaaaccacccagtctgtggtaacatttgtcacaacagccacaggaaactaacacaccccccttggtagcactccttggtgtctgttccctagtgcctcacaggtgtgagacaatatggcatggatcccgctctgcaaggtccacctgcctaccatcctccagggtgggaggttagaattaaggcagcaggggcctggaatctcccttctcaccctgggaaactactgaccctgcctatggatggatgagctgccactgaagtgggggtggggtgggggggcaaaagatggcagcagcagtggcagttcatggacagatgtcttcccagagcctatggtcaaaaggtgtttagcattctgtgactcacagctctgtcccagcagccctggtgccaagaccaccccctccagcaaagcacccaggaacactagcctggctccatggacaaaacacagggggccaggcgtggtggctcacgcctgtaatcccagcactttgggaggccgaggtgggcggatcacgaagtcaggagatcgagatcatcctggctaacacagtgaatccctgtctctactaaaaatacaaaaatattagccagacgaggtggcaggcacctgtagttccagctactcgggaggctgaggcaggagaatggtgtgaacctgggaggtggaggttgcagtgagccaagatcgcgccactacactccagcctgggggacagagtgagactccatctcaaaaaaaaacacacacaggcaacccatccaacgaggaacatagacacactactctctaaggaccaacacaagccctccagggcagaaggggagaagagcaaggccccaacatttggctaggccactgagggcagggggattaaaaacctctaagattggcagggtgcggtgactcacacctgtaatcccagcactttgggaggccaaggcaggcagatcacctgaggtcaggagttcaggagaccagctttgccaacatggtgaaaccccatctctactaaatatacaaaaattagccgggtgtggtggcagatgcctgtagccccagctacttgggaggctgaggcaggagaatcacttgaacccggaagccggaggttgcagcgacctgagattgcgccactgcactccagcctgggcagcagagcaagactccgccttaaaaaaaaaacaaaaacaaaaacaaaaaccaaaaaacaaaaaaacccaaggtcctgttattcagtaatagaaaggaatgaagcactgatgtatgctacaacatggataagccttgaacatattatgctaagtgaaaaaagccaagtaacaaacaactgcatattctattattccatttacatgaaacatccagaacagacaaatcaatcaagccagaaagtagattagtggttgccagaggctggaaagggatgaggaaattgggggatcatagctaaagagtgctggatttctctttaaggtgatgaaaatgttctaaaatggactgtagtgatgtgatggacgcacaaatctgtgaatatactaaaagccactgaactgtacacttcaaagaggtgaatagtatggtacatgaattacatctcattaaagttgttaaaagaaacacacccaagggctcagcaccagccaaggacgctgaacactgcttgaaatgtcctagcacaatccccaaaggccaaggggtcccacttaaaactttcatgaagggtgaggggagtgggagcagggaggagactataacttgcttcagagcaatgagtccaacctccctcctcaacactacccatttcatggagggagaaaccaagaaccagaaaagagaactgcctgaagaccacagaaaagcttactgcagaaacaggactcaaatccacgttgcctgggcagagaccccttcctgcttccccaccagctagctacccaattccagttggggtaagaagagcccaagaaatcagcaggttcctagatgccaaatgaagggcctttgctatcaaagataggttactaggagtggacaaaggctcctaggaagaaccaagatgaccctggggcaaactgcccattctgggcaagaggaagaaccggccaaggtccaaggtgagcaaggtcagacacacctgggcatggacaaacttttgcaaaatgggcagctgagggggcaagtagtttgcctaaagctataaagcaggtaaggaggagatgctgaggtctggaggtgatgagagaattgagggatgatggctcaaagcttgccttgctccaaagcccaaactccacacacaactctacctctctacaccactatccaacaggcctcctgacaggaaatcccatcgagcttgttcattacaacatggctgcccacaaaaaatggctgttcatcaaccctgagcctcacacaaaacaggctgcttgtcctgcccaccaagcttggatggctgagagggaacagaggagccaggaagagaggggagaaacccagttcctcctcaaaagacatccaccattctttgccacctccaggtccagagaactttggactgagttccctaaaatcccaaagctaaacaacacctcaccagcattttgcctggccagtgaggaaactgaggcccagagagcataggtagaacctaccctggttcatccagcaaagccttgaaagacccagagttggaacccaggcaccaactaccgtgccacacccagctttttccaccacctcagttcacatgccccttctcaaagagctctgtggggtctccaaactcaggatgcttacaggccaaccttttcatagagcagactctcagcaaggcagccatgcctgggaacccctgacatcaccacccacccagcacctggaccccagagtgccaaaaagactcctaaaggaagtagggatacaagagaatcaggacaaagaggaagcccaagtagtcagaaccccagaatcgccatctagactccccctcaacgacgcctctcttcccaagggatccaactgacctccaggctacaaccacccccagtgacagtttaggaccaagactggggtggcaggaggaatcttccctcttctcatccccaaaagctctcaagttggaccaggtgaggcagggagaagaggatcaccttctttgtcctaagaagtgtggggacagaaagcctctcctgtcattgggaagggcaggtttcatgaacccacaaaacttgattttcatattcttttttttttattagtaaagatgaggtctcgctatgttgccaagcaggtcttgaactccagggctcaagtgatcctcccgcctcagcctcccgagtagctgggactacaggcatgcgccactatgcccggcttactcctatgttcttatggggacaagtataagggagggactgcaaggggcataaggaagtgtttttgagttaccatggcagcataggatgttctttctctctgtccctgggaccagggatgtatcgcaagggaggggagtaaggaggtgtttttgaattatcatggctgcataggatgtttttcctctgtccctaggaccagtgatgtatggctccctgcttctagaggaggaaagaaactacccaaccagagagagaagaaataactggtcctgacccttgagtacaaatggcttatcgtgccagaattaatgatgggaggaagggaccaagaacaaggagctcaagacaaggcttggggcccctgtgaagtacagaaagatttacctgagccaaggggaaaaggaatgtgggaggagaatttccccagagtggcgatgtcccaaacccctttcctgtccctgggaagaaaaaagcttgtcaaaagcagttcaaaacttattatatgacctagaggtgagaagcaagcatagctaggtcagggagagactcggaatcgctcttggtttcagaagggaggctccagactccatgtccccaggacctgacaatcttctcatagaaagtaggaggaccttcttggccctggccacgagggagctctggataaggggttcatatgaccctgaagagcatccaggtccttctgtccaatgggagaggatgacctcacgttcctctccctggacagaaaggattgcctggtgtggtaggaggagagcctcatgcccaagtgggagccaggcccccagtccctaaggcaaacggtatcttgtcccagagagaaagcttgggcccagactcttttcctcagaatcctaccctattcatgtccccaaaaggagttgggagtctaaggcccaagtccccgaggcaggaagtcttatgtccctaaatgacccctaagactagggtgtatgtaagttgtctgaggtgaggtgacagtaccctcagggcaggttcagaaatcaggtcctaaggtggggaacaggccttcacacacctgagttatgattcaaacccttggaggtagactcaggaccctgttccacagggatcctttatccatgccccaagggaagagtctcagggctcaggtctggggggaggagtcctcctgtttctcaggtgtacatcttaagttccttgaggaggaagctcagaccttacctctagacacacaagtcaccaaggtatgtatgagtctcctgtccctgaaggaaagctcaagtgtccttggcagagtgggtctcaggcccttaaaagtaggcaaagatctgtagggaggccccagacatcatctctgggatcccatgttgcccatgtcccctgagtagtcgtctcaggctcaagttcccaaggcatgggtcgtatgtccctgacaaaaagcttaggcccaaggtgggagggcctcaaacccctgttacagaggggaaaatgggatactgtatccccaaggtatgtttcagtcccttataattggggtaaaagggtcacatatgctcgtggggtggggagtctcagatccccaaaaccactcagacaccagccttgagaagaaggatctcctaaagacttcaccttgtctgagacctttgcagcaggacaccaggcccctgaagaggcctcagactcggtctctaaaaacctcagtccataagcaggtggatcttaggccctaggatccaacgctgtgagtctcattttcctgaagaaaggttcaggcccctggtgggggtgctgagggcccatctcttcttacaagaagcttaagatcctgaagcggttcaggcccttgtctcccaagaggtaggtctcaggccactgataggaaatgcagacctttgtcactcagaaaggagataagtaaagctgctggtcattgggtgttggttttggtccctgtccccaagggcaagggaatcatatctccctgtgaaaagtcttacatccctggaaaaagcttagaagatccctatccttaaagggggcgtgtgtgtgtgtgtgtgtgtgtcaggaccttgattctagaagcaggactctcaggcccctgaagacagacttaggacccttgaggtctcaggtctggctattcagtggtcctgtgcagtgttacccagcgaagcgggagaggattgtcctatatgcagagtgtctcagactcttgaaagggcttaggctccttggggatgttcagccccgatctccgaggtctccaccttatttgactttcctggaaggggaatctcaaacttctatcccagaggaaaagagctcttaagccactgaacacatacctaagtctcttgggagacctgagactcctactcaagaggggcgcgatcctacctgtatctcttggagaattcccacctattggccctatatgatgaggtcccagggactggaatgacgactatagaccttaaaagagacctcggatctttaagtctgacaccttaccgtaggcctctagccccaaaatcctggaggggaggaaagaaggtgtctcacatccctaccgccagagaagactgtcaggcccagtgaaaacgcctagatcccttggggcgatctcaaacagccttccttgagtcccttcacagtctgggggtcccatctgccgtggccgctcacccctcaccccacagctcttacctgctcgacagtggcagggtccatagcctcgatgcgtgctgcagccgcctcatactcgtcctcactgttgtagcctgcgccgacctcctcacgctcgggactgcccccgccaaccgcgccaaccccgggagcttgacgtcgccgcttgctgtgcccaggcccggagcagcagccgcccacgcctacggcaccacccacacccaccaccacgcccgcggcacccacacccgccgccgctgcgcccagcgcgtcgccgggaccgccgccgggaccacctgggcccccgcaaggaggtggagaagcctgttgtggccggggacccgccactgcaccaggcggcacggccagcgcccagcgatgaagagcgcccggcggtcctggtagcgggccttgaggcggtggcgaagctcgcggacgggcccccacgacgccggagtcacggtcgcgatcgccgccgcccacgcccgtgccgccgccgcccacgcccacacctccgccgcgccgcggcgccgggggcatcggcccgggcggcggcggctcgttggcggggtcggcgtcgggaggcggcggcttctttttggggagtatagtcatggctgcactgccgagtaccccccaacaaacccggcgcggggcacgccgggagagaacccggatgagggggctagtgtagtgcgcgaggcacgacgggaacggcgagacccggataaagggatcgcggcaccggttcgagaaccctcggcggcggaggcggcggcggcggcggcggcggcggtggcggcgcgcgggtcacgccgagaggagaacccggatgtaaagtccaagatgaaggcagtgcggcgagtttgtcttagccttctctccaagtccagcaagtttattgctacgcttgttccggccttctgcttcaaaggaaacagaaccaaaacaagcacctcttcgctccgccccctcgcaggttcttgcactaccgggtggggccccggggcgctgcgcacgcgcgccagggcacagccccgccccttactcggaagtacgtgggcaaaatcgccgccgccgccgccacaacaattgcaacaccaaccaattgagcagctgcgtgggacctcgacgacgcccacgggccaatcacaggcgagtgctcgccctccggtgccctccgtctcaaatttcagtcaaagtcgacaccctggttcccagcctttctccccgtcagttccgtcttgctcttcacttttctccccgaagctctgacctgcaggcgtcggtactgcggacggacagcgtggcctgtcccacgtacgacaggaaaaacacctcccctccaggattccaacttgaacgctgtcagccggaatgactggaaaacatcaacactcccgggagcatagctggcccctgtagcgtcacttccggtcccacccacctacaaatacccttccgggggaggcggacaccgcttcgccccggcaacagcctgagttctgcggtgattggttaagagacgccgtcactcgcggcataccgaccaaccttgggacagacaggcgccgtggggacagtggttgtttgggaaacagacacgccttctctggcaccacagcactctcggcctcgcgttgacctccccgcccctatggctagtgcgcaggcgcggcccagccttttttttttttttttttttttttttcctaattgagacaggggtctcactctgtcgcccaggttggaatgcagtggcgcgatcatagctcactgcaaactccaactcccaggttcaagcgatcctcccgcctcagcctcccgaatagctgggaccacaggcgcgcaccactacgaccggctaatttttttttcacttttttgtagggacaaagtctcactatgttgcccaggctgatctccagctcccgggctcaagcgatcctcccgcctcggcttcccagagtgctgggattacaggcgttagtcaccgcgcctggccaagcccagcctttttctaaaactgagtttgcttgggtcgatcgaggtttatgaaagctctgtcaccagtcagcgtctcaaaatggggttggcagaatccctgctattgagtagctggagagctacacgctaatcctagctctgcccttcctgtctgagtgatctttgtcagtcatttaaaacccaccccgtcctcaatttttgttgttgttgtttacttttttatagaacgcttcacgtatttgcgtgtcatcctttcgcatagtgccatgctaatctctgtatcgttctaattttagtatatgtggtgcgaagtgagcacccatccttaatttctattctataaattggcaataattctaatccgaggatcagagattaatgcttgtgaagggcctggtgctgtgcccagcacataggaagtgttcaataaagtagtctgcatggtggtgcagtggaaggatcccaggctttggagccagaaagacctcagttccaggcacagatggaccattaccaactgtatgaccttgagcaagtcattgtgtcacttttgagattacccatgtgtaaaacaggaatgataatacctgcccagactacctcagggaatggttatggggttcagatgagctgatgaaccaagaaggtatttggagttcacttccagtcttaggagacaaaccatacaacaggttgactgaaagagaccatgggaaagctgttttgagtatagccttgcctcccttgagatactaaccctagttgaaattcttccctgaaaggtgtaagtaataaatgggctctaagtagtgttttctgctcatgagacttaataggaggggactttcacgtttaccgggcctgttgtgttcagggctctgtgccaaatgcctatgcacattatcacattgaatcttctcatgatcatctcactccagccccatatatttcactcactacacatctaaaactgaactcatgatagcaatcatggctacccttcaccaagtacttactatgtacctagcactgagtgctgacagctctgatgttccctttaccagggaatagcactcccatccagccgtcgtccaagccagaaactgggagtcaactttgactgctccctcttcctcaactcccacatgcctgtcaatcccaagtcctgccaattctgcctcccaaatctctagactctccaattctactgccactactctggtccaagccactgtcccctaccacctggactattataaaagcctccaccctacttttcttccttccaggactgtttctctatatccactctccacagccagaatgatcattctgaaacacaaacttcatcatgagttttctgtttaagtctttagaggtccccactatctttaggatgaagtttaaaattcgcgtcatagcttcaaagctttttattatctagcctacctctccatccttcctctcctcacagcctcacactctcctccccagctggactgaactactttcagttccccaaaggcctgagctcactctccaacctccaggtcattgcacatgctgttccctctgcccagaacattgcatcctttcatttgctgcctggctaactccaactcattccctgtgtgttggccaggttaagttctcctgccatctgcatgcctctataacacatggatcttagttctgccacaccatgttgtaattacttgtctgccttccatgctcaactatacatcagagacaatgtctactttgcccacctttgtatccctagggctggcacatgatggaagttaataaatatttggtgactaaatgaattatccctatttcacagactagcaacctgaggcaagagaaggtaagtgattctctcacccagggattggaacccagatcaacctgaatccatggtctgtctgctcagtgctctatagaactcagccacacactagcctagtgtagccagtagcccagaagagagaatgtagggggcgtccacaaggaagggaaattcaccaaacaaagtgatgcttttattagggttaaattcagggttgtttgctgtcaggaagcctgggtttaagcctcctctaactaactatgtgtttctctgggtctcagtttcccgatctgtgaatcaggaagctggcgcagatgatatccaaggaggaatgtctcaggaccccctggcctgtctcattggctgtagatgaactcctcaaaccacactctttcatttctcctggatccccatcttccagaatacatcaccaaccatccatctcccataccttgacccataccagcccttctcctagccaaaagggattgaaatcagagtgttttcaacccccaagcccaacccagcccccaaacccacagagccaggagatactctcagtcctcatctctcctctcaggttttattgactgatggaaactacatctttgtcagccaccagctccatggggacagtgctggggacagggaacctgagatgatgccagatttcagcctgagagcagagttttggaaggtcacccaagagggagaagaaaggaatatgtgaaaaggaattgtaggggaggaggaggaggagaagttcctcctgtctcctataactcccaaagttcagaaacatcccaggccggagcccctgatgcttctggactgttgcccaagaacatggaatcagcccatgatctccaaatacagcccagctcttgctggttgccaggctcttatctcagccagtccagactccagcccaacccaggaaggacgcaaaccagaggagaagagaggaggaggaggagttagaggtggcccctctgattagggcagatgtaaatgctgcagcaaactggtcagaggctttgcataatgacacggcagcagctgctattgctagagtttgctgggggcccagcagaggacagggttgcggggtccatttccagcagccagggaaggggatggtagaatttgtgctatctgagtgtgtgttgggagaggcagcctgacccctcaggcaaggcctggggatggcaggtcgctgcagaggccacagcccatgaagcctgtgtttgcattccaagcttcagaatctgggaattgttgggccagatggagatgaggacctctcgtagaggccagatcagaggtgagggttctcttctctgaacctccaaagctccatatcccagccagagggaggaggaaatctcaactctccttcttaggctagagctcagatgtcggatcaaagctttgccttcatctgagagcccaaggggaggagcatgcaggagtccagctgggagagtggggccagtcccagtgtgctagggcaaggaggccaggggcctgtggaagcccagtgcttcagctcccaccaggaaaaatgtctggggtgggaggaagtttctcatttcctggctacttccccactatgtggaccatttcatgaaactccattgcatagttctcagtggggggggcagaaggggtgcccaagcctgcccctctctgcctcccaaaaatatggctttggaaaggagttcccaaaaatgaagaggaccctctgaatcagcaggcctacccctcacagggatgagatcttgacagtctcggggaagaggcaaggggtacccaggctggagttcctgagggtgctgccggccctgccaccgccgccaggggaggaaggttggctctcatctggggtgttggcaggaggggtagggatgctgataatggcagccacgaagtcccggctgtcgcagttcaggtcaaggctgtcatggggcttggcattgaggctggagcggctgtggacaagggtggagaagatggaaggctcttaaaaagttatcttaggccgggtgcggtggctcatgcctgtaatcccagcactttgggaggccgaggtgagtggatcatctgaggtcaggagttcgagaccagcctgaccaacatgatgaaaccccgtctctactaaatacaaaaaattagctgggcatggtggcgcatgcctgtaatcccagctactcgggaggttgaggcgggagaattgcttgaacccggcaggcagaggttgcagtgagctgagattgcaccactgcactccagcctgggtgacggaatgagactctgtctcaacaaaaaaaaaaaaagaaaaaaagttatcagccgggtgctgtggctcatgcctgtaatcccagcactttgggaggccgaggcgggcggatcacgagatcaggagattgagaccatcctggctaacgcggtaaagccccatctctactaaaaatacaaaaaattagccaggcgtggtggcaggcacctgtagtcccagctactcaggaagctgaggcaggagaatggcgtgaacccaggaggcggagcttgcagtgagctgagattgcaccactgcactccagcctgggtgacagagtgagactctgtctcaaaaaaaaaaaaaaaattaatacttgccacagcaatcatggcatttattgagcacctactgggtccctggcactgtgctaagtacttaagtacttctcctgcatccccaattatggtggtaaagagtgaggactctagagtcagatagtcctgggttcaaatcctggtcccactttaaccactccaaacctctctcttctctcatctgtagcatgggacgaacactatctcccacctcatagggttgctgtggagattaaatgagattaaaaatgatacgaagtgctcagagcagtgtctggaacacaatgtgcatacatatgaaaatgctatctctcatggttactcctaacagtgtccaagtccttacaaactgtccatagtaggatctaaggtgggaccctcgctcctttctgagtttgcctcttaccagtctcccccagctcactctcctccacccatgatagcttccttgctatgtctctaatgtggacccacatctgcctcaaggcctttgcacaggctgttcactctgcttagaaagctcttcctctagttatctgcatggcccactcctttgcctccttcaggtcttggctcagttgtcacctcagtaaagccttctctgaccacactactaaaactgcatcaccagccaagagtggtggctcacacctgtaatcccagcactctgggaggccgaggcaggtggaccacctgaaggtcaggagtttgaggccagcctggccaacatggtaaaaccccatctctactaaaaatataaaaaattggctgggtgtggtggctcatgcctgtaatcccagcactttgggaggtcaaagtgggcagatcacaaggtcaagagattgagaccagcctggccaacatggcgaaaccctgtctctactaaaaatacaaaaattagctgggcgtggtggcgcgcacctgtagtctcagctacttgggaggctaaggcagagaattgcttgaacccgggaggcggaggttccagtgagccaagatcgcgccaccgcactccagtctgggcgacagagcaggactctgtctcaaaaataaataaataaataaaaataaacataaaaaaataaaaatataaaaaactagctgggtatggtggcggacacctgtaatcccagccacttaggaggctgaggcaggagaatcgtctgaacccgggaggcagaggttgcagcagtgagccgagatcacgccactgcactctagcctgggcaacaagagcaaaacttcgtctcagaaaaaaaaaaaaaaaatgcagccaggcgcggtggctcacgcctgtaatcccagcactttaggaggccaaggcaggtggatcatgaggtcaggagatcgataccatcctggccaacatggtgaaaccccgtctctactaaaaatacaaaaattagccgggtatggtggcacgtgcctgtagtcccagctacttgggaggctgaggcaggagaatcgcttgaacccaggaggtggaggctgcagcgagctgagatcccgccattgcactccagcctgggtgacagtgagactccgtctcaaaaaaaaaaaaaaaagaatggatgaagaatgagttccagacaagataagcccaagcttccagcatggaggggtttgggttcgagcttgacttgctaggcctggagttatgaaatctcagagctactggtctaagctctgagcttccccaggtgtggctagcaggtaggagggctgcttacctctgaggggcatggctcctgcgcagccctgccagcatgtccagctcctgcatgctgccacggctgactgaggcagtggagttggcaaggcggatggcgcggcgcttggccctgcgagggcagcaagaagacagcaggcttccgggtcccactggctgggaagacacagaggtgctacggctggtgcggccacccggcgagacggctcccagggcttcactgaaggtgagctcatctgtgaactcatggcactatgggcagaagggaggcagggtcacggggcatcccatgggagctgatcccaccctcaagcctttgctcaggctgttttctcctttctggacattgttccctcttcccttcccttgcccattcttcaaggcttggctctcctgtagcctcttccaggaagctctgtgtgatttccacaatttgtagtgagcctcccatccaagggagagagctggcatggccgcagagggaccccctctattctgctatatcacctcacattaggcctcaccgttgtcttctctagacagtgcagcaagtggtgatgttgctgttcaaaggcagaacggttcctgacacaaagagcctgttcctcgccactgccgctgtcctggagtagatggagcagagcgataagggcagcaccttcctccccgttatggctcaccccaaccctatccaggccccgacccacctcaaggcccccattctgcttgtactgcaggaaggcattggtggtaccactctttgccaatcggatccttgccaagcgcaccttctgcagagagaggagataaaaggtcaggtgggtaagccccaaagtagactggcttggggtgtggggagtaggaggtgctcggatggaaagtgcggttacctgctgtgctcggcgcttgtcagcccgctggttctggtggtagatgcggctaaagttggacacaatgactggcacaggcagggcaatgaccaagacgccactgagtgagcagatggacccgaaaatcttgccagcaatggtgctgggcaccatgtctccgtagctggagcgaggggaggtaggccaaggtcaggaaaagtgcccacctacctttcagtcccccactccatcccatctaatccggactagctctgtgaccctggccaggcactcaaaccttctgagtccctcagtttcttgctctgtaaaatgctgggtggccaagtgagaaatgggcctggccctcaacccctaccatctgctgcccctgtccaagctacataccaagcacctgagtcagctagaaatctatgaaaaccaagcagaggggagcatgaggaagtcacaggcagtgaacacagcctcctggggagagagtcccagcaccacaggccagccgaagggcttcaagtcccgggaggagtgttttgttggttttggctgcctctgtcttacctgctctaggtaggaccccttttcattcccctataggggaatccttgaaaactgtccacatatgacaaaatagggaggagccttgaaaccctcctgcctttctccatgccacccacctcccacagagacagagcagagccaaccttactaacttgttcacagagagctcccctgaagatcagggagattctgtaactgactcgcccaagatcacactgcatactcttgttctgaccgcagaaccaatcagaactcctccagagaaacacagcctctgcagtcttcagcctctaagccttttctcaggctgtgccctaggatggctgttccttatttcggtattttcactcattttaagcattcaggactctgctcaaaagtctttccaacttggccattgctggctctgtgatgtgtcatctcagagcgtgtcctcaactgtgagacatgggcagccatccaccatcacagagttgttgtgaggacttgaatagagtaaaagccatcaaaatactcagttccagcccactgtcagcgctcagtatttgtttgtcagtctgatcctggacctccaaccagaattggggtttctacgctttagaaaccccaaatcaacttttttttgtacctctatgaagaaactgagcaaacccaattcattcagtcattccttcaacagatactgagcaccaactgtatacccaatcccagtgatggaaacttagagaaggatcacagcatctgccctagacagtatctttggaaagctcatgagttcgatgattccatttgatacttttatcccaactctgtttcttctgcagggatcgacaaaaaaataataataataaaaatgctgaaaacatcttgttctgggaaacatcaaggaatcacaaaggctcagaagtagtgccccacacagcagacaattctagaaggttgggagacatgggtccccaaaacagaaaaaggtgctagaaagccaacacctatgtatcctgcaccagaaacattcagagaactttcacaactatgatgtcattgaatcctctctagatgatgaagggatcagcatttcccattttacagaggggaaaactgaggccatgagaaaacgacatcaacagaaagagagcagctaagacaatccttgaacccaagtctcctgacctagaaaatcaaggcattgtcagagctgggagggatctgaagaattaagtccagctccctcagtttgtacagatgagcaaactgaagctcaaaaagagaaagaggccaggcgcggtggctcacacctgtaatcccggcactttgggcggccaaggcgggcggatcacctgaggtcaggagtttgagaccagcctggccaacgcggtgaaaccccgtctctactaaaaatacaaaaattagctgggcatggtggcgtgtacctgtaatcccagctacttgggagtctgaggctggagaatcacttgaacccaggaagcagaggttgtagtgagctgagatcttgccactgtactccagcctgggcgacagagtaagactccatttaaaaagaaagaaagaaagagatcattcctttaaacttcctaattttacagaaagggtgagtgtaatcgggcagcccccaacgcagagtccacactcacccaagcgtggtcatggtgacaatggtataccagaaggccgcagggatgcttgtaaagttggtcttgtttgtgcccttctcagcataaaacatgacagtggcaaagatgatgatggccatggttagggaaaagaggagaaagcccagctcagaggcacagctcttgagtgtgtagcccagaatcctcaagccctgtgagtgcctggagaacttgaagatgcgaaacacccggaacacacgcagggtgacaaaggcgccagagacatcgtcgttcttgggcaccaaaagcccaatgtagtagggcaggatggccaccacgtcgatgaggctcatgacactccgcaggaagcggcaacggctgggggcggcaaacagccgcaggaggtattcacctgtgaatatgagtacacaggctgtgtccatgcagaaaaaggcctgtgggaagcgttcgccacagggctgctcccttgaggacctgcgtgcagagccgcggcatgggatggtctccaccacattggcgatgaccgacacggcgatgaagaagccggtcacatagtagaaaacgagggctgcggtgctcgtgtgtggattctcgaaggcccgccagagccgctgccgcagggagctgcctgctggcagggctgggccgtccccggcctgctctgcctcctcatcctctgccaggcgctcggcattctccttctttcggtcccgatactcttcaaggcagcagtcaccgactagctcgggaaccaggccgtagaaagccagctcttcgtcgaaggcctggatgcactcctgccgtgggcaatgcagccgccccgttcggtagaagttcagcacatggcggaacatgtcagggtcgcgatcgaagaagtactcgcctgagtcagcatcgtagaagaattccttctccgagctgcccagcaaggtgtctgggtagcggtccagcgtattcttccaagtctcaaagcgccgtccgctcacgttcaccaccagaacctcatctcctcgagatgccttcacccccggtgccgggggcaggggttgctgggccaggggcagccagcccactgctgctgcccgagcaaaaggcagccacgtggccaggcctgccgccatcgtgccactccccaagcccagggagacttagtgagggtggcgtttaggagaatgtggctgtctccaggatggtgggggcttggagacaccttgagccacccaaacaaggaaactgggggtgtctagagaggccaagaggaaccaggaggaagaactaaagagatgggaaggagtctgggggacatttacagaacctaggaggggcctgggcaatgttctgagggactgagaagggccttggggacatggagaagagcagaaaaggggtgtggggatggggccaagaaggagctgagggagggtttagagagactgagatgattctaaaggagtcagcctgtgcctgagaggtgtctgggggcgtctagaggggccaagaaacacgtggggaattctctgcactctcaagagtctcagggaaggcagaagagcctggaattcctttgcagtggtggagaggagactggggcatccagaggggtagaaatgggaccagaggtgcttgaaagagactgagagtgcctggaagtgggggttctagaggggctgagacaggtgaggagggttgtccacaccctcaagacttctaggggaagcataagagggttagacccccctcatggatctggaaagggagctggtgcatcttgaggggtggctgtggatccaggaggttgtaaagaggctgaaaggtgtcttgggactgcctagagttgccaagaatagcccgggggggtgtctatactctacaggagttctggggaagaaaggagaggccagagcctcctagtagggctggagaggggaaggggttatctaaaggggtagacagggggctgggttattttttgagaggctgagagttatctgggggaggtgggtatctagacgggccaacaaagcctggtcgacactctcaggagttctacagggaggaaaaaggggcctggggaattccaagggccgggactcaaatgttaggaagttgggcacaatcccagagcacccaggggatctatgaagactaaataagaggaagggggttaaccccaaaatgggattaagaggggggtggggtgttgaaagggagttgggtgtgtctccagggaggggggctcctgggctttgcaggaagctggcaggagacgccgggagaaggctgggtcccaccgttgggggcaggtctggggaaaccacaccccgaggggctggcggtgtgtactgggcagtggcagtagcagcagcggcagcaggaggaagagaagcaaccacagccaggcataggagagaaggtggcataggcagggggagggtgcggggtccctggaaggaggcctgggaagggcaaggtccagtgggacccctggggactatcccaggatgggttagggcgtgggggctggaccagggaaggatgaggacagcgctagtggtggtccccctccccctctctctcggggcgtcctcacctgtgtccccgctgcaggagcagcaacagcggtggggctgggggtaccaaacacccgagctcctggccccctctgcagagctgcctgagttctcctcctcctctggctctctctccccgcccctctgagcttgccgggagatggagaggcagggaggggcctcgtggctccctgagccccctcccctaggacagccagagagggaccctggggagactccgcctcctacaaagctggttgggcctcagtcgcgtcatctggaaaatgggggtggcagggaacttcgccaattctctccacctccttcctggactcccctctcttcctgcccagctcctacccgctctgcccccaggggcccccacccccactcgcctgaatcagcagcacttagcagatccgatcgatgggaaggcgtcagttaatggccccagagcggagtgccacagggaatgatgcagcgctgtcccctccctgccccccagactgtggaaaggcaggagagccaggagtcgggggtaattgctggggagtgtttctctagatggccaagcttccgaagccgcccccttgaggggcgcagcatgggttacagccccagctctaagacttcggctgtgggattggagcacgggacttcctgtttttagatatgaaatgagggtaaagggaatgtagagggggacaatccaggtcccacccccctaccatctcaggcaggccccactccgagggggtagtctctcttatctgtccatatccagtggcctcaaatcacacctcctccgctagagggctctgcttctggatggcaggagcactgattatggaatgcctctggctggctatgggtgggttcaaaccccagctttgccactgacttgctgcatccttgagcaagtgacttgcattgtttcctcagttgtcagatggagagacttatcccaacttgatagcgtcatttggagcattacatgatgtgaaaggtgatagcactggacacagctcacaccagggatgcttaatcttaattaaaggagtgtgatgacaggggcactgtaatgcagggccaggcctagcctttcacccaagatttacccacccgtgtaaacttccaattgcccatttggcacactcctgatttgtccatttctacatccattcctccacctacccatccacccattctcccacccacacaatcaattcctctatccatccctccacccacccgtccacttagtcgttaatctacccacccactcattcatccatttgtaagttcaccccatttggctgtttgccaatctatctatctgtatgtatccatcctctgcccatctcttcccacccggaacacatgcagggtgacatcctctgcccatctctgtccatacatagctccacttgtcatttcttctcccactctttacccttcccattcattagctcatctacccatccatccattcccccaaccattggtccatttactcctaacctgtccataaacccatccatccacctgtctacctaaatcatccacccatttgtccatagacctattatccatctgtccatttacatctctactatccatcctctatccacctaccaatctatctacccatttattcatctaaccacctatccatccatccatttatttcccaatctatccatcatcagtccatgcaaccgttcacttatacatccatcggtccatccaaccacttatccatcctcccatctgtctactcatctatacccacaatcccatacatgtctacccatgtacatatctgcaggtatttcagctccactcagtttgaggggctggtcagcagtaaatggagacaggctggatgagggtggggaaaagagagtaacgttgcagccagagacctctctccctattccaatggtgtaaacctccccgcccccagcatattcctcctggttgaaaagaacgagacgagacagtcagtgggtgggcccgtctggccagatggtattttggctgcatagcctttacacacacacacacacacgtgttgctagaacgctgaacatggaccacacacccacccagcatccccaatcccaaatgcagagtagccaggctccagacataaattaaaaaataaaataaaataaaataaaaaagagttggtctctgggaaggagagctcatgcagagatgaagacagaagcccttgggagccaggaccaagaagaaggagaaatccctgccccttccctcaggatccccactccctggtggcctctgccctaagacaggatcattaacactaaccatcaggcctctagcccctttaatgtccagtctcccaagctatttgattttggctccagccctcatttttccaccacagcccaagggaatagcatcctagggggtaggaaggggaggaggtgggtgcagcctgcaggtctttagctggtttctcctggctctaggtctgggtcaggaggccccacgcactccttgctgagccgcacaatttcctgggacagaacttccatatcctaagaaacaaatgaaccatcaggggccagagaaggggacaggctgctcccttgccaaacgtagggtatcatctgtgatttccctcacaccctttcattaatcaatgctcagctgtgtctggcctgggatgagaaggtacttggagaagctcacagcacccccaacagtgggcagggctcagaaaagtcatgaggatgggtggggagctacagataatgggagtgggatgcctcctgtggcatggtgctgctgcaggatacaccaccactctggccacctgctcttctaagtgtgagcttgcttctcaaaggcaggagctgggtctgacccctttctaactctcagagatggggaaagtccttgggtggcagtttgggcagaaagatgtgtgtgtggacccatgggcatgggggatctatggtagacaaattggtggacgaatgaattgtccagaggacagatggagatcaacaggtgggcaggcaggtaactgggtgg

SEQ ID NO: 535 - DNA, 27287 bp, Homo sapiens
acctgaaagagcataaggaacattttttatagatgcatattaccaaaccttcaaagaccaagcactctccatgttatataaggtcttacacgtagaaatatgaaaaacaggcagggcatggtggctcacatctctaatcccaacactttggatggcgaaggcaggtggatcacttgaggtcaggagtttgagaccagcttggctaacatggtaaaaccctgtctcttgtaaaatacaaaagttagccgggcgtggtggcgcatgcctataatcccattacttgagaggctgaggcagaaccgctagaacctgggaggcagaggttgcagtgagtcaagatcacaccactgcactccagcccgggcaacagagcaagactctgtctcaagaaaaaagaaatatggaaaacatcccaatttatttatgagaattgaataaccagaaaacaaaatcaagcaaggatagcaccaaaaaggaaactaactgcaggctgatcatgatgatggtaggatttcaaaatacaatattagtaaccaaatcttgttgaccaagtgaaatacttatattcagagtgcaagtatctctaacaggatgaaatttgttttggtatatcctaactaagacacaataaagaagaaaaatcaagtgatcatctcattcattgtttaggaaaaaaaattgataaaattgaatacctgattttagagaatagtggaccacaatagaaatagattatcataggaaaaaatgacttatgtaaacaaattttaaaaccataaaatttaaaacctctttgtgactaaagatactacaaagaacataaaaaaaggattggcagatgaaaaaaatatatttgcaaggagggaaaatataagacagcacctcgaaatgcataagaaatatgccaatagataactaaaaaaaatttaaaggcaaataattaaaattttgaataagcttatagaaaaaaaagtttaactttactaagagtcagggaattgcagcctaaattgggacaccattctcacctatcatgttgataaatattaaaaagtaaaaagattaatcatgttccgttttaaaagaatgctggtgaaaggcattcttattcaagatgatgtctaggtgaaaggcaaagttatagcagcacaatttgtaattgcaaaaatgtggaaccaaaccaaatgcccattaatcaacgagtgggtaaagaaactgtggtatatatatacaatggaatactactaagccataaaaatgaatgaattaatggcatttgcagcaacctggatgagattggagactattattccaagtgaagtaactcccgaatggaaaaccagacatcgtatgttctcactcataagtgggagctaagatatgaggatgcagaggcataaaaatgacacaatggactttggggactcaaggggaaagggtgggaaggggctaaggcataaaagactacaaatcaggtgcagtgtatgctgcctgggtgatgggtacaccaacacctcacaaatcaccgctaaagaacttactcatgtaaccaaacaccacctgttccccaataacctatggaaataataattaaaaaaaaaaaaacctagatgatggattgttagttgcagcaaaccaccgtgacacatgtttacctatgtaacaaacatgcacatccttcacatgtaccctggaacttaaaataatttttaaaaaaacaaaaacaaagggtgaagttacttggtctcgtggcatataaaataatagtctgtattctccaagtctttcatttattctttcaataaatagcactttctctttgccaaactgaattaaaggtcctggggaccctgcaagccataaagaggcaaaattagagtttctgtcctcatagagtttgccttctaaggagaatccttgctggtttcactcgattgcagttggtctggtctccccgttgttctttgtcctctgttactctgtcatgcttgcctggattttgttgttgttgtcaatttgctttggtttgttttctagctggtatcaagctgctcccactgccaaagttggtaagccctttcttttgttttacttctgaggtcccttctttctccagcctcttggtcctgacctcaggttggagcttttagtgcatctgtaattgttctcacgggcacagcaacgcaaacacagtaacacaagccatttacagactgtcttagtcctaggcatagaccctgcctctgcccttgcttccctgcctgccacttcccccaccacccccccacccccacgcccccacgcccccacgcccccaacaccactccaccagaagcttaggatcaggcaacagatttctctcagcatactgtctcacctctaacccctcttgggatgggggtcaggactaccaattcgcttttcagggattctggcaggcgttttcactctaatagggattctgcgaagtctctgtggttgaggtgctcctttccttttttgcttcttagaagttgccattgaggtgaaaacttctttgaaaaagttggtctaagaggtattggagaatgtagtgcctgagtaagcagaaagattcaacctgggtctcggggggtcttaagtcaggtctctttatccccttctacataggatttaattgctgcagcctacaataatatgctcattacttgtcacattttctaattgcattttgtaatttatctgtgcctgatgatcacacctgtgcattatggagatataccacacatgcttatgcataggtgtgaacggttacacatactttcttctttctcctgccattcttttgaagagtttctcttatttcacaaaatgcactaggagaagagcatctgggggaagtaaaatgagaggggtggtttcagatacaccttgttctgtacttgtctgtacttaatatggataattagatactctttactaggtactttgccacagggttttcatggattgcatttaattgttgccacattcttatgcagtggctaccctttttaatctctacaggtgagacagaagcaccaagtagtgaaatgacttgtgcaggactgagcttgtgaatgacgggcacagatatgaccaaagtggtatctgccaagcccatatgtttcaacttgagcgatactgtctcttgctgttctgctacttttatgttctgcttctgcactcaaagttataggctttcattttgttagacattataaagatgtaaaagaaatttaagccatagtccaaaaattgagaatgccatatgatatatccaaatgtcataatattacatgactactaaaaagattgtttatgaagagtttatagtaacttgagaaaccaatttttggataaaggtaaaaacctggatccacaattggatgaaagtttctgcaactgctgatggagtagggtttcacctgccatcatctgtagaacaagaaactcaaactaataggaatagtatattttgggtacaataatactattttttattgtcagaaaatttgcatggctttggattagtaccctagtagcacctgttagcttagagtcaattgcagagactgtgtcctgtgagaaacacatgctacaggcccaacaacaggaagaggataaagggatagtggcctcactggagtcatcaggacagccccgtggtaaatgatgtgatagaaaaattctccccatctacttgtgctgagcctttcctttcttggagttgtagtttctcttttgctgagacacctgttgtcctcaagttcttctccaggcctctctcaaaattccatttcaaatacctaaggctaagtgtaaatattcaaatgaaactgtcaaaatttactaagagatataaataaaaccttgcaatagtgagacatactttcttttctgaggtggaagtcttactagttttaaattttttgttcgtcccaaattaatatagatataatatacaatcttatcaaattcccaataggatcttctggaggaagagaagaaatatttaaagttcacataaaagatttagggtccttcagatgatttctaagaattaaaatataaattggaaaaattacaaagaagtaatacctaaagcttacaatggaaaaattaaaaataacacatttatatgtaaataaggttgtcccatgaacaatgtggatttgaattgcaggggcccattaatatgagaggggtttttttcccaataaatacaggggtctctctgtatctgatgtttccacatctgcaaccaagagtgcagagggaaagagcagtattcacagaatatgaaacacctgatattgatggctgacttcttgtatcgaagatttgctttgggctaatggtgggactcaagtatgtgcaaattgtggtattcacagcagccctggaatcaagctcctttgaataccaagaaacaaaaataatttcattaaaagtgccattcaaaataaattggggaaaatttatgtggtaattgtcaccaaaatttaataaacttccttaaaactgcattccaatcttaaaaatactaaaacttaaaaatgtgtaagcacattagtaagaaattctaagaaaaaaaaaccacaaatgcctaattataaaagaaatgcaagcctaagaaaaaaggagtttcttataaaattcacaaagtatataatgtgttacttcagagaaaatatgaattgaaatgggcttatgctttaaattttggtgagataatacaacttggaacaaactttctagaaaatgattagtaatgcatttcagcagcctttcaaaattcttttatttgacctagtaattctatttctaacaatctcttctaagaaaaacaaatcagaaatcttaacaaaaagtcatgcttatgcagcgtgggtttatttaactaaattgtggaaaaataggaagacacttcaatttattaaagtaaatctctataacaaaatgttaggaagtcattaaacagatgctttcaaagaataatgccatggaaaagccttcatgatatgttaaaaaaaataataagatacgatattgtatatttaatttgacctatgtatgacctatatatatatatacaaacacatatatatgtatataaacataacatatgtattaaagagtctgaaggaaaatacattaaatactaagagggatattttgagtactatgattagaagtgtttttagtttttatacatttctggttttgcatattttaagtcttcgagtatgcatttatattcagaaatagtttgctttaatatattttcctaagaaaagtaacagcaatatctaaacaaaacagcaatatcattgaaaatgtatagaaaaatatcatcctttcacttaattgttttaaaggcttcatctaaaggaataacttaattaaaattccagaccttagacggcaggtttagggaattagtttgtcatccaaagaggcttcttaaggctcccagaatcacactacatggcaattgacagtactgccgatataagttttaaggtcaggtcaggatacggttactgaagtctcacttacggacaatgtggggaaatgcagttcaccaatacataggcatttacccaagtttctcaaatgtagtggcagttttagaacacagcaatgataatgggctaggtggaggagactcaatttactcatttttttgagcctgcaaattttggaaaataatgacatggggaaagaaagggatgaacagaagatggaaaaagaaaagagagcaatcttagagcagcaagcaccttgaattgtagtcttgaaggcagcacagaagaattgagatagctgggggaattgtattgtgtatctgaagtacaccagctctgtttcataggccttgtgccatcacatcatctgggttacattacaaaaacactctactcctcacatagcataagtctctggtaattttggtgcaggaaggatgagtaatttttactatatttaattatcattgtggtaagtgttctctgaaagccttgatgtagctgaagcctctgcggtaatttaccaagaagtctttggagtccgcttagaatcttgccatcctgggcccttcgatgaccctgactttttgtgattttgcttaagatatcctatcaggtatctgcctgatgtcatgggagcataaaggcatgtgttgatggcaagaagaccatggagtcttattctctgataatgtttattccacatctgtgatttgtgtcctacaaggctcttgggacttaaaccacatgtgctatatttgcattaatgggaatttaagaaggagaggccataacactattaaaatgtttagctttcgctcccatcacacagacacatgctagtaactactcccagatcttgtatcatggtgctgcaggatgcaacgtggagtgcactcattgtttcaatacaagggacttgaaaacaaatagctgccatctctgtctctgatagtttgccaggcttttaacttctttggtttttccctctccagatcatggtgaggtatctcagatgtattccaaacagcacattgccccatctttgtttcttcttttataaaggaactcttgctttaaggtatatttagaaaacctagagtctaagccaaattctgaagaaccacatgataattctactttcaaatggcaggaaaggacttagtgcagaatcacccacacagggttattgatcacccaggcctaatagtcacaaacgtgacaaatatgctggaagtttttcctaggtttaaatatccaactgttaaattacatatgaagatattttgaagcatcttataaacagagaggcagggagggtgcagggtgggaagagaaaagaaggggaagggaaggagggacaaagggactgggagagaaagagggaggaaaagagaaagagagcacatcaaggaacagggcatgaagatcacatcttcattactccctaggccagagtttttcaaattgcaaattctgtgatcctttagtgggtcacagaatcaatttagtgagttgggaccagcatttttaaatgaaatcaattaaagaaaaaaagaaaccaggatagaagatatattacatcacatatagtaaagggaggtattattaaataaaacttttgtttcaattatatgatatatatacatatataaatgaacatatgcacatggtgtatatatatatatatatatatatatatatatatatgtgtgtgtttcattattatacattgaataatagatgaatttatgtgtagaaagatacctagatgacagaaagagagagagtgtgagagaaagagaaagggggggagagagagcaagaaagaggtactgattggcaatgattacttcttaacatgtttcatgaacaaaaatgtttgaaagccatcaccagattatacctccaggacagtggcttctttaaatttggaatacgttcttcccttagtgcctcctccacctgcattcaggtaaattaacaagctgcatataagtctcatctaattaagccacaaacttttaaagaaaatgttgtggatgaaactcagtgaaatatgaatccaatgctgtgagcctcaagggtagcagattacaaacccaatactggttctcatgatagaaaaatgtcctccttaatgtcctactccccaggatactagagaatgataaatggcacaatagttgatagtaagcctcagaaattgagggagaaacttactatactgatgatctttagatatcatttattcagggattgggattattgtttgagatcatgaaaaaacaagttaatggcaatggaaccatcttgatgaagcaggcaaaaaactatagttgggacaactactatggaaaagtttgagctgataatattggaaggaagtgtgtcttctggacagaatacagaacccaaaaagtaagataacaaaattcagttcaggctgttagggtgtgagttccaaccagaaataacaaggatattttaaagaccattggatgattgctgaatacactgacatgactcattttcagatattcttataactatggtgccttgaacgcaagtatggattatttcttgattacatgtgtaacaattcagatgggtgaggcagatggaaggtggatttaaagaactcagtgaggtgcaatgaggatcagggagatgctctgcagagccccagttcctaaaagggggcctggcaaaaggacactaccagccgagagagtctggtatgtgagataaaccaccagaatagggaaccacaagccggaagcaagaagaggatacagctacagaaatgagctttggcaaagacaggatatccaagactgtgcattctcaactctcaaggcctgagatcacgtcaagtcactttgggttatagcaaaggtctttattcaaataccaagcatctcaaggtggagcatctaacattgaaagcagagaagcatctgttgagttgtgtaaaagaggaaaagatcaggaaccagaaagagctggagaaaccccaggggcccatggaagaggtattcttcttaccaagatggtgtatcatcttttcagatagatgcattgatacaaccttagaaggcagtggtatgttgacagttatggaagttgcaatatagagccagctttaagaggatgtcttccccactgtgacactgtggaatagctcactaatacaggttctcagtgactaatcattgctttcctctttactagtataccaaataaaatctgttttctacatttcataagcctttcattatgtggataccaaaaccctttagtattaacctaagccaattgagctatcattcattctatacccctttattgagagctggtgctattccagatacttggctgaatgcagggacatgtggttttgtggtcagggagcttaatgtgtagaaaggtcaagacactggatgtgtacagtagtgagatgcacaccattatgaagttagtacaaactgctggagggatacctcttttttgacctctagatgttataaaggactttccggaataggcagtgtctgagtagtttcctgaatgaagaggtggagtttgcaaagtccaggagacaatcaatgaatcagtcaataagtgaaatcaaataataacataatattttaagtgctaagtatgtaccaggtattatgttaagttcttctcctggattgtattttatgtagcccttataatggtcctatgatgtaggtattattgtttttctcaggttataggtgagaatatagaaacacaaaaattttaaataaattgttcaaagttatgcagttaataagtagaggaattgaaaaggttagagacagagaaattatgaaatgttttgcaacatacattaaataattgaggttttatccttgggataaaaggaatccattcagtggcttttaagtggcatgtgacagatatggatttaggtagatcatctttctatggtctagagcagcagactccaatacagcataattttcaaatcactcgtggagctctgtaaacagacagactactaggccctatctccagggtctgattcttttaggtcctagtgaatgtgagaatcagacttacaaagatctccaaggacaaagttgatgtcagtcaacttaggagtttactgatgagtggatgtaaagaatggattgtaactataccatctgtcattaaggaggtcagaccagaagtcacattggtccgaattgcaatagagttacacattagggatctattagttttacaaatctaattttttttaaaaaaatgagaaatggtaatataattctggagcgtgtctgtaagggagaagaatcatgtcttacaggaaaatgtttggtaacaccaccatttaagggatgagtgaagggaaaagattccacagagagggcatagggacagcttcttcatgtcctttagagatgctgtatactttccttcctctgaatctttgtacaagcttttcctttcacctgtgttgtcctcttaccctgccttttcttctactaaatctcatccatccttttaggatccttctccaacattcatccctgggtcctccattataccctcaaggaaagtttgatttctttcattgaaaaccattatgtgtcccatcttgaatccttatgtaattgttgtttctaatgttttcacatgctggtcttttctcacactagattagaagcttcttaagaggaagggtcactgctaacttttttgtatacctcacagttcttagaattggaccaatgacaggtattcactaggcacctaaatggttattaaatgactctcagtattgtgtgtgttggctagtgatccatatgtcccagagacacaaaataggcctggtttataccagttgtcctggtgtgttattaacagtgccttttgccttcagcattatcatagtttcaacaataaattatatagtcaccctactgatagtgctaccaatacattttttaaaagtctagcatctttaagtggtaacatttcaatacaaatgtcattttgttttggggagtaaggagtgttaagatatttttgcacacatttggcatggagtgatatgtcattccagatgtctccttattaggtgggtggcctgttgctcaattgacagatgtcattgtctattatagagtcacaggtggtttattttaataaaaataccattaaattatctctatttttctgttgtgctctctttatatatagagagaaatagaacacatatgtacacatgtactatattacatattatatataactttatagtatgtatgtacatatatgatacgtatcactacatcatatgtcactatatgtgatatacctatatatcatatatagtgatatatatatgaacatattacatgtacatatgtactatatgttttgtaaaccactaactatagttttagaaatgtcagatgctttttcatgtttggtttaaagataacccttttgagtaaacagttaggaatgttctccaaacagcagaattacaatttttccacattctcagaagaaaattttcaacattttcaatttatttaagcctctcattcatggaaaaagaagcattactactcattcatgaacatcttaattacatagatagttagtttcattcctaatgaatgatcatgctctttcatggagagcaaaatctagattgtcaagctcttggttaaacacaatttcaaaattatgagacaccaaaagtaagtttgtagtattacacttacttcttgaattatgcagtttggattctataaaaaagaattcactggttaatttccaaatctccacctaatatttgttcctctccccaaagtatataacttgacagcagagaaggaaatagataccgttctttcttgtgagccacacactctgcaagggccattcctagttctgctatttcccaggacagagtatcaggaatcatgtgggaatagttcatatgtgtgtgtgcctgggctaatctgtgtttactagtgtagtacagaggggcactgtttatgtctgagaaaatagttataaatcacacttcttctgatcacaaatactcatttatctttagactatatcaccacctgagttatttttatgtaaatattgcacctcttaaatataatgatgataatagaggctgtgaatccttagatttgctcaagtgttccctttttcaataactgaaaatatttaaatcccagaagctttagcatcctaagagaagtagcagacagatgtgtcaatagagtgagacctacagaagttgtgagtaatgaataagtcagagtcatgggcttctgtaagggaactgcggtgcatttcctaggttggtatgttctggctatgctgcgaaccgtagcccagaaatgactgactcagagagagtcctcagctgctttgctcctttcagctctgtcatcacatagaaaggtctctttggcaaagtgtcggaaacaacacaaggtgggcaagcatctgcagatttcctcactcagtcagaagaccagctagagtcatccagcttctggaaatcagtaaagagaccaactttgggtagcgagtccccaagatcacagagaatctatgttgtggtggcatcaccattccttatttgttggcatccttgtctggaaactgcctcatttggctataatttaacttgaagattaaagcacagattttcatatgtatcttctgttctctgaatgtaaaattatgaaatacacctacattcacttctaagtggcagtattgtaattgagcagatttttgtttttcactgaaacctggagttgaattgtcttgagccggaaggcattcaagttgctgttttttacttagctatatttctctataagcatctaattgtttcaaaaagtgaggtaaagtatgtgaaaacctgaatctaatgcaaataagtctgtacagcactaaagctaacaggtgttctcattaatgtaagcagacatggaacaattcttgaatgttttataaacactcataatcatggccaaatatgttacaatagcataaagatacatactgtaacatcttttattcttgttgtacactctcagtacttattaataggagactagtggcaacaatacctacttctgcttaagtcactgtatcataaagttagctaatacttctaaataaaattaacaacgtaactactacctcctcccacagtttgcttatttattaatattaacagtgttcttgtaaaattgctacaatgctgatggacagcaatgagcatctttgcatcactgagtttctctaaagacttgacccattaacctaagtattagctctttaaaattttgaacttatgttccagttcccatactgtcaactcccaattaccaaagcctatatttagggtgagattcttagatgatctagtatagatgatccctgtaaaatacttgggtggctttggaatataatcaagaacgttctattttagagatatgcattgaaatatgactcttgtgcttcccagcccttccaagtttaatcctattgtctgatgtctaggacttgctgactgctgggaaaatatagccttcagactgccattatcaatcttcaaaatagtttgcctactctactcttatgaagtgttttcagtagacgtcagtattacattacttatattacctgaaagaatgcaattgtattgcagccttcaaaattttatgacaatagagaatgagttaaatatattatggcatatcaaacaatgcaatataatgcattcaccaaaatgaataaagtagataaggtttgtctattgattattttcttagtgttccttatgtgtctgttgttcagccatgcatgtagacaattgtcattggcctcaggattattatagcatagtggggggaatggaaagaccaacaaggcattgcaacataaaccagtttgtgctaagataaaggagaagcaggatgttatgagcgcacttgggggaatatctatttcaaagaagcctttactgaaaaggtgacatctcaaatgatttgaatgatatgacagaggatgtcaaaggggtctaggcagcaggaacaacctgctctaaagtatgggacagctggggaaccaaaaaaatcagtatggctggattgtggaaatgcagaggaaaatgtggagcagcggaagtgcagagtgggtcagtgccagagcacacaggggctggcatgccaaattaaagagtttgcactgcactgcaacagctgtggggagcctcagaatgatatcaagcagaagaatgggatgatcatatccaagtttcagagggatcactttggctgcaatatatagtatggacttgaaggaaaaacatggatgagacagtgaggaaagcaaaggatattatgactaaattctcatgagagatgatggtagtatatatagtaaaaggcacaaaaattttcataataatatacatgatattttcattaaactgtaaacatacataatgtttcctcgtgggtcaaaaaggtatgtagaaagagacaacaagtcagtgtatcttgaaggaagggagattctatgtttgttaatttgaatttattaaaacttttaaaattgagcattacctacataaggacagtaataataaaaataataccaatttgaaaacaatgggggcagcagattcccaagtgtcatgtgactgtgactaaatgagtaattgaacacagtgaatatagctcaggcaagaaggtgatctgtggttggcagggagtgactggtgacaaatcccaggatgattcatttatctacagacaagtacacccccccagtttaaaaattaagagcaataaaagtctaagttgatatctttatacaccaactgctttgattagtctctttttgagtcgtttttcatatgagcaccacaggcaaaagttttggtgtggctgctgcaaaactgtggaaattgctaaactatctactaattacttggatagtattctttcatgaatattgagaagactgtttctcagtacttaaaatattttaacacaataaaaagaatgaacatgagggttttttttttttttttgcttgtttgaaataaattttgggtttagatatttgttaataaacagaaagttagagtgggcaagtaatatggggtgtgaatgttcactacagggacaattttattatgcagaacaaatctctgttgtacgaatgcatggacaaaattatttgggtgtcaaagtacagctcaatttcacttaaaaagcattgtttcttgaaaggttggccttaaaccttagattttggaatgtactggaggtctgtcatgtacgtaacccgacattgtttactttccattaaataagaaattgcttacatgggcaggttattttgatatgatgacaccactgagggttccaataaatgtacatgcaaatcaatcaaccccaaacacattgaaaacatatccaataagcgtctggaaactaatgaacgcacatttgttaacatagggggagttgtggaaatgctgagatccattggtggcctggcttatttagtagcatgtggatttaggaacatttcacggagtcagaagaaacagagtaattataacataaggttcaacatctttagatatgtagaacattttccgttgcttaaaacaaatattccctaagaaagtataaaacatttttctgacttgcaaagtttttgcagtctatcatttaaattacttaaataaagggagctttactgctccccaaagctgagaatataacaccctccatgcatattagcttgatcttcttgacagaccagaaaagtgtttgtgtgtgccaattaaaacaaaaatggatccctagtggcttgttcctcatacaacttttgaagactgctatcattgtttgctagggtaaccctggataaggctgctatccaaagtaaacaaacttttcaaaactttcatgacagatggggattacaaatgcattttaataagagagttgccaaagtaacttttttttttttttttgtaatcagcatatatttacttaacatctagcaacattgggaacacaaggcagatactttctcacaaaatgctttaacaagtaacatttttggaaaggcaaattgaagaccttttacatctaactgatattttacccttagttttattttaactttgctcaacatgttaagagaaatgttaggaattactcaaaccagactgtaatttgagacagacattcagcctgatagtgtaatttctttggtggtcataaacacctttgagaccaagtaatttagctattagtataaccatgacaaccttcatttgatcagctatatgtggagtgatgcaagatgaaaaaaatgtgaatctgtgtgggttttgtaagcattattacttcgattttaggtcttgatatctccctatcatgtgtatattttctgctgggagtactgaatacagatatggacaaaattactatcacaaaaataattcatattcacttcaaataaagttagtgtatgttgatataactttttatttttacttaatttaactcaaatataaaaattatatcatgaagtccaaagtctctctaaacataatagcaattaaattccattcctcttatttatgtctctctagaaccactgtagccatattatttaacatgttttagggctctttggatatttggcatattttattatgcatttcctgcatactatttcagtttcactaaaatggaataatccctccttaggttctaatcaaaatgcgaaaggtatttgttcaagtgtaggattgctttagtcctttctaggatttgaaggagttgtagataacccaattcagtcttagatatattttttcatagcaagagagtgcttgtttttggaaagaaaaatcagagctaggattttgcatgatcttttaaaatcgggctatctttagcctaactgcaaggaaagaagcaactttgtctaaagttgctattccaaatttcataactgaaaccaaattatcacggcccttttcctgttcaaacacacagtccttgactgtatacaactgtttgctgagaactagtgaactagaaatcaagatctttgtaatctcttaattctatcatttaaaatgatgccaatttgatagaatggcattctcattttcctcatttgcttcattttcttcatttgcaaaattactttatgatagtggaggaaagctgcatttggagaatgtttattatgtgctttgagatcattaaagctgatatcactttgcataccaagtggtggtattcatatccttaatatactgaagttctgatacaatcaacgtttaaagaataacgtatcatgaccaccagtttatgcatactttcatgatgtaaatgtgcctgcagtaactactccttcctctgaaatcttgacatgagcattgtgtgtgctgctcacattgggactcagtatgagccattttctattgttatttatctgtatatgcatatgtcctatttatccaaacagattgtgagttcttgagggtgggggctgtgtatccctagcttctagcaatgtgccttgtacttaatggatgcttaatcagtcattgttaatgattagtaggatgttctgtcatgaacgcatcctctctattcttctgtacatgaaattatttgtgggatttattctgcaatcagaagggtggggctctcaaacagggtagcaccatgtcactcattatctcttacatctttggtaatctccccatgtgcatctgaagtcagttggaagctggtaatattttaccatcaaatatgttttgctgatgaggtgtatctatctataacattgatcattatttctgtttggttattatttataaaagattggcaataatgaaattaaaatacctacaatgtttactttgtgtagctatgcataattttgattctttatctttatttttcccaaattctacacaatgaagtattattcttagaaaaaagaagttctaaaaaaggttttgtttatattctagtaaacaaaagtatggaaatttataatggtataaatgccattctacacattaatttctcatttaaattaaaaaatctaatagcataaaatcttactgccagaatgaatattgatgagagtgttacttaattgacaatatttaaaagaacaatacttaaatcaacataaacactacttcttaaaactcttttaagatgttttaaattagcatagtaaagctccatttaattaaaatctaaaacgcaaatttcttcgctcttcatcagtgaagtctggacttgcatctacctgcctccatattaagaggaaccgtaccaaggacacagactattctaagcccacgtgaaaactattgttgaattaattcccaaaagccttaaggaatgtgcccactctgcatgttgctcagtggacacgcttctataatttcctgggcataaatttcttaccagcaagaattcagatggacccttatttagtatgaaaaagttcaagacaaatttccccagatggatacttaaagatatgcattattgacactgcacacttcattaaggttactttggtgccctgatatattccttcaaaatacgacctggtgtggtaatgagggatttcaagaaacatttgcctaaattaggtttctaagcaagatggagaccagcagctcttatctaaacctgttatgttgtctataagttcttccttcatccccttaccccagcatctgtcacggaggcaaaacatatagaaagagtacattagcacggcttaatatcaaagcctttatgtctgttatacatcattttagattgtcatcataagttgttcaatcaaaagatttagtcagagctaacattctttactgatgtcttttttccccaagagtgttggaaattcgattgttcaaagtgcaaatatgattcagcaaaccatttatcagaaatcctaaagaggtaaaataaaaaagcgggttgaggaacctgaattaaatgggctttaccagtcaaagattttgaaactactttcctgtgagtgactggaatagagcagaacaaagtcaattactgactgtaattaagaagtggatgcatttaaactgtagagagcagtagcagacttctccagactgcctggtaactcgaaagattagtgggaagacagaggaaaggatgtgaactgcatctctctgatagtatgttttgaatgaattgcattcatatagctctctgatctagcttctcaaaatgaattcgtaaatcactgattatgtatgattaatgcagtaatatatttggacaaaggaacttttaaaatacattttgcttttggttgtgttagcaatataagatcccctttgcattgcatagcatgcaccaaaaatgcaaacgcactgctaaagtacttatattttatcactgtttgaatttactagactgcaagctgaactatgttggctctttcgtaaaccctcataatatagcaaatctaattatgtttgtttctcgtacttcttaaatgtttctttttataattttaataatggtttatttatactggcagagaaacattacattgtacattgtgctttggctaattcatttgtctttgtgtatgttaacaaattatgatgttagaaatacattcataatcaaaatatttcactacagattaggatgaaggtagaggtctaggacattactagttttcttgtgttagaaatgaccttatatttttagattactatttcttaggcaacactctataaagtaaatatttggaactttatctgagtagagaacattgcaatggtgttcagataattaggcaaacatcacctgagctgtcttttactggatacataaaataggaggctgttttgagccatcctaaatcttatatgcagtttcattttaaaaagagagagaaagactgattggcctcagtaatctgtcaaattctagtgtgggcaattaaatctttttatttttaaatctttcacttcttataattgtatacactttagacagttcttctcacagttatagagacaacatttgatattggaacccatctcaatcaagaatggttactttgcagtactgattaatattgaatctctatagagtttttctaaaaacaaatgacaaatgaatatatatgcacatatgtaacagatttctttcaaaaccccaaaatcattgtcattaaatgttgccatgagaatccttgaaaccttcagaatgagccatttggggtagtaattgtcactttaatgatagaattatagagatggcctaaagcgtgatttgtgattttctgaacctgtgccacatttcagcgttcacctcctgtttagagcaaggaaggctgagaagaggtgactggctcctgattgagtattttgaaatgtcagtcctctaaacccctgaactctgtgtgacagtagttgggaaatgttcatcttccagttgcaaggaaaagtcaataatacaaagggaaaatcttcacagttcagattgatggccaaatacaaaaagcatgtccacacccactctaatcaattttttctctaagttgcccgttatgtgtgaaactaagagtattgctctgtttctgtagggtcgtatccttttctcacaagtctggggagaaaaagattcactgtaatgaaaaatggacagttacacgctaaatattgccaactacttagcagtctgagagtcaggaacctgaatgttcatttgataaatactctcccagagaggttcaaatatgtaaatgaacttttattttaatatactccttttgtggggaaattggtttttttattactttcctatagatctctgataagaaagtagaaatagtcaaatgttattcatttcaatgaacttttggaagtctgcaattagtgtttttggtaaataaactgttttagagctctccataaaaggaaatcaaatatagagatactattagatttgaaaaagacagacaggaaagaggcaaacgtgcagaatgaattctgacacacccgggtgcatttttctgcgggttctgacttaagtgtgtactgtctgcagttctctgaacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattggtatgtatttgttttggctgttacctttattaattaaaatgtagtcatttaaatcttattgctcaggcatataacacacacactcatttaaatagatcctatggactgagagggattaagttcttttagtttaaatagaatctactaaaaaccttttcagcagacaggatttgtagaactgtcgtttaatttctctctttcaaaaatatagtgcattctttctttttttctgaaataacatagacattcatttactggaggctgtaaaaagcacacaagcacttaataactactgatttttttttcattttcagtttatgcagtccatactacatactcctgtaaataaataacatatttaagactcactgttataataccaataaataaataataaccctttgtactgatttttattattcttccagctaagctagattgttcttcttatgaaaattacatatctagaacttcatgaaattatcctaaaacatacattcagagtatgttttctaagaatgaacttatttaaaaccactcattccatgctgagtctctagaacaaacatttaattttatgacactaatatttgcaaaattttgggaagaaatattcttaatacggaatacaacacaatagtaaaagattttctgtgtgattttcttgatacttaattgcaagctttcattataccattttgggattaacactttaaaaagtaaaataacaaatttactttttcctgttattagtatattccccttaaaggggtgtgtgtgtgaatgtgtgtgagtgcacatacatacatacacacagtttgttgccattgaggatggactctggaaccagactgctagagtttgaattctagttctatcatttgttacctgtgtggccttaggcaaattacttgcctattttggcctcattttcttaatgaggaaaataaggataataataataccacctactctatagaattgttgtaatgattaattgaactaatgcatgaatagtgcttagcatttagtaagtaccatcatatacatatataaactattattagagtattgagcttagcatagaggacctatcctcaaataattaccttacttcaaatttccccataaacagcaaaattgaacacaaaattctatggtgaatcctttctttctagtaaaattattcagtctaattatttgctgtttccagccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatataaatgcattgaaatgagatttaagccaaactcatcatactcatggaagattcgtagccatttcctggccagggatttgtgcactggagggcagtctgggcactttgctcacatcattgttggtaatgccttttgagaaaataattgttccaaggtcatggtctctgcttacagcaaacctctgaatctctgagtaatagccatggtgttcagatcagtgattgattttgagagtgggaaatgtcaagcatctccaaccctggtatcctgactattttatttgcatacattaaagggtatgagtgaccaccagtgtggtctaacttaagtcaacaggctatgccactttccacaccttcagaccaccagaaacacttagaaacgtgctttccagagaggctgatagaaaatatgggatgtgaattagatgttctccaaggtcacacctagttctaatattctaagaattaaatttagagtaaaaagaatggtctcactacttacacagtgatcttgagtatctttcttaaccattccccagactgcttcttcctcaatgaaaaggggttattaaaatatgcaacacatatctcactgagttggtttgagtctcaacctcctgaaagaaaaggtagacatctggctgggcgaggtagctcacgcctgtaatcccagcactttgggaggctgaggtgggtggatcacgaggtcaggagctcgagatcatcctggtcaacatggccaaactccatctctactaaaactacaaaaataagctgggcatggtggcacgtgcctgtaatcccagctactcaggaggttgaggcaggagaattgcttgaaccagagagtcagaggttgcagtgagctgaaatcataccacagcattccagcctggttggcaacaaagcaagactctgtctcagaaaaggtagacatctttggaaccagagaaaacctatttcccaaagtcttaaaaattatagtattttgggggagtcttctacctggctgaccccaatcttgcaaatcatcatttttttcctgctatttccctctgacaaaatatcagtatactgacatcctaaactttagaatttaaagagaactcagtaagttgagaagagctgctaatggaatatatgtgtacatatatacatatatacatacacatacacacgtatgtatgtatgctagatgattatttgtacgtgtacatatatgtgtgcattaagaaatatatgtatatacacatacatgcacacaaagactcatacacatatgatagggaagagagaagctatttatatgtgataacatatttgccaaagttgaattactgaagtctacaaatctagaaattgcatgagaatttaagagtagaagcacccttttgaaattaagtctttatgcaaaatcccatgccataattttcaacaactgctagacacatttacttagccagttgtgctaagttggagtttaagattatcagtgttaatgtctagaaaatgcatggtttatttgtggagagttaatgccatttcaaaagacttttccataatggtacagtttagaggtatttcatttaaagaatgttttcctttcatgcctgatcattgtcttcttttacttcatatggtttgagacataaggtaagatttcagaattgggattcagttgggagtatatatttagtgttaatcatatagacattctgtagtacatataaaagaatatgtgatgcaatgactagtaggtctggaatcttagatataattgctggttcagagaccttaagatgtttctaaaacctgagctatggagaaaataaaggtttgcaaaaatgtatttgagaaacattgaggataatgaattctctattaagtaacagtcactttaaaagtattaagatgctgctgaaaaaaaaatcttagatagaacactcactacttctctttagaatctatttttaattggaaaagacaattatttttctactttgagcttaaactcaatcctacttaaaaacaagggaggccaggagtagtggctcatgcctgtaatcccagcactttgggaggccaaggcgggtggatcacctgaggtcaggagttcaagaccatcctggccaacatggtgaaaccctgtctctactaaaaatacaaaaattagccgggcatggtggcgagcacctgtaatcccagctactcgggaggctgaggcacaagaattgcttcaacccgggaggcggaagttgcagtgagctaagatttcaccactgcactccagcctgggcgacagagcaagactctgtctcaaaaaaaaaaaaaaaaaaaaaaaaaagggaagagatacatgatttattctattcatttcaaaatctaactaattgtacagtgacttcatactcaccttttactttgaagttaaaaaaaaactagaaaatatgaaacatttactgtgcaccaggcactgttccaagtgcttgtcttatagcaatacatttaatcctctcaccaatcctatgaggtagatactattagttaccttattttatagaggagaaaactgaggcatgaagaactaaggtaatttgtacaaagacaagttatggagacatgtttcaaacccaagcagtcttattttagagcctgtacttttaatcattacattataacaaagtgaacaagtaaaaggtaaacttagtttatatcgaacttagacttggatagaaatattatgttaaaaataagattcatagaaatcagtaaacttgaatcaggacccaaaaacttattggcaaaaataattaaaactgggtgttttctttcaattttgatttcactattaaaataataatttaatctttaacactagctctaattttagaaaatgattcttttctgtatcttggtgagtatgtatagttgtaagcctttttttttagggccagtatgttttttgcaatgtaggacacagttaatatccatctattactttgaattaagttcattcaatatgtatgtattcattttcatttgaaaggcataatgattgacccacccacacaatatcaaattagaccatgcatttgaaatagtgattgacatgttttatatttgatgctttgtaaaatatattttttcaagtaggaaataccctgtgtgaaacccctctgatctcagtcctagatttgaacacccaaacttaggtttcttaaaacttgcattcgcttttatgtcaccctttggagattaaataattatatagaatcagagactcaacagtatcctcttccttattagtagtctaagcacaaactttattgtcggttttctgcctttggcttcctgtgcccttgatgttcccatgagttttgccgccaagattgtagacagataaagccagaattacttttttaaaaggcatgtgaacatcattagcagctaacaggtggtgatttcgttgtccagtttgtctatataacatgggaaaaatatgttctctcaatgagtgaattcagaaagttatgtttacatatacttttcttttaaaaaatatgattctaacctgccaacactattaagaacgaatcagatattttaagatatcagttgagtctaacagacaagaagccagaaaatttaatgcaagggccaaatcactgtgggaaactcaggacaccagcctgggatgagagtaggagagcagctctccagggagggctgttatggaaagtggagagtcaatcaaagaagatgtgaacatatttctctgaggaaagagaattgtcttccactgacagcaaagagggggaaggcccaaatataataaatcttgcatcagataaccttggcgaggtttcttaacttttctgagctttactttccacatctataaaaatgggtctaatactgtccttaaaggatcgtgtgagaatttgaaattagacatgtaaatacttagctcatagcaggcactcagtaagtaggagctcttattattatcctccatgtccccaagcagatagcactgagacagggcttgagcctggtggtggttgatgaaagactggagcagggcatataagcttgccatcctactccctgagtgtatgaaaggtagaaaaagggtaccagaattggatatgggagtcatagctgcaaaaaatctaagtacgagcagctggtctttcccctggcaactcccatgtaaaaggggcaggtagggcattcttgggagcagcacaccaggaaacagtagaaaggagccaagaaacactcttgattctcctaaacccagaaaagcatgccattcagaaattcaagttgatgggaaggattcagcattagccatctcactattcctttacacaaagttctagtttattcattcatacacacattaattcttttttatgaagaaatacaactaaaggtatacaactaaaattcttgatttcactcatctgtgctttcaatttttaaaaaataacttttgtatgtaggttatgctttagtagtaatatatctcatacctatcaattgctaaactgtaaaatccatgagtgtggagaccttggataacttgaaaataaaactgacactttagtattggaaataagcaccctgaaatgaacatgagttagaagactaaagtcaaaaggtaagagagctaaaaggaaatgggttttcctttagctgtctcttgattaagttatcata

SEQ ID NO: 536 - DNA, 27359 bp, Homo sapiens
acctctctgatgtttagaatacttagcatcactcagaggagacttttggattgtttgatgaagctgaatcgttgatgaccagaaagcatgctgtggtaactctccctttttggacacatgggagaatggtactttcctcctccatttgaagttaggcatagccatgatacttgcattagtcaccagacaaaacggtagctgacactttcagtcacacacatgtttttggtgtttttttaaaattgatttttttaattctctactactgtgacattcaaggaaggcacatgcttttaaaagccagtgccttattattattattattttttttttttttttgagacagagtctcgctctgtcgcccaggctggagtgcagctgtgtgatctcggctcaccgcaagctctgcctcccgggttcacgccattctcctgcctcagcctcccgagtggctgggaccacaggcgcccgccaccacgcccagctaatttttttgtattttagtagagatggggtttcaccgtgttagctaggatggtctcgatctcctgaccttatgatccgcccgccttggcctcccaagtgctgggattacaggcatgagccacttcgcccagccaaccagtgccttattaaccatgttgccctttgactgctccaacaactactgaagcatgtgtggagagaaagccccattagcctgggtccctgagaaaatctgatgaacagagtccctttattaatccatgttgaacatgtagggttaatgagaaatactcatatgttacatcactgagatttttttttttttttttgagatgggagttttgctcttgttgcccaggctggagtgcaatggtgcaatcttggctcactgcaacctccgcttccgaggcacaagtgattctcctgcctcaacctcccacgtagcttggattacatgcatgcgccaccatgcccggctaatttttttgtatttagtagagacagggtttcaccatgtcagtcaggctggtcgtgaactcctgacttcaagtgatccacccacctcggcctcccaaagtgctgggattacaggcatgcaccaccatgcccagtctgagatcttaatagttgtaacttgggtgctctttacattcttccacaaatcagtatgatataattggataaaataccatttcccagtaaaagaaaaaaaaaaacaggacttcttggcaaaagtgctggtttgaggtctagagcaagaagtgtacaaactgaacctagaacattctgtaataaagcaaggaagactactgaaggtcttataaaaaggtgacaggagccaatttaaagaggtttccaatggccagatatggaacaatttgagaactgaaaaaaaaaaaaaaaattcaggaaacaactccttctgcaaaccagtaaataaattgggagaagggtcaaggaaagcatttattctgtcttttctgtatagaagtcccacatggtaaccagttgatgtggaaagatctatacagaaaagtcttggcgatcaaatgcagaaataatattagaattacagtacaatcattttgtaaaccttaataaaatattgaatctaggcaatgattatcagtagctgctaaaaattaccattatgtgaaaggctgatgggaactttataatgaaagaaagatacaacacttgaacccactgatcaatcttaatatcacaaaaagatattgtgtgcttcctgatgtgatacaatagaaaatacagaataccacctatactgttgccaaaaacttgaatctgaacctgataaagctactagatctatttaacagcttacaagaaatataggtgactgaagaacacattaaaggaaacaaggctttaaccagtaaaactgagattgtgggaaattctacagctaaaataatctggttttaagcaacaagaaaaaaagaaagaaactgacagattgaaagatgtagggctgggcacggtggctcatgcctgtaatcccaccactttggaaggccgaggcaggcagatcaccagagtttaggagttatagaccagcctggacaacatggatcaccagaggtcaggagtttgagaccagcctggacaacatggtgaaaccccatctctactaaaactacaaaaaacttagctgggcgtggtggtgggcacctgtaatcccagctacttgggaggcagaggcaggagaatcacttgaatccaggaggcagaggttacagtgagctgaagattgcaccactgcactccaggctgggcaaaagagtgagactccatctccaaaacaaacaaacaaaacaaacaaacaaacaaaacagatgtggaccttatttgggtcagaattcaaatgaactgtaaaaaaagatttatgagacaactgggtaaatttgaacattcactggatgtttttgttttgttttgttttgttttaggtgtgataacaatattgtggttattcttttgaggacgtgagtgtccttatcttttagaagggtcaacaaactaatgctggtgagccacctgtatttgtatacctaacaaactaagaatgttttttacgtattgaagtaattgagagaaaaacaatcaaaggcaatcttctaacgtgaaaattatatgaaattcaaatttcagtgttcacaaatgaagatttattgaaacacagacatgctcattcatttatttactgtctatagctgctgtgcactacaactgcagagttgagcagttatgagagcaaccatatggcctgaaaagcagaaaatttatttactatctgatcctttacagaaaaagtttgccaacccctgttttagagccacataatgaaggatgtatttataaatgaaacagcagaatatcagaaattttaaaatgatgtagtggaaggaggggggaagatgaaacaaaaataagatatctctacttctgtgtacatttgatttctatataaaattttaaaaatctgtatccctctgtattgaagacttctcacacaaacacacatacaggcacacaaacatttaaaaaattctttctgtttttggtcgggcacagtggctcatgcctataaacccagaactttgggagactgaggcgggtggatcacctgaggtcaagagttcgagaccagcctggccaacatggtgaaatcccatccctactaaaaacacaaaaatgggccaggcacggtggctcaggcctgtaatcccagcactttgggaagtcaagttgggcagatcacaaggtcaagagatcgacaccatcctggccaacatggtaaaaccctgtctctactaaaaatacaaaaattagctgggtgtggtggcgcgcgcctgtagtcccagatactcagaaggctgaggcaggagaactgcttgaacccgggaggcagacgttgcagtgagccaagatcacgccactgcactccagcctggtgaaagagcaagactctgtctaaaaaaaaaaaaaccataaaaaagctgcgcatggtggtgggcacctgtaatcccagctactctggaggctgaggcaggagaatcgcttcaacccgggaggcagtcctggcagaggctatagtgagccgagatcacaagatcacaccactgcactccagcctggtgacagaccgagactccgtctcaaaataaattaaaattaaaattaaaaaataatttaaaataaaaaattatttttgttggccaggcgcagtggctcacgcctgtaatcccagcaatatggaaggccgaggggggcaaatcacaaggtcaggagatcgagatcatcctggctaacatggtaaaaccctgtctctactaaaaatacaaaaaaattagccgggcgtggtagcaggcgcctgtagtcccagctactcggcaggctgaggcaggagaatggcgtgagcccgggaggcagagcttgcagtgagccgagatcacgccactgcattccagcctgggcgacagagcgagactctgcctcaaaaaaaaaaaaaaaaaaaaaaaaattttttgtttttagagacagggtctcactctatcacccaggctggagtgtggtggtgtgatcacagctcactgcagcctccaactcctgggctaaagcaattttctcacctcaacttactgagtagctgggactacaagcatgcaccaccatgtccagctaattttttaattttttgtagagatggagtcttcctatgttgctcaggctggtctcaaactccttgcctctagcaatcctcccgtcttagcctcccaaagtgttgggattacacatatgagccatggtgcctggcacattatacaaattgtttaaaggaatttaagtgtttatgaaacatgttccaaactatttcatttatatttttaaaaaagtacacttactgcaccgattaagcatgtcattctacaataaagaactgttaagccacacagaaatccagaattatcacagaatcaggaatatacacaaatcacagaaaataatattcaaatatattaaatactcctcaataataccagagccctaaacacactgctctgggtcttcaattaaatacttttagttttctgaataaatgcattcattgcatgaaatagttaaaaaccagactcatgaagtatattcaaattatatagcctcttttattactgaacactttactttttttttttttttttttttttgagacagtctccactctgtcacccaggctggagtgcagtggcaggatctcggctcattgtaacctctgcctgccaggttctagccattctcgtgcttcagcctcctgagtagctgggattactggtgggcatcaccacacctggataatttttgtatttttagtagaggcggggttttgcaatgttttccaggctggtccgaactcctggcctcaagtgatctgcctgtctcaccctcccaaagtgctgggattacaggtgtgagccaccgctcccggccaataactgaacagattactttttacatatataagcatatcaacctttactgatcacaacaaatttgtaacagaatttttacggaactaagatagcccaaaagcgtttccattaccaaaccacagatataggtaaaacaaaatataataaaaacttgagaaaatggatatgtaaattttactttcaaagggataaaacttcaaatagaaaaacaccaaagcattattatactcaccagtatttttgtggccttttagaatataaagtggcattggactgtccagtgagaaaatgcatatattgtggtcatttccaccggtggcaattaggccatgagggtagatgtcacttgagggtatgatgcatacacaagatacaaaattggaatggccactcatacagtgcatttctgtaaagctcctgtttggactggaaagacaagataattaatagatacatattcgtaccctgacttagcctaggacataaactgtcaaagcactcattttcatttagtgtctagacaaactttagagtatatactatcttaagaatctattgttttaaaattgaaccttacataattcatatgaactactatagagaattacatgagataaagagaagtttgtttagtgtttctttgataagaatacgttaacatagagaacaaggaaaaaagaaagggcaataaataatcatgactgggttttttctcaatctccatcttcacttctacacattagtgactgttaccctaagaaatccctggttaaacgaaacatacatgcaattaagataatgaaatttattattaagaagacctaaatatactgaggactttttcacattatgaagcattgacttagagcccagtagtatagtacagcatgtgtttctacatagctagaacaggggtgtcaaatcttttgccttccctgggccacactgaagaagaagaattgtcttgagccacgcataaaatatactaacactaatgataactgataagctaaaacaaataaacaaaaaaaccccacctaatacagaaatatataaatggctagagtaatattatataatatataatgttatatataattatatatatcaatgaacacagtacattaataattgcactgggattaaaatgattaccagtttgtgacatgtatcaatcacttagcatcactgccttacttaacaagttcaaccagcagattatgatttactatgtggaaagcaataaattacctgctgagagggataaaaagaattatatccctgactcagctaaatcaaagagtttgcagtctagttgaagaagataagtgtacataaagaggtaagactcccagataaagactaaacaaactcatctattttcacttccttcccaaattccactaaaaacaataaatacttatgttttttaataaaggcttaattaaacccacaaggccaaggagaatgaaaaaaaaaatacatgaatacaactttgaatatttaaagcttacagaaaagtagtaagggccttaggagacctgagtcctagcaggcagcaggacaaccgaagaaccaatttaccaacaaagggcttaagaactagagaatattctgggaagtcggcagagtcggaagcaccaggcatctgttttcccacctagacaacgatggcactggcagaatctgtctgatgtaactattatgaaactttgcagtcatttgaaagcttgcaacttctaggggaaggcttggattgtaaattgaggttaattttgatcaatgcctgctcttggcacagtagcagttacccacacctcacccttctagccccatggcaggcagtcatgcatctgttcccagagaaccttgctcacagctgtaggaactagggttggcaaaaaggatcctgtcctccaaatatcagagatctgttctctgatcactgattgctgctttgatcacagagcaacaacaaagaggcaggcagccattgttgttgcacctcccccggttgatgcaagcctctaccacttgagctgaagtgacttccaagaggatttaaaaggctgatgcccggccgggcacagtggctcatgcgtgtaatcctagcactttgggaggccgaggtgggtagatcacctgaggtcaggagttggagaccagccttgccaacatggtgaaaccccgtctctactaaaaatacaaaaattagctgggcgtagtggcaggtgcctgtaattccagctacttgggaggccgaggcaagagaatcgcttgaacccgggaggagaaggttgcagtgagccaagattgcgccatcgcactccagcctggggggacaacagcaagactttctctcaaaaaaagaaaaaaaaaggctgatgtccattcccctaacaccttcattttcctcttctgggagcaagataataaagactaagatattcaaaaggaactacatatatggaaaaaattagaaagtgaaagtgcatgcccagggaaaagcacaggctcagaaaagactgagaagactaagtttacatcttagcccgatatttgaaacaaagacacccttcaacaacaacaacaacaaaaagataatacacaaaaacataacaaaaaacagcaaaccctggaaaaggggaagaatatgatttctagagttatattattagattaaatgttcactttcaaccacaacaaaaaaatcacacgcatacaaataaacagaaaagtatggcccattcaaaggaaaaattaagtcaatagacactgtccctgaaaaagacctggcagcagatctactagacagagactttaaaacaactgttttaaacatgctcaaagaactaaaggaagatggagaaagtcaagaaaattatgcatgaagaaaactgaagtatcagtaaagaggcagaaaacctataaagaaaccaaaaagaaattatgaagatgaaaggtatgataactgaaatgaaattattcactagacaacttgaagacagattcaagcaagaagaaataattagcaaacttgaacataggacagtagaaattatcaggtttgaagaacacaaaaaaagactgaaaaaaaaaaaaatgaacagagcctaagggacttgtggaacaacatgaggtaggccagcatacagattgtggcagtcctagagagaggggaaagggagcagagagaatatctgaagaaataatggctggaaacatcccaaatttgatgaaagacatgaatataaacatccaaagaaactcaacaaactccaagaagataaattcaaagagacccacaccaagtcacattatattcaaacttaagaaagggagatacaaagaatcttgaaagcagtaagaaagaagtaacttatcacatacaagggatcctcaataatataattagtagatttctcatcaaaaactttggaggtcaaactgagtgcagtagcacacacctgtagtcccagcacctcaggagactgagataggagaaccgcttgagcccagaagttggaggctgcagagtgctgcgaccacactcaagaacagccactgcattccagcctggtcaacatagcgaaaccccatcttgaaaaatttttttggagcattagctaggtgtgatagtacacacctgtagtcccagttacttgggaggctaaggcgagaggatcccttgagcctgggagtttgagacttaagtgagctatgactgtaccactgtatgcccgcctgggccaaaagagtaagacaccatttcttaaaaaaaaaaaaaaaaaaaaaaatggtgagggagtttgctgccatgagacctccctgtaagaaatgcttaaaggagccttctcgcacagtgaaatgaaaacacactagacagacttgaagcaatatgaagaaataaagatctcaataatggtaaatacgatagtggtttataactctaccttttgatttctatgtcatttaagaaacattacattaaaaaaattagcctaaaagctaatgatattgtaactttggtttgtaactccaaatttttcctacataatttcagaaattaaggcatttaaagtaattattactttatgtttttaggacacagagtacatacagatgtaattctgtgacaccaacaaccaaaaggggtgaagatggagctataaagaagaatttttgtttgttattgaagttaaatgtatacattcaaattagaggattacaactttaggatattaaatataatcctcatggtaaacacacacaaaaatagaatatacactaaggaaatggggaaggaatttaaacataaataaactaggccgggcgccgtggctcacgcctgtaatcccagcactttgggaggctgaggccggcggatcacaaggtcaggagatcgggactatcctggctaacacggtgaaaccccatctctactaaaaatacaaaaaattagccaggtgtggtggcaggggcctgtagtcccagctactcgggaggctgaggcaggagaatggcgtgaacccaagaggtggagcttgcagtgagccgagattgcgccactgcactccagcctgggccacagactgaaactccgtctcaaaaaaagataaaaataaaataaataaataaacaaacatataaataaataaatcaactaaacacaaaagaagacagtaatgcaggagatgagagaccaaaaaaaaaaaaaaaaaaaaccaaacaaactttaaggcatatagaaaacagacagcaaaatggcatcggtgattactttcaatgtaaatgaattaaattctccaatcaaaagacaaagattggcagaaaccattttaaaaaacataatccagctcggtgctgtttatgagactcactttagatccaaagacacaaatatactgaaagtgataggatgaaacaggatattccatgaaaacagcaaacaaaagaaagcaggagcagctatattaacattagacaaaattgaccttaaatcaaaaaaagaaaacaagagacaaagaaggatattatatattaataaaaagttcggtacaggaagaagatataacaattataaacatttatgcacataatatataaaacaaaaactgacataattgaagtgatatatagatagttctacaataatagttgaagacttcaatatctcaatctcaataatggatagaataatcagacagaaaacatgtaaggaaaaagaggacttaacaaaataaatcaactagaactaacagacatacagaatatactacgtgaaagcaaagacacctgctacagaaaaaagtatggaaattcctagaaaaattaaaaataaaattaccatatgactcagcaattccatttctggatatattcccaatggaaatgaaagcaggatcttaaagagatatgtgtataaccatattcatagtagcattattcacaatagctcaaatgtggcatcaacctaagtgtccatcaatggatgaataaacaaaatgtggtataaacatgaaattttattcagccttaaaaaggagggaaattctgacatatgctacaacatggaagaaccttgaggacattgtgctaaacgaaataagccagttataaaaacacaaatactgtatgatcccacttatatgtggaacttagagctgtcaaaatcatacagacataaagtagaatcgtggttgccagggtctgggggtggagacaatgagttattgcttaaacaggtacagtttcagtgtaaagagataaaaagagttaaaagatggatggtggtgatggttacacattatgaatatacttaataccattgaactgtacagtttaaaatggttaagatggcaaattttatgttttgtgtattgtatcacaataaaaaaactggaggaaaagaattaacagcactatatacctccagaggtgaggacaaagaggcaggaactaagataagaaagactaatcgaaagtcttcagaatctgaagcattatgaaaaagtcttcaaagaaagatacctggtagtaaccaatttcaacttgttcacttcattttagggggtgttgtttttgttttttaatgcttttgaaaccattttatcaataagcccagaggaagtcaaaagatagaacatgttttaaaatctgtattatgtaaaccactaaatctacccactatgtgtaacccttaacacttcaaagcatagatgtttgtgtgcatcttcggtagtggtctgtgaagttcttaatggcagaatccagattaggttctttgtgtcttcccaagtccctagcacaatgttttaaatggttagcattaagtatttcttaaactgattttaaaaaatacttaaggtattaagacaaaaaaaaaaacaaaaacaaaacacggggggtgggggagggatgtgcagctagacaacccagccagacaactgtcctgctagtactcagcaaaagtctgaagctttttctttaaaaagaaaatctttgaatggggggacataaggatagttgagtcttgggagtgtgaagaatgtgtatattcctactggagcccaagaccaccaaaagaaaaccctggaaaccataccctcatcctctaggcagcagatcagcccaatataatggccctaccagataactcaacagtaaaactcacaaccagcaagccccatccaggagcacagatctcccaggagcttcttaattctctacccataacactgagcacacaataaagattaccagacatctggggaaagcctccagcatgaaatacagtgatcaaaacaaatagagatgagaaaaaaaccaatatggaggaaaacagaccattaaggaggaaataccttaaaacatttttttaaattgtcattatcatccttagaggtataagatattgcaaccatgaaacaaggacataatttcacaaagtcaaggcaacctgctagagattacagccaagaaaaaaaaaaaagagagaaatttagaaagcaagttcaatatctgaataaaaacagttccagaaaaaagaagacagaaaaaataaagagaaagcagccaaagaattaattgaagaacatttcccagaatttatggacatgagttttcatattaaaagggcccgccaatggcctggaacaatggatagaagtagactgccttccagaaagaaaaaaaaaatagttcaaaaatcagaatggcttcagacttctcaacagtaacactagaagatgaaatacaatggattccatcacaattctgaaagaaaattattttaaaattagaatgctacaaccattcaaattatcatgccagtaacaaggcaaaataaaataactttcagacttgcaaggtcttaaaacatttattactgatgcactacatttcaggaagctcttagaggttatgttccaataaggcaacaaggaagaaaaccaaccaagagaaagctaaaggatactgacaataaaaatccaacatatgaggttcaaaaaagttgttttggaaacaacaatgaagggaaatcctaggattagttgtgcatcagaggtagacagaccaggtcagaaagtttgcattgtcaggagaggaaattgtaaaatatccaatgtatctaaaggccttaagaggtgattcggtaacgaacaaagactttgaaattgactcagtgataaatacatagtaagctaagcaaatgaaaaccaaaataaaacaattattagccacatgcagatcataaaattgttgaggaagagttatcatagattattccacagcttaaattataagagtcagagcacggaggccgggcatggtggctcacgcctgtaatccgagcactttgggaggccaaggcgggcggatcacgaggtcaggagatccagaccatcctggctaacactgtgaaaccccgtctctactaaaaatacaaaaaattagccgggcgccgtggcgggcgcctaaagtcccagctactcgggaggctaaggcagaatggcgtcaacccgggaggcggggcttgcagtgagccgagacagcgccactgcactccggcctgggcgacagagcgagactcgtctcaaaaaaaaaaaaaaaaaaaaaggcacagaaaaagatgcatacgtgatggggtgagtggaaggcagaaagagagctaaattctcatattctacagtaggaactaatagattacaactaaaaaatctattaatatagattaatataatcagatcctatatctgaagatgtgtcttcaagcatgggtcgtttttcaaaaggcaaggcaatataaaggcaaagctgctgaagtcctatctcactcatctctccccacccagaagtcaacgacagacttgggaaatgtaatttagcttgaagctagcttatagagacctgaagtagtctgaaacaatggcatgttgctggctcagttcaatgcccaaccaacagatatgtctccactctgaaggtccaaagactttctgggttttcaaagggcttttgtgaaagactaggtacctggtttagtctactctaaaacagaactatttctgcctccctagaactaactttccccattattcccagtccatccctacatttactaccctgatctagaaccttagcaacaacatacatggaaagcagtggtaaattcatttgcatcagaggtagacagaccaggtcagattcagtaagaggcaattcagtaatgaacaaagaatttgaagttgaatcagtggtactgattcaaatttacagtggtaaatttcatttaccacttggctacatgggaaagcaaatttcatttacgacttcactccaaacatttatagcatttcattaactctattaatatgctgttatgagctgggagtggtggttcacacctttaatcccaacactttggaaggctgaggcaggaggattgcttaagcccaggagtttgagaccagcctgggcaatctagtaagacgctcatctctacaaaaataaataaataaaaattagctgggcatagtggttcttgcctgtagtcccagttacttaagaggctgaggtgggaggattgtttgagcccagaaggtcgaggctgcaataaggcagtgatcatgccattgcattccagcctgggcaacaaagcaagaccctgtgtcaaaaaaacaaaatcacacaaatattctattatggcctgaacgtgtcccccaaagttcatgtgctggaaacttaaccttcaatgcaaccatgttgagaagtagaacctttaagaggtgattagatcaagagggttctgccgccatgaatagattaatgtcattattgcgggactgggttagagagtggctttgttacaaaagcaagtttggcccctctgcgcctcttgctgtgtgctctcctacccttccaccataggatgatacagcagcaaagaggccctctcaagatgccgataccttgataatggacttcccagcatccagaactatgaaaaatacatttcttttctttacaaattacccagtctgtggtattctgctacagcaacacaaaagagaagacatgtatcatgaaataaaaattgtcaatatgtcagatttgaggacacttttacaacattaaaggtatggttgagacacttcagttggcatcaataagagcttaatcacctaatgactatgaaacactctaaccctggggtatccaatcttttgactttcctgggccacattggaagaaaaattgtctttggccacgcataaaatacactaataattacaatagctgatgagcatttttaaaaaaatcacaaaaaaagcctcataatgttttaagaaagtttatgaaatttgtgttgggccactcttacagccacccatgggccacaggatggacaagcttgctaacctaaccagcaggatatgagagactaaataatcttatctcactacgcactaacacacactgtggcaaaatgcaagttcttcatcagtgttagataaatacatacaggaatgaattttgaaaaacaaaaacaaaaaaatcatgagttcggccaggcgtggtggctcacgcctgtaatcccaacactgggaggccaaggtgggcagatcacctgaggtcaggagttcaagaccagcctgaccaacatggagaaaccccatctctactaaaaatacaaaattagccgggcatggtggcacatgcctgtaatcacagcttcttgggaggctgaggcaagagaatcgcttgaaccccggaggcggaggttgcagtgagccaagattgtgccattgcactccagcctgggcaacaagagcaaaactctgtctcaaaaaaaaaaaatcaatagttcaatgaacaacaaaatcacttttcaaatagagaatcagttcagcccaaagttcttcaagttcctggtaagcacaaccactccagtgattaaacccttgtcaaactagtacagtcccaaaagtttaatgacaggattccattattaaaacaggcatccttgattatactccttactgcaatggttatattctactgggcttatgcttctactggattcaattttaaaggcaaaaacttaataactgtactcaaacaaaaagttccatattagtattactaagtagttttggatattatagaattttagagttagatctttagagatcatctcattcaattcaatacaggaatttgctctatactatccctagcctagtggaccatcttgtgttgattatactacttcaaaagcctccaagcaaacccacttctacacttatcccttctcaatctattctctaccatcagctagcagaaacttctcaacacggaaatcagatcatgttgctccctgcttgaaactatttgaaggcttccatctgcaaactccataacctggctcttgccagcctcaaaacctgccctcacctcacagctaattccctcctgtttgctcctccagctgcctggaatgctcttccaattcaatcctccctatttgctcttccacgaccagctccatccatctcatgcttcaaatgtcaactttaaacaaacaactcctcagagaggcttcctttaatatatctctccacctaattaactgtatgttttcttcacatgccagtttttaattatttattggcttgttttttaatctatcttccccatcagactgtaagaaagctccagaaacactggcaacttgtctgtctttattcctctccagtatcccaaacaaagaggaggcactcaacagttatcaactgaatttatggatggtgactcaaattctaaaatctctagcagtgggagacctactaaataacaaaataactaacctcaatttttctttctctgaactgcaatctgtcttctaggtcttaaatatcctgttacaaccagccaaatcagggctgaacccgtgaactcgatcaggactgattcctaacctttttcttctttttttttttggttcgtgaacccttctgataaatcctttgaaggcaatggatgctgcttctcctcaagaaacagcacatgcacagaaacaaaacatccgagaggtttcactccctcaggaccagcacagaccacagactaaaattctaacctggacgaaaagaggattcaccagtgcaatttttgagaactaaagtcttcaaaaattaaattttacagaagactacagagcatcttcttcgaaaaaaaaaaaaaaagaggacatttcagatgccttcaaactacctcacttcggagggtgcaactgcaatcagtaaattttcaagtctaaaagaaacttgggagatcatcgtccaaaaactgaaggcccaaaaggtaggagactcgtctgtggtcaagttagcacaacaaggcaggtctttggtcccccaaccctgtgctctttccacttaaatcccgatggtttcttacagagttctaatagtctgagaattggaagggagcggagagcagagggaaggctggggggagagagagacggcaggactgacagggaagggtcactctccttccactctccgggaagcgtgcaacacagccggggcaacccgactcccagcgctcacctgtctggggcccagaggcgggtggtgcggtctcgggacacggacacaaaggctcccggcggataggcgcagcacaccaggccccgtacgtccagctcgtggccccggagcgagcagctcagccggtacctggttgcgccgctcgtcatggccagtgtctgtctggcgcccggtgcccaggcactgtgcgagaccagtccgcaggggcgactcggagagcgccgggccgcggcgggagaagagcctgcaggtaaggggcggccggagaccggaagagcccgagagccggtacggaagggcggctgggaaggggcgcgccgagcgggccgagtgacacagcaagcctgacaggcactccggaattcatcatcggcctcagccctccatgacgcagagtgtgtgcgtcccaaccgccgacgccgatgcggagctgagctggctttcctccagggctctggactccctgctgagcaagagagaaagaggcccgcccttccaccaggacgcctgaccctggggtccttcccaaacccgggtctcttccgactccgggcccaacagtttgtggtaaatcgggaagcgggccgggactacaattcccataatgccgcgccagctggcgtggacatccggcgcgccgaatccggatattttaaacctgagtctttcgcgctgggcatggcggaatggctgagtgaggttgtttggtgtctactgttaggtcatcctcactgcttttccctgagaatctcgaggtttttgcaagttaaccttgtttttcaattaaaacgagaaagcttgaggccaaattgggaactattaatcattgaactattcctccgtttcaagttatctgaatctcctactctctgttgtcaaatttagcaaatacggtggtccaagtcaattttttaaaggtataactacttttctctggcggcttgttaaaatgtagattctgattcagtaggtctgagttagagctgagatacgtatttttaacaaccccgccgcccacccacccgtggtgctacttgctagtcattatcagaccttattgagtgccagggtaaacatgacctgtctccttactttgttttcttcccatccgctattctctcgcatccaactacacttttccacaaacctttctaaattgctaagcccaattcacacttttctgacttctcccttcctaaaactcctactctaggtttggaatcacttttcccctggtttgggagatcattcttgaaatgctgacttttgatacttctttgctatcatatcccctccctgggtggattatttactacttggcttatttctagagctgtattcccatattgtcttctccaaactctagatctgtatttctagctatctgttagaaatctgtaccaattagtcctacttaaattatttcaacatttctctggcctttctaccccttctctccagccaatcctacacattaaaatataattatctttctgaaatatacacttaattgttttttctctgtttgacaacctgtgatggctttccattattttttttttttttttttttttttttttttttttttttttgagacggagtgtcgctctgctgccaggctgagtgcagtggcgcgatctcggctcactgcaaccctcgcctcccgggttcaagcgattcctgcctcagcctcccgagtagctgggactacaggagcgcgccaccatgcccagctaaattttgtgtttttagtagaaacgagtttcaccatgttggccaggatagtctcaatctcttgacctcataatctgccctcctctgccttccaaagtgctggattataagcgtgagccaccacgcctggccggctttccattcttatagtacagcattacatagggcctttcacacaatctccctaatctgttttactagattcatctccctctgttatctctcttactctagacatttcgaatttgtcacaattccctgaacacattatgctgtatgctctccatgtctctatgctctttgtacatgcattttttttttaaacttagaattccactttctccatctgtcatagttcaacaccagtttatcttctgtttttttctagttcctctggggaaccaatgcagttttgtctgttgtcaatatagtatttactgcattctaatatgttcttttatgtctgtcttttctaccggactacattttattattatcaagacctttattttacatgaatcttaaccatctaatttactgcctcctatataataggaaatgtttttcaacttggtatagtattcagtttaccaattttcacagtctctcatttagttctcacaataaccctgcaaggtagatagtattattcccatttcacacatgaagaatttgccttgtttaaaaaatgttaatttggaggccattaggttgagatagttccagctctggagcccaactcaatgtaaacagtaaaatgaaacttaagcttaactaacagaaacagacaaacctctaactaaggactttccactttaaccaatcaagtaagtatattttcttagtcttgcttccaccaaccccttataaaagttttcccctcgtgctgtaattgcccctgtgttcttttacacagggaaatgtgtaatttcacatttccctgtgtaattgcctgctgccttccaaaaaaccaatgcactgagaactacaaatgttgcagcagggaaagatgaataatcacagggccagccaacgaggaggatgggagatatttctcaaatccacctccaagaatgtagagactaggtttttaaaggatcggttggtgggcaggaggctaggaaatgggaaatgctaattggttgggtcagggatgaatcacaggtgtgtcagaactatcttcgtgaacctgagtcatttctgaggagtggggttcacaggtccaggttgtgtctgttggtctgccaaaatgctaaatttgaaaaatatctcaaagaccagttaattaggtttcacaatagtgatgttatctgtaggagtacttggcgaagttacaaatcttgtgacctctggttacgtgactccagggcaggaggctctatagaaaagcaagctaattaggctgggtgaggtggctcacgcctgtaatcccagcactttgggaggccaaggcaggtggatcacaaggtcaggagatcgagaccatcctggctaacatggtgaaaccttgtctctactaaaaatacaaaaagttagccgggtgtggtggcacgcgcctgtagtcccagctactcaggaggctgaggcaggagaatcacttgaacccgggagggggaggttgcagtgagctgagattgcgccactgcactccagcctggcaacagagcgagactctgtctcaaaaaaaaaaaaagaaagaaagaaaagcaagctaatcaaacaatgccaagttattgtttgagcatgtctattctttagcaaagttcaagcctctaccataattctaatcttgtcttatgaatgtagcttcaatctccatacaaggagttggggtggggggtcacttttccttgcctcaaagtttaactataaaccaaattcctggcatagttattttagcctccacactagaataagcaaaaaacaaactaacaataaaacgacaacaacaaaaaactagtttagcctgtgaggttttgagcaaaatggagtcagtcatgttagatttctctcattagttataattctgcaaaggtagtttaagtgcccctagatggagtttcaccacttgtggtttggtgctgcccaattcatgaatcactgtctgctcaactgaactgtttaatactttaatgtgtgttgtcttttaacagcttgataggaggttaatgctcagtagatgttattggttaccttaatgaattaatgaataactgaaataactattttaatgtcacataactagaacatagtgcagctgggactaaaattctatgaacactaaattgggttcttgatactttaaaaataattttaatgtttttatgtgttcagcagttcaaaggtttaaaacaaatcatttatgtcaactgtctgtctgcatacaaataacaattctggatccccctcccatatgcctgaaggcatgaaggaaaaatgtccgtaatgacagtagttctctcagagaaaatgcatggaatagttgggtagctggactaaacatcacagtttgtgtaaattgaggtaaacatcacagtttatgttctcaatatgatgttttcattaaaatttaattttaaaagccctcaatgcactgagaacagcattaatgcagattatacaggaatgaagttggggtcaatatggttcagggctggcaacttagtaggaaaacccaggcaaactaaagaaaggaattgtaacagggatggtatttggcttgtgtgtgaaagtgatggtgacagaatattgtttagcattttttttttaactaaaattcgccacatagactctggtgccaaaactttgggctggtatagcacaatacatacatgaaataaaatattaaaatgcattggaaaatgatagaaattttacatgtacagatcttagaaaattgaggctacaaatatgtcccccataaggggaatgttgaaaaaacaaagtccatatatataagaaaaaaacccataaaatgtgaaatatgggctgggcgcaatggctcacgcctgtaatactaccactttgggagactgaggcaggtagattgcctgaactcaggagttcacaaccaccctgggcaacacagtgaaaccccgtctctactaaaatacaaaaaattagccgggtgtggtggtatgcgcctgtagtcccagctactcgggagcctgaggcaaagaatcacttgaacctgggaggcagaggttgcagtgagccgagatagctccactccactccagcctgggtgaaacagcaagactctctcaaaaaaaaacaagtgaaatatgaacttcatctttaaggatggttatcagcttctaaatcacattcgtcttgccagtactgtggaacatgacagaaaatgtttcaaagctaatacatttcaatttcccaaaagataattgttttcaagcttttggtgcccaaagaggagaaaaacattcttctagtgccaatacatttagtaagcgtttttcttggcttttagtgagtttttttgttaaacatttaaggacactttttcctttgttttcatatgctttgaaatattatctagataattgcataattcattaaaagctggctaatgtgaatattcattatgatttttatcgtcccctcattgaaagtttatttaattttttttaaccttttttttttttttgagacgaagtcttactcttgtccccaagctggagtgcaatggcgcgatcttggctcactgcagcctctgcctctagggttcaagcaattctcctgcttcagcctcccgagtagctgggattacaggcgtctgtcaccatgcccggctaatttttgtatgtttagtagagacggggtttcaccatgttggccaggctggtctcgaactcttgacctcaggtgatccgcctgcctaggcctcccaaagtgctgggattacaggcgtgagccactgtgccttgccgaaagtttatttttaaaaagtaataataatgcattccttggtttaaaattcaaaagacgtaaaggatgcacattttcaaaccctaaccacccagttttcctctctggaggcttatcagtttcttgtgttcttcccaaagattgtttatacagatgcaagaaaatgttaacattgaatacttactcaccttactttatatatcttggaaaactctccatattgtatgggaagaagaaagcttttcctctaccctgtcatgttcactattcaagggcctatgagttaaactgaaaaaagacagactaacaggagaaaaatatcaatttcttatgcataaaacagccaacaaaagcagcagctgactagtcaaatgattaaagttaaaggcttatataactaacttagtagggaaaatggtgggggagaaacagcttttacagggaaaaaaatagaaacattgacttttaggagaacaaataagaaagtttgtgttcacgttcatctatacagttaggagtggtgttcttccgggccataagttagggtatttatggtagcatcattccccagaaattttgctttcagtgagataaggaactctctgagaaggtttttttcccccttcatcaaatgccttcaggttaaaataatatttttatactagctctggggttcctagtcagcctctgcaatatcagtatacaaggagcattcttttttatagatggccaaattttatgtgattttatgactatagcattattaattcagtgttgtttgatttttttcctaatctttctctgtaacaaacactgctcaaataaataaccttggacatcagcatatgtcatttatatgtataaattcagtgtgaatatatgctcacttcctagaagtggagttactgggtcaaaggacatgtgcatttggatttctatagccatcttctttcaatagacactcctaccagtgtatccaaaaatcttatttcagttgatgtacatattcactagtaagttcactaacttttctctattttacagtagaataccttaatgatgtcactcctcaaagtgtcttttcttttttaagattcatttttgttttcattttttgtagggggggggtctcactatgttgcccaggccagtcttgaactcctggccttagtgaccctcctgccttggcctcccaaaatgttgggattagaggcatgagccaccacacctggccaaaaaatttattttcttaaaaaacctacaaacatcctacaaagacatttttgagttattttgttaacatttttcttctgtgcaccctgggctacataagcgtaactggccatattcagtaccaagtggtatcctcttcattgggccttattgcccttgactctactgagtacccacttgctcccttccctactccctcattctccctttaaaacatccaatcactgctgtacaaatcaaggttgaattcctttcacattggactattttccctattgcagtagtaaattatggataaaaatgtgtccctactgtcagggtttgttatctttgacaacaaaaataaacatataactgcaagttataatgagtgatatgtagtgttaaaataattaaattggaggccattagactgaagtcgctctaatgcactgagttcctacatgaggaaactgaaacttaaaacggaatcacaagtggccaactagtcatcagttatatcgtcttgaacttcccacaagaacagtccaaataaggcaactgctcaaactttaaccagtcaaataatttctttgctgtgctctgcatttactctctgaaagctttcaactacctctgggggagccccaaaccacttatgatttggagctgcctaattcatgaattgctgtctgttcaaataagctctttaaaattttaatgtgccaaagtttaccttttaacagataggaatagtacagggtgcactgaggacatataatgaggtggggggccagaaggagttggagcactaatctagtatggactggcagagaagacctctctaataaaagacatttgggttaagacctgaatgatgaacaggactttggacagtgaaaagcagagggacaaagattccaggaagagagaattgcagtgaaaaggactagagacagaaaggaacttgaaacacaagtagtcttacaataaacttaaaatttgacataacctaattactaaccaaattacaacttgatataacctaattccaatttgatataaccttaaaagcaacagaacctaatacataatgatccaaagtcaaataagatatggtgcctactctaaggaagctcagaggcaaataagtgagatgtattcctattctctattcctttttcatcatgaaaaagaaatggggacagggatcaatacttactacctaaatgagcttaagcaaattatttaatctctttaaaacttggataatagtatctgtcctgccaatttcaactgttaatatctgtcagggtccttaagtgcaaggaacagaaatcatctataaatgatataaaagctgaaaatgaatttattaaaggacattaagcagctcacagactctcccagaagctgaagaaacaagctagaggttctcctcccaataaagcctctgagtacctaacactgcagcttgcaacaacacactgatgctggacactggttgctggtgatagaacattgcagtctcggaaacgatgtagttactgcggctgtcacccttacttcaacagactctctgaagtcctgcttctggttgtcattcaagtttgagttgagtccaccaaattagattggagagtctagcaagcaataatactcatgtcccagtaataaggaagactaggaaagccagtatctgtcactttcagttcctgtaagggtgttggggggcagggtaagggagaaactctgccaaaaggatgacaaatggccactgcaaatagggtgagctcaaatgagataattacatgaaaatgtttcacaaactaagggagaattcagccacataacattatctcattttgtgttgtattgatttttaactcctcgaaggcaggcaagttggaaataatgtgtaaaataatgttaaaatcccaatacatatgcaatcacatttaagctgttatcaatgaagattggaaggaaacatacagtaaaagttattttattagagaagtgggatttaaggtgaagtagttcttaaattaaaaaaaaaaaaaaaaaggacactttccattgaattcacagtcttccccacaaacttggatccaaattctaatgaaaggaagcttaaagacgcaaagcttctggtgaaagcaggaacggaacagttggtgccagaatcgcatccatacttcatgatgcgttgtgtacgctatgccgtcctaataggaaggaaaactaccacaaattaggagtttagaaaattgcacaatgctgcctaccacttaacttcaaatgtaacctgttaacaacgttagccgacgtgaggttacctagggacatagcaaaactcgctagagttacttcaagtaaggcacacggaggttgctctgattatcaagaaaaccaaacgttcacataaaatgtttgtcttccagccgccccgctgttttccactttttccaaaaagcactgaagcgtggtgaagaaacaaacatatcctcaattctcgcgagagctccgtgtgtaaccaagggctgaggcggaggattggtcactcaggatgaggagcctccgctatcccgcccccgttgccgggatacgccgcggcgcacggcagttagtgggtaggcctgagagccgaggaaaactgagcgtgggcctcagaaagaagttaaggcacccgcgagccgggcaactgccctccttccgcgccggcggaggtgagaatccccgggtcccatctcttcctccctccctcccacgtctgttctcttgccttggagatgctgatccgctccaaacaaaacaaattcaaactcggtcttagctaactgttaccgtcgggcctgtagccaggccaggcatgtaccaattctagtcgagcgaaggttgcgaacagacctcctccaacagcccgacccctccccgaccccccgcaggagacccgccaagcacagagcagagggaaggaccgcgatgggctgaaggattttagtcaaagcaatacatttctgcctcttacagtggaagggacttatttctgtctgttgatcacagtgcgggcagttagcaactttccacttattcacctgtgtgagaatggttggcttagggaggataacgatagtaataataattagaagcagatgttttaaatgtaatacttatcgtcttcacaacagccctgcaaggtagatgtcacccttctgttttacagaagatgaaatcctgaggggttaattaaggtggcaagattatgcagccgctaactttgtcagcactagtttgtatcgctaatcattctggatccaaaggccaggctgcctctctgtgtgaataattggaa

SEQ ID NO: 537 - DNA, 27421 bp, Homo sapiens
ccacctctctattttcaggaaagacacagagaacctatggttatgaactaaaacaaagataatgtagattctgaatatgtctagagacattgttcatttatagtcaggaatagctttacccttgacagagaactctgtgccagctgctgggtgctgagcacttttatttacattatgtcatgtattccccaccacaactactacatacatctctcttttttttttttttttcttgagacggagtctggctctgtcacccaggctggagtgcagtggcactatctcggctcactgcaacctccgcctcccagattcaagcaattttcctgcctcagcctcctgagtagcagggattacaggcgcccaccaccacgcctagctaatttttgtgtttttagttgggggggggggcgggggcgttcaccatgtaggccaggctggtctcgaactcctgacctcgtgatccgcccgcctcggcctcccaaagtgctggacttataggcgtgagccaccgcgcccagcctatgatagaaatcttattagctccatggttacaaacagacaaccctgaggcctggaggaaagtaacttcagaacagatactctcctggctgaactttatatttattgcactcttggcagtcgtccctagttgtctttttctttgatctctctctagttaagacttgctcctggaggcaaagcgtggtggtgtctggctcagcatagcacctgccataattacaaatggcaattatggaatgaatcagctgtttaaagcaccaaatcttgagctggcccgaagactgcgcaggaggattgcatgctcaactctcccctttagaaactgttaacaatcgttgtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaacaatcgttgtaactggaaatgtaactgttataccctcccccccttttatttatttatttttttgagagggagtttttgcgctgttgcccaagctggagtgtggtggcgcccagccctgttagccccttacagagtagatcagctgccgcaggcatctgagttccccaaacggacgcccgaacccggcattgcgcaaatcgtttccaagtagccccggcttatttatcccgtccgggagggagggacccagggaaggcccaccccacttggttcccgagaaatgcagagcctggcgtccactcccggtctgggggacccctccaccgccagcccaggaagtcagcgccgggccctcggggcggagcagggaagagggagcggttggcccggacgctcttccgggtcctgggaggagggcccggacctaagccccgcccctccggggtggagtcacggctcgcgactggcctaagtcgccgcaggtattgcagtccggggctggagggtaggggcgagggtccccggataccgggtctatcacggtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggtgagatttatccattcatctctcaatctattttctttcttcattcactagccactcccccacttctactccatgccaggtccattggtaggttctcggaatggatctgacaggcccagccctctaggaacttagtctagtggaatttaatctagaatctagtctagaagccttaaatagataaacattccaaatgattcctgcaatggtgatggctaataccttcagagcccagtgggtggaagaaggaagtaacttggatgtgggtggaagagaaaagggcaaatcagggaaggtttcaccagggaagggacttttgaactgggctttgaaggttaactaggagtttgcaaatttcccagaagggaagcgacattccaaataggggaagcagaacaggctgcaaaattatgaaaaggcctgccatattacaagaacagcaaaaaaaccaataatgcaagagattgtggaggtgagttcacgggaaaaaagctcaacagcagaaggccttactttctatgctatgttgaggccaagatttatcccagagctcagtatttctcagcttctttaaatattttgtcctttgagcggagagcagtggctcacacctgtaatcccagctttttaggaggctgaggtggaagaattgcctgaggctaggagttcgagaccagcctggacaacaaagcgaaacctccatttctatttttttttctttttttgaggaggagtcttgctctgtcgccaggctggagtgcaagtggcgcaatttcggctcactgcaacctccgcctcttgggttcaagcaattctcacgcctcagcctcctgagtagctgggactacaggcgtgggccacaacgcccagctaattttttttgtatttttagtaaagacagggtttcaccatgttggccaggatggtatcgatctgacctcatgatccgcctgcctcggcctcccaaagtgctgggattacaggcgtgagccactgctcccagccccgtttctatttttaattaaaaaataaataaatggccgggctcagtggctcacgcctgtaatcccagcactttgggaggccgaggcgagccaagttcaagaccagcctggcgaacatagtgaaaccccatccctacgaaaaatacaaaaaaaattagccaggtgtggtggcacttgcctgtagtcccagcttactctggaggctgaggcaggagaatagcttgaacccgggaggcagaggttgcagtgagctgagatcctgccactgcactccagcctgggtgacagagtgagactccatctcagaaaaaataaaaataaaaaataaagccaggcacggtggctcatgcctgtaatcccagcactttgggaggctgaggcgggcaaatcacctgaggtcaggagttagtgaccagcctggccagtgtggtaaaaccccgtctctactagaaaagctagaaaaatgagctgggcgtgggtgggcacctgtaatctcagctactcaggaggctgagaaaggagaatcatttaaacctgggaggggaaggttgcagtgagtggagattgcaccactgcactccaacctgtgcaacagagtgagactctatctaaaaataataataaagataaatacataggccaggcacggtggctcacacctgtaatcccagcactttgggaggctgaggcgggtggatcagctgaggtcaggagttcgagaccagcctgaccaacatggtgaaactccatctctactaaaaatagaaaaattagctgggcgtagtggcacatgcctgtaatccaagctactcgggaggctgagggaggagaatcgtttgaacctgggaggcagaggttgccatgagctgagatcttgccattgcactccagcctgggcaacgagagctaaactccatctcaaataaataaataaataaataaataataaaaataaagatgaaaagttggtgattcttattcaaatcaatcaggcctagaaattagtacattcaacaggaaaggtttaaaaaggaggttgaattgattaagatgataatcataagtgtctaaaaagtgcctttctttcttatgcataggacaccatgaagcaactgccagtcttggaacctggagacaagcccaggaaagcaacatggtctgtaaggaaggatccagacacagaaaagcatgagtttttgtttcatttataagtagtttatttacatatttgatcatcaacaaaaaggggtagagatgaaactgtctgcagtttctggtaattagactcaaactgtctgagaaagtcttcagaggaaagataggggggcagtaattatcacagagcagatgttaattttattaaaatccatttaccagaaagagtaaggcactgaccatctggcatcctcagctccaatgctgtgtcttcccccgagctctgactcatttttaagatttttaggaaattagatttggattaaactggcttcactgtttcttggctgtttgttcaaacaaccctttattcaacaactaacattggcctgatgggggcagctgctctgtgggtgctggaggtagaattgtaaatagtctctgtgtactggggactacagactaagcaggtgatggtgataaaatgtgatctgctctgagtcagggcccacagaaggttgtagagaggtggcagttcttcaacaggaccttgaaggagagactccagactggcttccatgcatctgtcttgctctgtacccagaatacagccaatcatggcatttcctagtttaaaacccttttgtgcctccctgttggtgttgggataaaaatcagactcctgggctgggcacggtggctcatgcctgtaatcccagcactttgggaggccaaggcgggtggatctcctgaggtcaggagtttgagaccagcctgaccaatatggtgaaaccccatctctactaaaaatacaaaaattagctggcatggtgttgtgcaactgtagtcccagctactagggaggctaagacaggagaattgcttgaatctgggaggcagaggttgcagtgagctgagatcatgccactgtactccagcatgggccacagagcaagaatccgtttcaaaaaaaaaaaaaaaaaaaaaggccgggcacggtggctcatgcctgtaatcccagcactttgggaggccgaggtgggcggatcacgaggtcaggagatcgagaccactctggctaacatggtgaaaccctgtctctactaaaaatacaaaaaattagccgggcgtggtggcgggcatctgtagtcccagctactctggaggctgaggcactccagcctgggcgacagagcgagactccatctcaaaaaaaaagaaaaatcagactcctgaccgggcgcaatagctcatgcctataatcctagcactttgggaggctgaggtgggtggatcacttgaagccaggagtttgagaccagtctggccaacatggcaaaaccccgtctctactaaaaatacaaaaattaaccgggagtggtggtgcatgcctgtaatcctggccactcgggaggctgaggcaggacaattcttgaacctgggaggtggaggttgcagcaagccgagatggtgccactgcactccagcctgggcgcaacagagggagactccgtctcaaacaaacaaacaaacaaattagacttcttaaactggcccaatggtccctgcaaaatgtttctgcctgtatttccaacctcaaatcccatgacttgttcctttgttctctttctcttctttattgtgccctttgcactgttccactcaggagctgttcatgctggtctctttgcctggactgctctttctgcctggagtgctctttccctccactttttgtccctctcttttcccagcttattttattttatttttgagacaagttcttcctctgtggctggccacccaggctggaatgcggtggtacaattgtggctcattatagcctcgacctcctggcctcaagtaaccttcccatctccatctcccaagtaactgggactgttggtgtgtactaccatgcccagctaatttttttttttagagacccagtctcgctatgttgcccaggctggtctcaaactcctgggctcaggcgatcctcccactctagcctcccaaagtgctgagattacaggtgtgagccaccacacctggcctacccagctaatttctactcatacttcagatctctctccaaatggtgcttcttcaggaagccttctctgaccaccctatctccctggctccttacagggtgagaccctcctaagacatgcatgtcctcatactatatattctgtactcctttctaccacaattgaagtgaaacagatagttgtgaaactgttgaatgtttcttttcccaactagtctgtaagggctatcaaggcagggacttttttttgttatatccaccatctctggatggctgtgtgcttttggtaaattacttaacctttcttagcttcagttcctccgttgtagaactcagatgatggtaacagctgttatcctcaaagcgtttttttagtttttgtttgtctttgaaacggagtctcactctgttggcaggttggagtgcagtggcacaatctcggctcactgcaacttccgcctcccgggttcaagcgatcctgcctcagcctcccaagtagctgggactataggtgcatgccaccacacccaggtaatttttgtatttttagtagagacggggtttcatcatgttgcccaggatggtctcaatctcttgacctcatgatctgcctgcctcggcctcccaatgtgctgggattacaggcgtgagccactgcgcccggccctcaaaggggttttatgtagattaagtgacatcagaatagagctctgaatgggaaacaaatttggcaaccactgatgaatatatagatgagtgataattgaagttatcactacagataacattaatcaggtaagcaaatgtaaagtgaggaaaagagaattgagaatgacggagagtcaggaggtggctggtaggaaaggagtcggagaaggaagcagaaaggacaaccagaaaagtgagtgcagaaccaaaggaagggatgtgggaaagcctggctgggagaaaggcacaagaagcgaggagaggtcaggagtctcaaacaccagagaggtcaaataagacagggcctgaaaaacagctacagaattttcttttccaatcaggaagcttcaagtgtgttttctcagtcagcattcagaatcactgtggagagtggaatgggctgggcgtggtgggcgcgtccctagcacttagggagaccagggcagaaggattgcttgaggctgggagttcaaggctggccaacatagtgaaaccccatctctactaaaaatacaaaaattagccaggcatggtggtgcgcgcctgtagtcccagctactcgggaggctgaggcaggagaatcacttgaagcctggaagtggaggttatggtgagccaagattgcaccactgcactccagcctgggcaacagagcgagactccgtctcaaaaaaaaaaaagagagagagagatagtggaatgaccgaattctgtatgtgatttttcagagtgctagctttggcttccatcagattgagctttgggggtaatctggaaaagctctgaaatcagtaaattctggataatttttttgatggagaggaatcactggctagtggcaagagccccagggctgttgattaccatgtggtggcacataaagctctcgccaccatttattgagtccttccctgccctgttttgacgtcttgtctcagtcttcacaatcatcttttgcagtaagaactgttgctgtccagccaggcacggtggctcacgcctgtaatcccagcaatttgggaagccgaggcgggcggatcacctgaggtcgggagttcgagaccagcctgaccaacatggagaaatcccatctctactaaaaatataaaattagccaggtgtggtggcacatgcctgtaatcccagctgctagggaggctgaggcaggagaatcgcttgaacccgggaggcggaggttgtagtgagccgagatcacgccattgcactccagcctgggcaacaagagcaaaactccatcttaaaaaaaaaaaaaaaagaaccattgctgtcctcatttcacaaatgagtaaactaaagttcagaaaggttaagtgacttccaaaaggtcacacatctaggaagtacctgagctcgaatttgaaccagatctgtctgaattcatacaccatgctcacagccaccatcctgtgccaagacccatcactgaacatttctggaggtcagtttccctatctaccaaatggggaaaaataagcccagtgcattcctaccagattactgtgagatgaagacagtgacaaaattgaaaagccaaagactgtgtgcaaaggggaggtactattattaatcagagaagtgctgctttattgggtacaatttaaagtgtctgcataaggctcttcattctggtgaatatttcatgaggaatggaaagagcacactactgcatttattctctgctcaggcctcctgaatacatccttcctttggcaggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggtaagatcagcagctgcagagtacatgccctatggccagagaacagggctgtgtgctgctagccatgagcagggcattcctaaaaacaccagcagggttttcctataagaaaacatggccaggaccaggtgtggtggctcacgcctctaatcccagcactttgggaggccaaggcaggtggatcacctgaggttagagttcgagaccagcctgaccaatatgatgaaaccctgtctctactaaaaatacaaaaaaattagccgggtgtggtagtgggcacctgtagtcccagctactcgggaggctgagacaggagaattactttgaactggggagatggaagttaaagtaagccaggatcatgccactgtactccggcctgggtgacagagcaagactctgtctcaaaaaaaaagaaaaaagaaaaagtcagcatcactgacagatccctcaggtttcttagtaggcccctggcacacattcatctgaccagtacctccttgtttagcgggagagaacccttatggagccctggttgtccagccatttattcatcaaatatttctgtaggatacattgatgactaccaccactcattctattcacatatccaatatatcactaagccctacatatctcttttctttgttttttgtttttgtttttttgagatggagtttcgctcttattgcccaggctggagtgcaatggcgcgatcttcactcattgcaacctctgcctcccaggttcaagagattctcctgcctcagcctccccaagtacttgggattacaggcatgtgccaccatgcccagctaattttttttttttttagacggagtcccactctgttgccaaggctggagtgcagtggcacgacctcagctgaccgcaacctgtgccttccaggttcaagcgattctcctgcctcagcctcctgagaagctgggattacaggcgcccaccactacacccagctaatcttttgtatttttagtagagactgagtttcaccatgttggccaggatggtctcgaactccagacctcatgattcacccttcttggcctcccaaagtgctgggattacaggtatgagccaccacgcccagcctacatatctcttatctttatccatgtctgtccatttccactactactactgtagtccaagccactgttatctctcaactagacttacaagagcctcctcaccagcctccctgcttccaagtttaccccctatacagtgcattttctctacctagccagcgaatatcatctaaaatacaaatctaaccatgtcactccctatttcagacttttctcaacctcccttttttttttttttttttgagaccaagtcttgctctgttgcccaggctggagtgcagtggtgctgcaaactcggcttactgcaacctctgcctcctgggttcaagcaattctcctgcctcagcctcctaaatagctgggattacaggtgtgcgccaccatgccctgctaatttttgtatttttagtagagatggggtttcacgatgttgatcaggctggtcttcaaatcctgacctggtgatcctcccgcctcatcctcccaaagtgctgggattatgcatgtgagtcaccacaccagccttttttttttgaggcagcgtgtcgctctgtcacccaggctggagtgcagtggcacaatcttggctcactgcaacctctgcctactgggttcaagcgattctcctgcctcagcctcctgaatagctgggattacaggcgcgtgccaccagcctggctaatttttgtatttttagtagagatgggggtttcaccatgttggccaggctggtctcaaacttctgacctcaagtgatctgcttgcatcagtctcccaaagtgctgggattacaggcgtgagccaccgagcccggccccaacctcatttcttggctctctccaacccacatttgctgcactggatatccttcagttccttgaacacagcttgagctctctggcctccatgcctttgcacacacagatccctctgctaggaatgtttttcccttttcttatcatctggcttctctatatctttcagatttcagattaaatgtcacttctaccaggaacctttcctgttacctctggactcgttcaggcactacatgactctgtatgtccgtagtctcatgtgctcttccatcctgtctgccttcacagccctatcacatgtgattgtttcttgtccgtctgccccacaagaacataagctcctcagaaacagatagcatattttcctcatcattgtatcccagacactaccacagggcttagtacagagtgggtgctctataagtatttaaatgaatgaatgaatgaacctgctaataagaaacaattggatctgggcgcagtggctcacgcctctaatcccagcactttgggaggctgaggcgggcggatcgctaggtcaagagatcgagaccatcctggctaacacggtgaaaccctgtctctactaaaaatacaaaaaattagccaggcgtggtggcgggcacctatagtcccagctactcggggaggctgaggcaggagaatggcgtgaatccgggaggcggagcttgcagtgagtggagatcgtgccactgcactccagcctgggtgacagagcaagtctccgtctcaaaaaaaaaaaaaaaaaaaaaggaaatgattattagctgggcgtggtgactcacgcctgtaatcccagcactttgggaggccgaggcaggcaaatcacaaggtcaggagatcgagaccatcctggccaacatggtgaaaccctgtctctactaaaaatacaaaaaaattagctgggcatgatggcttgtgcccgtagtcccagctgaggcaggagaattgcttgcatctgggaggcagaggttgcagtgagccaagattatgccactgcactccagtctggcaacagagcaagactccgtctcaaaaaaaaaaaaaaaagaaaataaaagaaacgattattctttgctctacacaagggcagaagttgaacaatggtgacccacttacgtattttgttaggtccatgtaacatttccctattgttttaatcttaagttttgtttttttttttgaaatggagtctcaaactgtcacccaggctggagtgcagaggcacgatcttggctcactgcaacctctgcctcctgggttaaagtgattctcctgggccgggcatggtggctcaccatgctgtaatcccagcactttgggaggccgaggtgggcggatcacgaggtcaggagattgagaccatcctggctaacacggtgaaaacccatctctactaaaaataaaaaaaaaaattagccaggcgtggtggcgggcgcctgtagtcccagctactcgggaggctgaggcaggagaatggcatgaacccgggaggcagagcttgcagtgagccgagatcgcgccactgcactccagcctgggtgatagggcgagacgccatctcaaaaaaaaaagaaagtgattctcctgcctcatactcccaagtagctggaactacaggcacgtgccaccatgccccgctaatttttgtatttttagtagagatgggttttcaccatgttggccaggagggtcttgaactcctaacctcaagtgatccacccacctcggcctccccaagtgctgggattacatgcgtgagccaccacgcccagcataatcttaaattgtttaccaaccaattatgcagaaatctacatataaaaatttaaatggtttggcttctcttgataatgttggaaaatctaatgtcagtaggcctccctgtctacatggcaacaattatttggaactgagctgccacctatcaagagggctcttattctccagtttgccacagtttttgttactcccacctaggcatttgaatttctactccctgcactaaaaaaatcaaaggtaggctggacgaggtgtaatcccccagcaccttgggaggccaaggcgggtgggtcacttgaggtcaggagtttgaggccagcccggccaatatggtgaaacccccatctctactaaaaatacaaaaattagccaggcatagtagctcacacttttaatcccagctacttgggaggctgaggcaggagaattgcttgaacctgggaggcagaggttgcagtgagccgagatcgcgccagtgcgctccagcctgggcaacagagcaagactccatctcaaaaaaaaaaaaaattcaaaggtaaattaaatcacttctagccctcaattacattaaattagttcaacttacatctttattgcaacctattaatagctttgtgaccctggctacaccatctcaaccatctggacctcagtgctctataaagtagggataataacttgcttcagatctaacaagataatgcctgtaaaggtcttgtgtaattggttaaccaagtaaaataattgttaataataaaggttagggttttttgtttgtttgtttgttttttgagacggagtcttactgtgtcacccaggctggagcgcaatctcagctcactgcaagctccacctcccgggttaatgccattctcctgcctcagcctcccaagcagctgggactacaggcgcctgccatcgcgcccagctaattttttgtatttttagtagagacagggtttcaccatgttagccaggatggtcttgatctcctgacctcatgatccgcccacctcggcctcccaaagtgctgggattacaggcatgagccacagcgcctgaccaaggttaggtattactattctgtgaacttgtcttagccagccatcatttatttgcaagtaacagaatctcacttaaaccagaggaaaaagggggaatttatttagtcagatacaggcgtgtttctttctttctttcttttttttttttttgagacagagtgttgctgtgttcccagactggagtacagtggcacaatcttggcttgctgcaacctccgcttggtttaccaagtaaaataaccctgggttcaagcgagtcccctacctcagcctcccgagtagctgggactacaggcacgtgccactatgcttggctaattttttgtattttagtagagatgaggtttcaccatgttggccaggatggattcgatctcctgacctcgtgatccgcccacctgggcctcccaaagtgctcggattacaggcgtgagccactgcacctggccaatacaggcgtgtttcaaagaattcaaggacaggaagtagagcccaggatcatgagaaagtggaagcacttgatctggttggctcattctggtttcattggctaccttcaacccaatcagctaaagctacaaagtcaaagcatagtacaaacatgtcatctgggatctatccttgtggttgacaaagtggggacagtttccatagaacggggtctatggactaggcagacagccccctaagtatctattatagaattttctggaggttgacaacatgccctttaagtgattcagtggttttcatttatgtttatggccctcttctcatgaccctcctcaagtgtgccaaccaatataataattggcagccccaatctaggaactgggtgaaatgttttccaggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctggtaagtagccaaaggttattttatttacgtacatacaaataaactttcatgcacacacacacacatatatataaatccaattataattccagtacatttggattatactaattaccatttaactttgctgacatagaaaataggaattttaacttgtagcataatctgaaaacaacagaataaaaacaattgttggtaacacatacaatttttaacttgttaaatgtcaaagctggaagggacttcagagaacagctatatcaagtgggctactcaggtttatcaagggcaaagtgactttcctaaagtcacaagaggccgggcatggtggcccatgcctgtaatcccagtactttgggaggctgaagaaggcagatcacttgaggtcaggagtttgagattggcctggccagcatggtaaaacccccatctctattaaaaatagaaaaattagctgggtgtagtggtgggcgcctataatcccagctactcaagaggctgaggcaggagaatcgcttgaacccgggaggcggagattgcagtgagctgggatcatgccactgcactccagcctgggcgacagagtgagactctgtctcaaaaaaaaaagaaaaagaaaaaaaaatttttttaaaaataaagtcacaagagagtcagtgactgagccaggcttagaacccaagtcacctagattagtagtcctccagtaaaggcgattgtgcccccgggggacatttggccatatctggaaacattttgggttatcacaactgggggtagcgtgggctactggcttctagggggtagaggccagatatgctgtatatatatcctgtcgtgcctaagacagccatcacagggaagaattgtctggtctaaaatgtcagtagtgccaaagttaagaaacactgacctggatcctcctagtatgtttcttttagccaaaagtacaaagttcctaacttgtctcactggcaagacattttgtttgttcgttttgtttgtttgtttttgtttttcatatcttgctgtttccatcactggcagttttattatagaggaagcagtttgggaacgtcgctactgagaggaggttgctaaaccacctgtggggaagtggacttgtctttttgccttttgtttgtttgtttttgtttttctctttacaaatattatttatgttcattgtaaaatatttgaaaagtacaaataagtggaaaaagtcatccacaatccattattatattaaggctattaccaattttctgtctttttttttttttttgtgacggagtttcactcttgttgcacaggctggagtgcagtggtgtgatctcggctcaccacaacctctgcctcccgggttcaagtgattctcctgcctcagcctcccaagtagctgggattacaggcatgcgccaccatgcctggctaattttgtatttttagcagagatggggtttctccatgttagccaggctggtctcaaattcttgatctcaggtgatccgcccacctcagcctcccaaaatgctgggattacaggcatcagccaatgtgaccggcccagctttctgtctttttcctgtcttttctctgtttttacaagcctgagatcatactatatttacacattcataactttttccttttaatttcataatcccaggagaaataggtgggttttttttttttggctttagcaaaaataattgatttgttattaataacaatgctttgttaatataatatcatttgtttgttttttttgggtttttttattgttggtaacttttttttttttcgaggcagggtctcactctgttgcccaggctgggatgcagtggtatgatcacagctcactgcagcctcgaccacccaggctcaggtgaacctcctacctcagcctcccaggtagctgggactacaggcgcttgccaccatgcctagctaatttttttgtattttttgtagagacagagttttgccatgttgcccaaggtggtctcaaactcctgggctcaagcaattttcctgcctcggcctcctgaagtgttgggattacagacatgagccactgcacctggccaacatcatttttaatggctgtatcatactccattatatataaaatactccataatatcataacttctccatttatgaacatttagttcttttcaggtttttaccattataattaacaaagcagtgaacatcttcattcagaagtcatagactgtatttcaaattattttcttagggttcctgccaagaaataaaaaggctaggtaaaatactgtgaaccttttcaaggttttgatacatactaccaaattgctctccagaaagatttttccggtttatcctctctccaactgtgtttaacagtgtttctttcattactgaccagcactgaatttatcagttttaaacattgctaatttgataggcaaaaaaacttgtacatagtttaaatatgcattttgggccggtgcggtggctcacacctgtaatcccagcactttgggaggctgaggtgtacagatcacctgaggtcaggagttccagagcagcctggccaacatggtgaaaccctgtcactactaaaaatacaaaaattagccaggcatggtggtgcatgcctgtagtcccagctgctgaggagggcgaggcaggaggatcgcttgaaccctggaggcagaggttgcaatgtgccgagatcatgccacagcctgagcaatgagtgagactctctctcaaaaaagcattttttgacctggacatttttcacatgtcagccaactcttgctcagttccctctatcaacaatatatttggggtgttgcccacctactacatttgttgagtattgcccgataaaaaaattaaaattaaaaaaaaaaactattgtacaatagttggtcagagttcaggaactaggaccaaattttcttatatgtcaagtatttaaattccttcagcacatttagacagtatgttatcttttaatttgatttatttgtttgggtatttatttcctgtcttccctcctcttccatgccctccctctgtggaacataagcgctttgaagggaagagtttgtttattgttgaatactcagggtacagaacactgtccgaaataaagtagacacggccgggcatggtggctcatgcctataatcccaacactttgggaggacgaggagggcggatcaaaaggtcaggagttccagaccagcctggccaacatactgaaagcccgtctctactaaaaatacaaaagaaaaaattagctgggcttggtggcaggtgcctgtggtcccagctacttgggaggctgaggcaggagaatcgcttgaacctgggaggtggaggttgcagtgagccgagatcgcgccactgcactccagcctgggtgacagagtgagacaccgtctcaaaaaaaaaaaaaaaagaagaaagtgatagagtagacacttggcagaccatttggctaattgtgaagccaatttgcttggaggactagcagtataatatggtgcttaagggcacagatgagggtctctgttttgctatgcactaactatgaccttggactagtgatttaacctctctctgcctctgttttctgtcacattggatagtaatagtttctaccttgttaatttgtcaaggatttaaataaactcagtatctggcacataattaatgctcagtaattgttgtggtagttgatgtagttaaggtttggcaaagggaaatcagttctggaaccctggccttttgattttcaacaatggtatccattgaaataaaataaagtgagaatttggaaagctgtcaaagagggtgattttattttatttatttatttatttatttttatttttgagacagtgtctcactgtgttgccaaggctggagtgcagtggcgcaatctcagctcactgcatcctccacctcttgggttcaaatgattctccagcctcagcctctcgagtagctgggattacaggcacatgccaccatgcccagctaatttttatattaaagagggtgattttctatcatatcccttttctctcctagaaaatataatttgacatcatgcccaagaaatatgaaatatgtacttagttgcatttgttaccaaggcaagtccctcaaatgctcaggactcctttgtgattctttgtgctggtgtttgagttggcaggaatacagccctagggtcttctgggcctggaggtgacatgtatacctttctagctccctctaagatccaaaagctctccaacatctgtaactatagagacagctacattttgctttggatataggctgagactttttcagtctccaggtccccatttgagtcccacacatattacagatgtttcctgtagcattttatatattggatgtagaccttttacaaaagacagaatttcttggtgtgttatggtagagcaagtgtgggactctgatagaactgagttcaggcccggcgcggtagctcacgcctgtaatctcagcactttgggaggccgaggcgggcagatcaggaggtcaggagctcgagaccatcctggctaacacggtgaaactccgtctctactaaaaaaaaaaaaaatacaaaaaattagccgggcatggtggcggatgcctgtagtcccagctgctcgggaggctgaagcaggagaatggcgtgaacccgggaggcggagcttgcaaagtgagccgagatcgcgccactgcactctgggctgggagccacagcgagactccgtctcaaaaaaaaaaaaaaaaaaaaaaaaaaagaactgagttcaaactcctgctctgctacgcacatatgctataacctgcaggaaaggatttaaatgtgcagagcttcagtttcctcatctaaaagtagagatacttccgctcacttcccaagcttgagtgaagacaccagggatggcagtgcccagggcaatgatgctgcccattgagggtgctcaattaatgcatctgcttctataaaacccaggttcatccttaaaagaaataagcttctatacatctatctaggtggtgaaattttattctccagtcagaggagtgggaattagaaagatcttggtgttactgaaagagtttaaattccaactcagccatttcttaggcatgtcactttatctgtctctctctctctctctttctctctctctttctttgccttattctgtaacccaggctggagttgcagtggtgtgatcttgactcactgcaacctcaaccgctgcaggctcagtatatcctcccacctaagcttctcaggtagctgggactataggcatacgccaccacacccgactaatttttttttgtatttttttgtagagacagggttttgccatgttgcccaggctggtctcaaactcctgggctcaagcaatccacctgccccagcctgctaaagtgttgggattacaggcatgagccaccgagcctggctagccatgtctcttttaaaaagttacttaatccatccctacttcaattctcttacctgtaaaatgcggaaattaatatttgtttagcatttactgtttagtagggactgttattactgctactgaaatgtaatagtattgtctttttttttttttcatttctttctttcttttttttttttttcaagatatggtcttactcttttacccaggctagagtgcaatggcacgatcatagttcattgcagcctcaaactcctgggctcaagcaatcctcctgccttggcttcccaaagtgctagggttacaggccttacagccactgtgctcagcctaattttttttaatttttaatttattttattttattattattattttttaagatgaagtctcgctttgtcaaccaggctggagtgcagtggcatgatctcagctcactgcatcctccgcctcctggttcaagtgattctcctgtctcagcctcctgagtagctgggattataggtccccaccacgacacctggctttatttatttatttatttatttttagtagagatgggatttcaccatgttggccaggctggtctagaactcctaccctcaagtgatccacccaccttggtctcccaaagtgctgggattacaagcgtgagccactgcacccctggctgattttttgtagagacaggatattgctttgtttcccagtctggtcacaaactcctgggctcaagcaatcctcctacctcgatttcccaaactgctgaggttacaggtgttagctgctgcacatggcctgcctactttcttttattggccacattttctgggaaatctggcacacctggactctggcatctagtgggaatgaatgttagcagatgttagggggagcgatagtgagcaaagtagaagagggttcagagaggatatttgaaggcctccaaaacaaattgacctcttttttttcttctttttttttaatatggagccttgctctgtcacccaggctggagtgcagtggtgcaatctcagctcactgcaaccttcacctcctgggttcaagcgattctcctgcctcaacctcctgaggagctgggattacaggtccccaccaccatacccggctaatttttcagatttttagtagagatggggttttaccccatgttggccaggctggtttcgaactcctgacctcaagtgatccgcccgccttggcctcccaaagtgctgggattacaggcatgagccacactgcacccagcctgactccattcttgtgcttacagcttttaaatcttggggattttggactgtcttggcaaatcctaagtatcatcttcattcttccttgatgtttgtgagtatgagatccctgcccaaaactatgctggcccccctggggattggagtttggaaactgacttcactcagccccagagtcaaggtcagaagcccctctacctggatattttaagtgcctgcattctctctggcccagaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaagtatggactggtgggcaccttggggctggtcagggccatcccagtttacacattacctaatataggaagcagaagttagaaaaggaaagcctgactaagtgtctcacttctagacttctttgttatatctcttagctgatatctttttcccacagcaaaattggcatttaaaaagggatagtgaggcctggcatggtggctcacacctgtaatcccagagctttggaaggctgaggcaggtggaccgcttaaggtcaggagttcgagaacagcctggccaacataccttttctctactaaaaacacaaaaattatccgggcatgatggtatgcacctgtaatcccagttactcaggaggctgaggcaggagaatcgcttaaacccaggaggaggaagtttcagtgagccaagattgggccactgcactcagcctgggcaacagagcaatactccatctcaaataaataaataaataaataaataaataaataaataaataaaactaaaaaggtaggccgggaacggtggctcacgtctgtgatcccagcactttgtgacgcccaggtgggaggatcacctgaggtcaggagtttgaaaccagcctggccatcatggcaaaaccccatctctactaaaaatacaaaaattggccgggtgcagcggtgggtgcctgtaatcccagctactcgggaggctgaggcaggagaatcacttgaacccgggaggcggaggtggcaatgaaccaagatcgtgccattgcactccagccttggcaacagagcgagactctctcaaaaactaaataaaaaaataaaaaggtataatgatcaagttaaaaagtttaaaccatacaatttataaagtaaaaaagtaaaagaaagaataagaaagacaaaaaacaaacagaagtaaaagattccccttcagcctttcctttccccgcctcaggtacatgcctgggtgattttttttctttttctttttttttttttgagatggagtctcgctctgttgcccaggctggagtgcagttgcccgatctcggctcactgcaacctccgcctcccgggttcaagcgattctcctgcctcggcctcccaactagctgggattaccagcatgcaccaacatgtccatctaattttttgcgtttttagtagagacagggtttcaccatgttggccaggctggtcttgaagcctgacctcaggtaatctgcccacttcagcctcccaaagtgctgggattacaggcttgagccactgcacccggccagatttttgtatttttattgtagagatgcagttttgccatgttgcccaggctggtctcaaactcatgagctcaagcaatctgcctgcctctgcctgcccacctctgccaccacactcagccaaaatttttaccttgcaaagtaaaattgggaaaattaagagatagcacattcccaagccagagtatttgggaaaaaaaaaaaaaaagacacatcacagtgtgacttttctctttccagaaagaatgggctttgtgattcttttaaagcagttttaaaagtttaaataatattggttttgaatatataaaactataaggaacaagaaaaaaaacatatgtatgtgtatatgtgtgtgtgtgtgtacatgtgtatgtactatcaccccaaaattaaattactgttaacatctcagtgtattatcaatcttttttttttaagaacagagataattcaaaccagatgtggtggctcacgcctgtaatgccaggactttgggaggctgaggagggcagattacttgaggtcaggagttcaagagcagcctgaccaacatagtgaaacctcgttgctactaaaaatacaaaaaattaactgggcgtggtgacgcacacctgtaatcccagctacttgggaggctgaggcatgagaatcacttgaaccccggaggcggaggttgcaatgagccgagatcttgccactgcactccagcctgggtgagggagcaagactctgtatcaaaaaaaaaaaaaaaaaaaaaaaaggacagagataattctatatgttacatttgcatcctatatttttcacttaagcattgttccatgcaatcagaaagtcttcaccagcattttgaaatgatgattattatataaatattagagtcagggtctcactgcattgccaaggctggtctcaaactcctagcctcaagtgatccttcagctttggtccctcaaagtgctgggattacaggcattgagccacaccacccggccttcaccatcatttttaataagtgcttaggccaggcgcggtggctcacgcctgtaatcccagcactttgggaggcagaggcgggtggatcatgaggtcaggagttcgagaccagcctggccaagatggtgaaaccctgtctctactaaaaatacaaaaatcagccaggaatggtggcgggcgcctataatcccagctactcaggaggctgaggcagcagaattgcttgaacccaggaggcagaggtgggtggattacctgaggtcaggtaatcctgggcaacatggtgaaaccctgtctctactaaaaatacaaaaaattagctggacgtggtggcaggtgcctgcctgccaccctctgctgcaatcccagctactagggaggctgaggcaggagaatcccttgaacctgggaggtggaggtagcagtgagctaagatcacgccactgcactctagcctgggtgacagagcaaggctctgtctcaaaaaaataaataaattttttaaaaagtgtgtaatatttcctcatggctatactaataattaaacctgctcatggacacttaggctatttccaatttttgtctattataaacaatactgtaatgaacaagccaggtatgctgactcatgcctataatcccatcggctcaggaggctggaggaccgcttgggcccaggagtttgaggatgtagtgagccataattgcaccactgcactccagcctttgcagtagagcgagaccctgactctaaaaaaaaaaaaaaaaaaaaaatgctataaggaacatatttatgcagaaaccatttcaggtaattttaaattaaattccttgggacactggggactccttgaacaaccagcaggcataccataaacagtaattcaaagacaaattgtttggcagacctttgtttcaaagagtttttgcaggctgggcgcagtggctcatgcccgtaatcctttgggaggccactttgggacaccaaagcaggtggatcccttgaggtcaggagttcaaaactagccttgacaacatgatgaaaccctgtttcaactgaaaatacaaaaaattatccaggcatggcggcaggtgcctataatcccagctactcgggaggctgaggcaggagaatcgcttctcctggaggaggcagaggttgcagtgagccaagatcgcaccactgcactccagcctgggcaacagagcaacactctatctcaaaaaacaaaaacaaaacaaaaaaaaaaaacaacagagtttttgcagtactcctttaagacttttctggtatatagaaatgattaattttccagaattctatatatgtacagctttgaagataagaagggttgcctgtagtaaaacgtaataatcatcatattcataactctcatgtattgggtacttttttttccttcatgctttatgtatattatctcatttaattcatacctcagctcttaaaagtaggtattgtcttttttttttttttttgagatgaagtcacgctctgttgcccaggctggagtgcaatgacacaatcttggctcactgcaacctccacctcccgggttcaagcaattctcctgcctcagcctcccgagtagcttggactgcaggcacatgccaccacgcctggctaatttttaaaatattcttagtagagatggggttttactgtgttagtcaggatggtctcgatctcctgacctcgtgatccgcccatcttggcctcccaaagtgctgggattacagtcataagccactgcgcccggccagtattgtctgtatccttattttacagccatagaaactgcagcttagagaagtaattggtgaaaggccacatagttatatagtgagataacctggtttcagctccaaatcccatattctaaccattatcctatactgccacatcaggagtccctgctaacttttatttaagactagtctgtttttttccccaaccccttcagcaaatcaattaagtctagcaggatgcagtggtgtgtgcctatagtcccagctacttgggaggctgaggtgggaggaccacttgagcctaggagttccagtccagcctggacaacatagcaagaccccatctctaaaaataataataagactgggtgtggtggctgacacctgcaatcccagcactttgggaggctgaggtgggtggatcacttgagcccaggagttcaagaccagcctgggcaacatggtcaatccctatctctactaaaaatacaaaaattagccaggcatgatggtgtgcacctataatcccagctatttgaaaggctgaggcaggagaattgcttgaacctgcgaggcagaggttgcagtgagagccaagatcgtgccattgcactccagcctaggcaacaagagcacaactccatctcaaaaaaaaaaaaatggctggatgcagtggctcatgcctgtaatcccagcactttgggaggcccaggggggtggatctcttatggtcaggagtttgagactagcctagccaacatggcaaaacctcagctttactacaaatatgaaaaaatttaggatgggcgcagtggctcatgcctataatcccaacactttgggaggctgagacaggtggatcattttaggtcaagagtttgagaccaggttggccaacatggtgaaaccccgtctctactaaaaatacaaaaattaagggccaggagtggtggctaacgcctgtaatcccagcactttgggaggccgaggcgggcagatcacgaggtcaggagatcgagaccatcctggctaacacggtgaaaccccgtatctactaaaaaacatacaaaaaattagccgggcttggtggtaggcacctgtaatcccagctacttgggaggctgaggcagttgactcacttgaacctgggaggcggaggttgcagtgagctgagattgcaccattacactccagcctgggtgacagaggaagactctgtttcaaaaaaaaaaaagaaaaagaaaaagaaaaaaaaaaaatttagctgggcgtggtggtgcacacttgtaatcccagctactcaggaggctgaggcaggagaatcgcttgaacctggaaggcagaggttgcagcaagccaagatcgcaccactgcactccagcctgggtaagagagtaagactttgtctcaaaaaaaaaaaaaaaaaattagctgggtgtggttttgggtgcctgtaatcccacctactcaggaggctgaggcaggagaatcacttgaacctgggaggtggaggttgcagtgggcgaagatcgcacttgtgcatcctagcctgagcaacagagcaaaactctgtcccccgaccccctgcaaaaaaaaaaaaaaag

SEQ ID NO: 538 - DNA, 27483 bp, Homo sapiens
tgttccaggagaaacaagtcattaagaaacctcacataattttattttaaattcatgacagaaagatttttttaatgagggaaattgttgaaatacctccagctaatacgcttttataaaattccaaattaatatttgcagaatattccaccattattccaaatgaaagtttggcagagtttttgaagtaccgtcttcaaatttgaataagaactctgtgaaggcgggaatcattttgtctcattgctcagtatgttgcctgatacgaagtcagtgctcaataaatatttgttggataaatttaatgaaaatatatgaatgagatttagcaatgaatgttttaagtaacccccattcctagtactgtctttcatacatggtgggcctttcttgagggaaatttagcagtataatcaaagcctttaaaatgagcatgtattttatctggtatttcttcatgtagacatttattccaagaaagaaatcaaagatgtgtgcaaagagaagtcttagccagaacaatcaggcaagagaaaaaaagggcattcaaattggaaagaaggaagtcaaactatctgtttgcccaccatatgatcttataccttgaaaaccctagagactccttcaaaagactcctagatttgataaatgaattcagtatactctcaggttacaaaatcagtatacacaaatcaatagcactgctatacaccaacaacaaccaagctgagaattaaatcaagaactcaatcccttttacaatagctacaaaaaataaaataccaaagaatatacgtaaccaaggtcgagaaagatctctacaaggagaactacagaacactgctgaaagaaatcatagatgacacaaacaaatggaaatacatccaaagcaatcctaagcaaaatgaacaaatctagaggaatcatattacctgacttcaaattatattacaaggttatagtaaccaaaacagcatggtattgacagagaagtaggtacttagaccaatggaacagaatagagaacccagaaataaaaccaaatacttaagaccaactgatcgtcaacaaagcacacaaaaacataaactggggaaaggataccctattcaaaaaatgatgctgagaaaattggatatccaaatgtagaataatgaaactgcattcatatctctcattatatacgaaaattaagatagattaaagattttaatctaagacctgaaattataaaaattctacaacacttaggaaaaacccttctggacattggcctagacaaagaatctgtgactaagatctcaaaccaaatgcaacaaaaatacataagtgggacctaattaaagtaaaagtcttgtgcacagcaaaagaaagaatcaacagagtaaacagcctacagaatgggagaaagtatttgcaaactacgcatctaacagaggactaatatactgagtctgcaaggaactcagatcagcaaggaaaaaacaattccgttaaaaagtggacaaatgacatggacatttctcaaaagaagatatgcatacaaatggccaatacgcatataagaaaatgttcaacatcactaatactcagggaaatgcatattaaaaccacaatgatttaccaacttagctagaatggtcattatggaaaagtcaaaaaacaatacgtgctgacatagatgtggggaaaagagaactcatactttttttttttctttaacttaaaaaaattttttttattatgctttaagttctagggtatgcacaacatgcagctttcttacataggtatacatgcgccatgtcggtttgctgcacccatcaactcgtcatttacattaggcatatctcctaatgctatccctcccccagacccccaccccctgacaggccctggtgtgatgttccccaccatgtgtccatgtgttccttgttcagctcccacttaagagtgagaacatgcaatgtttggttttctttccttatggtagtttgctgagaatgatggtttccagcttcatccatgtccctgcaaaggacatgaactcatctttttttatggctgcataccattccatgatgtatatgtgccacgttttcttaattcagtctatcattgatggacatttgggttggttccaagtctttgctattgtgaatagtgccacaataaacatacgtgtgcatctgtctttatagcagcatgatttataatcgttcgggtatgtacccagtaatgggatggctgggtcaaatggtatttctagttctagatccttgaggaatcgccacgctgtcttccacaatggttgaactagtttacagtcccaccaacaatgtagaagtgttaactatttctccacatcctctccagcacctgttgtttcctgactttttaaggatcgccattctaactggtgtgagatggtatctccttgtggttttgatttgcatttgacggccagtgatgatgagcattttttcatatgtttgttggatgcataaatgtcttcttttgagaagtgtctgttcatatccttcgcccactttttgatggggttgtttgtttttttcttgtaaatttgcttgagtactttgtagattctggatattagccctttatcagatgagtagattgcaaacattttctcccattctgtaggttgcctgttcactccgatggtagtttcttttgctgtgcagaagctctttagtttaattagatcccatttgtcaattttgtcttttgttgccattgcttttggtgttttagacatgaagtccttgcccatgcctatgtcctgaatggtgttgcctgggtttccttctagggtttttatggttttacgactatcatttaagtctttaatccatcttgaattaatttttatgtaaggtgtaaggaagggatccagtttcagctttctacatatggctagccagttttcccagcaccatttattatatagagaatcctatccccatttcttgtttttgtcaggtttgtcaaagatcagatggttgaagatgtgtgttattatttctgagggctctggtctgtcctattggtctatatctctgttttggtaccagtaccatgctgttttggttactgtagccttgtagtatagtttgaagtcaggtagcatgatgtctccagctttgctttttggcttaggattgacttggcaatgggggctcttttttgtttccatacgaactttaaagtagttttttccaattctgtaaagaaagtcattggtagcttgatggggctggcattgaatctataaattaccttgggcagtatggccattttcatgatactgattcttcctatcgatgagcatggaatgttcttccatttgtttgtgtcctcttttatttcgttgagcagtggtttgtggttcttgaagaggtccttcacatcccttgtaagttggattcctagctattttattctctttgaagcaattgtgaatgggcgttcactcatgatttggctctctgtttatctgttattggtgtataagaatgcttgtgatttttggacattgattttgtatcctgagactttgctgaagttgcttatcagcttgagattctgggctgagacgatggtgttttctaaatatacaatcttgtcatcttcaaacagggacaatttgacttcctcttttcctaattgaataccctttatttctttctccttcctgattgccctggccagaacttccaatactatgttgaatagaagtggcgagagagggcatccctgtgttgtgctggttttcaaagggagtgcttccagtttttgtccattcagtaatgatattggctgtgggtttgtcataaatagctctcattattttgagatacgttccatcaatgctgaatttattgagtttttagcatgaagagctgttgaattttgtcaaaggccttttctgcatctattgagataatcatgtggtttttgtcattggttctgtttatatgctggattacatttattgctttgcgtatgttgaaccagccttgcatcccagggatgaagcccacttgatcatggtggataagctttttgatgtgctgctggattcagtttgccagtattttattgaggatttttgcatcaatgttcatcagggatattggtctaaaattctcttttttgttgtgtctcacaggctctggtatcaggatgatgctggcctcataaaatgagttagggaggattccctctttttctattgattggaatggtttcagaaggaatggtaccagctcctccttgtacctctggtagaatttggctgtgaatccgtctggtcctggactttttttggttggtaggctattaattattgcctcaatttcagagcctgttattggtctattcaggaatgcaacttcttcctggtttagtcttgggagggtatatgtgtcgaggaatttatccgtttcttctagattttctagtttatttgcatagaggtgtttatagtattgtctgatggtagtttgtatttctgtgggatcagtggtgatatcccctttataactttttattgcgtctatttgattcttctctcttttcctctttattagtcttgctagcggtctatcaattttgttgatcttttcaaaaaaccagctcctggattcattgattttttttgaagggttttttgtgtctctatttccttcatttctgctctgatcttagttatttcttgctttctgctagcttttgaatgtgtttgttcttgcttctctagttcttttaactgtgatgttagggtgtcaattttagatctttcctgctttctcttgtgggcatttagtgctataaatttccctctacacactgcttgaaatgtgtccctgagatactggtatgttgtatgtttgttctcattggtttcaaagaacatctttatttctgccttcatttcgttatgtacccagtagtcattcaggagcaggttattcagtttccatgtagttgagtgattttgagtgagtttctgaatcctgagttccaatttgattgcactgtggtctgagagacagttccttgtaatttctgttcttttacatttgctaaggagtgctttacttccaactatgtggtcaattttggattaagtgcggtgtggtgctgagaagaatgtatattctgttgatttggggtggagagttctgtagatgtctattaggtcctcatggtgcagagctgagttcaattcctggatatcctggttaactttctgtcttgttgatctgtctaatgttgacagtggggtgttaaagtctcccattattattgttttggagtctaagtctctttgtaggtctctaaggacttgctttatgaatctggttgctcctgtattgtgtgcatatgtatttaggatagttagctcttcttgttgaattgatccctttaccattatgtaatggccttctttgtctcttttgatctttgttggtttaaagtctgttttatcacagactagggttgcaacccctgccttttttttgttttccatttgcttgataaatcttcctctatccctttattttgagcctatgtgtgtctctgcatgtgagatgggtctcctaaatacagcacactcttgggtcttgactctttatccaatttgccagtctgtgtcttttagttggagcatttagcccatttacatttaaggttaatattgttatgtgtgaatttggtcctgtcattatgatgttagctggttattttgctcgttagttgatgcggtttgttcctagcgttggtggtctttacaatttggcatgtttttacagtggctggtaccggttgttcctttccatgtttagtgcttccttcaggagctcttgtagggcagggctggtgttgacaaaatctctcagcatttgcttgtctataaaggattttatttctccttcacttatgaatcttagtttggctggatatgaaattctgggttgaaaattcttttctttaagaatgttgaatattggcccccactctcttctggcttttagagtttctgccgagagatcagctgttagtgtgatgagcttccctttgtgggtaacccgacctttctctctggctgcccttaacattttttccttcatttcaactttggtgaatctgacaattatgtgtctttgagttgctctttttgaagaatacctttgtggtggtctctgtatttcctgaatttgaatgttggcctgccttgctaggttgaggaagttctcctggataatatcctgcagagtgttttctgacttggttccattctccccatcactttcaggtacaccaatcagacgtagatttggtcttttcacatagtcccatatttcttggaggctttgttcatttcgttttactcttttttctctaaaattctcttcttgcttcatttcattcatttaatcttcagtcactgataccctttcttccagttgatcaaatcagctactgaagcttgtgcattcgtcacatagttctcatgccatggtttgcagctccatcaggtcatttaagaacttctctgcattggctattctagttagccattcgtctaatcttttgtcaaggtttttagcttctttgtgatgggttccaacttcctcctttagctcggagaattctgatcatctgaagccttcttctctcaactcatcaaagtcattctctgtccagctttgttccattgctggggaggagctgcattcctttggagggggagaggtgctctgatttttagaattttcagcttttctgctctgtttttttccccatctttgtggttttatctacctttggtctttgatgatggtgacgtacagatgggtttttggtgtggatgtcctttctgtttgttagttttccttctaacagtcaggaccctcagctgcaggtctgtaggagtttgctggaggtccactccagaccgtttgcctgggtatcagcagcagaggctgcagaacagtgaatattgctgaacagcaaatgttgctgcctgatcgttcctctggaagcttcatctcaggggtacctggctatgtaaggtgtcagcctgcccttactgggggttgcctcccagttaggctactcggggatcagggacccacttgaggaggcagtctgtccgttctcagttctcaaactccgtgctgggagaactgctactgtcttcaaagctatcagacagggacatttaagtctgcagagatttctgctgccttttgtttggctatgccctgcccccggaggtggattctagaggcaagcagtccttgagctgtggtggactccacctagtttgagcttccaggtggctttgttacctactcaagcctcagcaatggcgggcacccctcccccgccagcctcactgccgccttgcagttcgatctcagactgctgtgctagcaatgagtgaagctccgtgagcgtgggaccctccaagccaggtgcggaatataatctcatgttgtgccatttgctaaggccattggaaaagtgcagtattagggtgggagtgacccgattttccaggtgctgtttgtcacagattcccttggctaggaaagggaattccctgaccccttgcatttcccaagtgaggcaatgccttgccctgctttggctcacactcagtgggctgcacccactgtcctgcacccactatccaacaagccccagtgagatgaacccagtacctcagttggaaatgcagaaatcacccatcttctgcatcgctcgcactgggagctgtagactggagccatttctatttggccatcttggaaccccacccctgatttttgctcattgattttgtgtcctgagactttgctgaagttgcttatcagcttaaggagattttggactgagactttggggttttctttttttttttttttttttttttttgagacggagtctcgctctgtcacccaggctggagtgcagtggcgggatctcggctcactgcaagctccgcctcccaggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccacctcggcctcccaaagtgctgggattacaggcgtgagccaccgcgcccggccggggttttctaaatatacaatcatgtcatctgccaacaggacaatttgactttctcttttcctaattgaataccctttatttctctctcttgcctgacggccctggccaaaacttccaacactgtgttgaataggagtggtaagagagggcatccctgtcttgtgccagttttcaaagggaatgcttccagtttttcttattccgtatgagattggctgtgggtttgtcataaatagcccttaatattttgagatacattctgttgatacctagtgttttgagagtttttagcatgaagcgctgttgaattttctcgaaggccttttctgcatctattgagataatcatgtggtttttgtcgttgcttctgtttatgtgatggattaggtttattgatttgtgtacattgaaccagccttgcatcccaaggatgaagccaacttgatcatggtggataagctttttgatgtgctgctgggttcggtttgccagtattttattgaggattttcgcattgatgttcgtcagggatattggcctagaattctctttttgttgttgttgttgttgttgtatctctgccaggctttggtatcaggatgatgctagcatcatggaatgagttagagaggattccctctttttctattgaatggaattgtttcagaaggaatggtaccagctcctctttgtacctctggtagaattgagctgtgaatccacctcgtcctggactttttttggttggtaagcaattaattattgcctcattttcaggacctgttactggtctattcagagattcaaattcttcctgttttagtcttgggagcatgtatgtgtccaggaatttatccatttcttctagattttctagtttatttgcatagaattgtttatagtattgtctgatggtaatttgtatttctgtgggatcagtagtgatatcccctttagcatttttttattgcgtctatttgattcttccctcatttcttctttattggttttgctagcggtctatttatattgtagattctttcaaaaaaaaaaaaaccagctcctggattcattgatttttttgaagggtattttgtgtctctatctctgtcatttctgctctgatcttagttatttcttgccttgtgctagctcttgaatgtgtttgctcctggttctctagttctttttattgtgatgttagggtgtccattttagatccttcctgctttctcttgtgggcatttagtgctataaatttccctctccacactgttttaagtgtgtcccagagattctgatacattatgtctgtgttctcattggtttcaaagaacatctttatttctgccttcatttcgttatgtacccagtagtcattcaggagcaggtttttcagtttccatgtagttgtgtggttttgagcgagtttcttaatcctgaattctaatttgattgcactgtggtctgagagacagtttcttgtgttttctgttcttttgcatttgctgaggagtgttttacttctcattatatggtcaattttagaataagtacgatatgctgagaagaatatatattctgtcgatttggggtggagagttctgttgatgtctattaggtctggttggtccagagctgagttcaagtccttgatatccttgttaaccttctgtctcgttgatctaatattgacagtggggtgttaaagtctcccattattattgtgtgggagtctaagtctctttgtagctctctaaggacttgctttatgaatctgggtgcttttgtattgggtgcatacctatttaggatagttagctcttcttgttgaattgatccctttaccattatgtaatggccttctttgtctcttttgatctttgttggtttaaagtctattttatcagagactaggattgcaacccctgcctttttttgttttccatttgcttggtagatcttcctctatccctttattttgagcctgtgtgtgtctttgcacatgagatgggtctcctgagtacagtacaccaatgggtcttgactctttatccagtttggcaatctgtgtcttttaattggggcatttagcccatttacatttaaggttgatattgttatgtgtaaatttgatcctgccattatgacgttagctggttattttgcccgttaattgatgcagtttcttcatagcgtcaatggtgtttacaatttggtatgtttttgcagtgtctggtgctagttgttcctttccatgtttagtgcttcctttagaagctcttgtaaggcaggcctggtgttgacaaaatctctcagcatttgcttgtctataaaggattttatttctccttcacttacgaatcttaatttggctggatatgaaattctggattgaaaattcttttctttaggaatgttgaatattggcccccactctcttctggcttgtagggtttctgccaagagatccactgttagtctgatgggcttccctttgtgggtaaccgtacctttctctctggctgcccttaatatttttttcttcatttcaactttggtgaatctgacaattatgtgtcttgcggttgctcttctcgaggagtatctttgtggtgttctccgtatttcctgaatttgaatgttggccgtctttgctaggttggggaagttctcctcaataatatcctgaagagtgttttctaacttggatccattctcccagtcactttcaggtacagtacactaatcagacatagatttggtcttttcacatagtcccatatttcttggaggctttgttcatttcttttcagttttttttcctctaattttgtcttctcgctttatttcattaatttaatcttcaatcactgatatccttcctttcttccacttgatccagtcggctattgaagcttgtgcgtgcgtcacgaagttctcgtgctgtggttttgaactccatgaggtcatttaaggacttctctacactgtttattctaattagccattcgtctaaccttttttgaaggtttttagcttctttgcaatggattagaacattctccttagctcagtgaagttttttattaccaaccttctgaagtctacttctgttaatttgtcaaactcattctccatccagttttgttccattgctggcgaggagctgcagtcctttggaggagaataggcactctggtttttggaattttcagcttttctgctctggtttctccccatctttgtggttttatctacctttggtctttgatgttggtgacctacgatgaggttttggtgtgcatgtgctttttgttgatgttgatgctattcctttctgtttgttagttttccttctaacagtcgggcttcttcgctgcaggtcttttggaggttgctggaggtccacttcagaccctgtttgcctaggaatcaccagcggaggctgcagaacagcaaatattgctgcctgatttttgctctggaagctttgtcctaaaggggcaaccccctgtatgaggtgtctcttggcccctactgggaggtgtctcccagttaggctactcgggggtcagggacccacttgaggaggcagtctgtcccttctcagagcttgaacaccatgctgggagaacgactctctcttcagagctgtcagacagggacgttaaggtctgccaaagctgtctgctgccattttttctgatatgccctgcccagagaggttggatctagagaggcagtaggccttgctgagatgtggtggactccacccatttcgagcttccaggcctctttgtttacactgtcagcacaaaaccgcctcctcaagcctcagcaattgcggatacccctccacctgccaagctgcagctcatggcaggtcaatctcagactgctgcgctagcagtgagcaaggctccgttggcttgggacctgctcagccaggcacgggaggatatttcctggtctgccgattgcaaagacttggggaaaagcgcagtatttaggcaggagtgtaccactcctccaggtacagactgtcacgacttcccttggctaggaaaggaaaatcccccgatcccttgtgcttcccgggtgaagcaacgccccaccctgctttggtttgccctccatgcactgcacccactgcccaacccgccacattgagatgaaccaggtacctcagttggaaatgcagaaatcacccatcttctgtgtcgatcttgctgggagctgtagaccagagctgttcctatttggccatcttggaacttaactcttacaaagacgtacagagtgttataatgggcattggagactcagagggaggaaggataggagggcagtgagggatgcaaaactacctattgggtacaatgtacactgcttgggtgatgggtacactaaaattcactgttgagtgagaatgcaaattagtacaacctatatggaaacagtatggagatttctcaaagaactgaaagtagaaatatcatttcatccagcaatcccactacaggatatctacccaaaggaaaagaagtcattatattaaaaagatacctgcacacatgtttatcacagtatcattcagaattgcaaagacatggaatcaaccttagtgcccatcaaccaatgaatgaagaaaattgagtgtgtgtgtgtgtgtgtgtgtgtatctatatatacacacacaccatagaatactactcagccataaaaaagaatgaggacatcttcctaagtgaagtaactcaggaacggaaatccaagtgccacatattgtcacttataagtgggagctaagctgtgcgtacacagaggcatgcagagtggtataatggacattggagactcggagggaggacaggaggatggggagggatgaaaaactatctgttgggtacaatgtacactacttgggtgatgggtacactaaaatcctggacttcaccattacacaatgtatccatgtaacaacaacaacaaaaaaatcacttgtacccctaaagctattgaaataaaaacattaaaagaaataggtcggacatggtggctcacacctgtaatcccagcactctgggaggccaaggtgggcagatcacgaggtcaggagattgagaccatcctggctaatatggtgaaaccccatctctactgaaaatacaaaaaaaattagccaggcattgtggcgggcgcctgtagtcccatctacttgggaggctgaggcaggagaatggcgtgaaccgggaggtggagcttgcagtgagccaagatcacgccactgcactccagcctgggcaacagagcgagactccatctcaatagataaataaataaataaataaataaataaataaataaatagatatgagctattaagctatgaaaagatgaaaaaagttgcaaaagtttaaagatagtcattgcattgtttaaagttattttaaaaaaacaaataatacacacttgtttgcataaagaaaaagttgtctatgaattccaccacccagagatgactattaacagtgtctgtctacctgtatacacattttttacaatgttgtttagagtgaaaaattgtagacaacctgaaagtctgtcaataggaaattagttaagtaaattacacttcaccattgaaaagtgttcaccttatatgattcagtttaaagagtaggccaagcaactataaagtagttttcccctacttccttcaaaaaaatatgaaaacttgaacattaagactctataaaaactgccaattttttgcagacaatagagggaaaaagagcatgttaagtgtccatgtaggtgctagtagaaaaatgaagactttggaaaagaaactctgtaggacaactgacccagtttctttaaaaataaaattgcagataggaaacaagatggtagggggagcttgaaaatagatttgagacacaccgggtatttgtaacgtacagaccttacttggatttctattcaaaccaaattttaagaagtatattgccaatgtattaatatttgttgaagctaggtgatagctaaatggaattcattacacctctctacttttgtatatgtttgaaactgtctataaaatttttttttaaagcagtttacaaaacaaggtaatgttttgtcagtgtatagctggagttagaaagttacaggtgtttttcttttttttctttaatttctgttttttctatgacttccaatgggtttttatttttaaatcataattggaataattattatacactttaaatattgaaacatcttcagtgtccagcatgaatttatctttaccttttatgtaagtgtatgttctcaagtttttcaagattatttataatacatttatattctacttttaatcccaaatatattcatgaagtctacttgaattgttaggaattcagagataataatattgacatttgtgtataattttatattcttgtttcagattcccaaatgctggaaaatcctctttgctaagttgtgtttctcatgcaaaacctgcaattgcagattacgcatgtaagtgtaatttgattgtacattttaatgagtggaggtaaacttttaaagactaatatttctctgagaatgaataaaatgataactcggagggtatccttaactgaaaaatttttggcagatagactactgttgcacaggccaaagtgcagttgcatgatcatggctcactgcagcccaggctcaagccatccccctgcatcagcctcccatgtagatgggactacaggtatgtgccaccatgcttggctaactttttttttttttttgtggggacaggggtttcgccatgttgcccaggctggtcttgaactcctaggctcaagtgatctcccaccttggccttctaaattgctgggttataggtgtgagccaccctccccagccatattttccattaatctttgaaacctctatacccctcagcaaagttgcttaaacaggttagacacttactttattgcatttatttttctgtcacagaatcgtttatttggtttagttaggattttatgaaccacttaccttttatcaggcactgtgataagtaccaggaaggtacttatcattcatttagcagatacttatttttggagccacattaggttctgggattacaaagactgataaacagaaacagctcctgttttgacttgtattgagtttgtagactagtggagtaaggcgtacatatcactaataaatataagggaatatgaaagggtactatgaaagagtatagatgactgctctaggcttccttaaggatgtgtgatttttggactgggatatgaggaataattatgaggtaattagtaaaatagagtggagggtgaagggtctttaatcagaggaaatagtatgtacacaaagccttagtggtggcagggagtagatttgtgtgtctagagaacatgaaataagggaaagaatcgagatgagcctggagatgtaagagagcatgtcacatagaccatttaggctgtatttgatttttatatcttaagagcaattggaagcatttaagcaagggataaaatgcttaggtttgctcctcacagagatctcggcctgtaatgtagaaaatggattggtgtgggacatgaagggtctgagacaaccagttagtaggctcttgtggtagctagatgagatataaaagaagctttggttaaaagtagtgagtatgataagatctctgccatcattaaaaggacacagaatgccattaacttggaaaataaaatcaagccattctaaaattagactgtgacgaagtagagtgaagtttggactaagtgctataaatcacaaggccaatatttgttataatatatgtaggacttgagaaggaagagcaaaaagtcataggaaagaggctagcgtaggattgatgaggcttaaggataacaatgagaaggaactagaggataactgaatgagaaggaactagaaaaatttcagccacagatccagtgatagaaacttaatatctgaccctcctgaacatctatcactcaccttaaagtgcaatagaagaacgttgaggttcagtaattacattaggcctatacagattataaaaatctgtgtttgtctttttccaaatactatttattcatttattttagagacagggtctagctatgtcacccaggcaggagtacagtggcatgatcatacctcactgtaactttgaactcctgggctcaagcaatcctcccacctcagcctctggagtagctaggactacaggtgcactgccatgtctgcctagttttacattttttgtagaaacagggtctcactatgctgcccaggctcatcttgaactcctagcttcaaatgatcctcctgccttggcttcccaaagcattgggattacagacatgagccacaacatttggccctccaagtacatattaaatagcaaagataataatagtttccattttagcaaattagaacaaaatctgaattgaaatattgtttatgcataataccaagacagttttgagagtaccagccctaaaataaattctagccttaatttattgctgtgtttccttttagttacaacattaaagcctgaacttggaaagataatgtacagtgatttcaaacaggtaggtatttttaaagtaaaacactatattagaagtcaaaagtacttggttttggtacgtacttggatattatagtttttgcctgtttctgtggtgttaggggagaaaaagtaacaagattttgtttatgctaagtgaaactggtcaaattaattctgagcactatcataatatatttaatttcttcttccaaagattaggtccagtttatccctacaacattatgtcttcttcttagccttagtttcttcttattgcaagtctttcttttactactatattggattatttatcttcattttttaaaaatgctctctaaagttcatggtaatgattttattccaacttttctttttttgagaaagaaaatgttttaatggagttttggtctcaaccagctattaaaattcattttttccttcacaagtaacaacagtggatcttctgtataattagaaaaaaactaaaaaaaggaaagtaacaatatttaaaatataatgtacaatctagtagttgtgctccttagcatttacccatgtacattgaaaagttatgcacacacagaagtctgcacatggatgcttatagcagctttatttgtaattaccaaaccttggccaagatatctttcagtaggtgaatgggtaaataaactgtgatatatatttagacagtggattattattcagctctaaaaagaactgggctatcaagcctcaaaaagacctaggggaaccttaaatgcgtaatactaagtgagagaagccaatctgaaaagactgtgtgatactgtatgattctaactatatgacattctggataaggcaaagctgtggagacagtaaaaaaaaaaaatgaatgatttccagggttagggaggaaggagagatgaataagcagagtacagagaacttttagggtacactataaagtacaatacatatagtaaagtatgatactatataatattacagcaacattgtgttgctgtaatggtagacacagtatacatttgttaaaatccatagaatgtacagcaccaagaatgcaacaatgtaaagtatagactttgggtgctaacgatgcatcaatatgggttcatacagttttatgacataatttaaagaaacataaaaaagtatttggttataatagtgataataacagtaaaagataaaaccagttataatatagaatgttaactgtaagtaaaattgtattaaatataggataatatgaatatatagaacaatatttagaggaaaagagaacatcatttataccgaatttttaagggaaatcagtagaggaaatttcaggacatgagacttctgttgtgcatgctgctttgtcagcttcctttaagaccctgaattatttatctacactgggcaagggatgtcgagtactgcctctcattctttattgcacttcagaattatctgggtggtctaagaacagcaatgatgagtgatgcttaggccccagagatttgaaactaaatctcttgggggtagggcctgggcatttgtagcttctaagagttccctacgtgattatgatgcacagtgaggtttgaaaagcacaagtggccgggtgtggtggcttacacctgtaatcccagcactttgggaggccaaggcaggcagatcacgaggttaggagatcgagaccatcctggctaacatggtgaaaccctgtctctactaaaaatacaaaaaaaaaaaaaaattagatgggtgtggtggtgggtgcctgtagtcccagctactccagaggctgaggcgggagaatggcgtgaacctgggaggtggagcttgcagtaagccaagattgccccactccactccaggctgggcgacagagcgagactctctcaaaaaaagaaaagaaaagcacaagtgtaaaatgatggttaataatgattattccctctaaaaggagtctaggaaactgtattcttttattatgttggtacaaaagtaactgtggttttggccattaaaagtaatggccaaaagtaggagaaagtaggagagccacaactacaacttgggtttgtcgagtgctgtttcacctgactgatcttacttgaatactggcacaaaatgagatgatgacaaggtgacaaggaagcatgctcaggtgaatgaacttctagatgatagaactctgctcctcatgtaatgccatgagatttgcttaagtataaacaataatgacctacaaaaatgtgaagcattaacaaacatggcactgcaaagaacaggtgaggagaatcacacctctattaatgtagtaaagtctcttaaaagtaatgccaaaaccacagttacttttataccaacctaatactttgtaagaatggtcgataatcctgctagtataatatgaacagaaaaggaacaattggtgccaaataaataattacaaattgaatttaaaatacagagctgtacctggtaaatgtctgctgaattaataacctcatagatttttacgaatttggagtataaaggttgaaattctgtgaaaagttcatattggacaataccatttaggaaattataaataaattttaaactagggattagtgtggtggctcacgcctgtaatcccagcactttgggaggctaaggtgagaggatcacttgaggataggagtttgagagcagcctgtgcaagatagcgagaccctgtctctactaaaatttttttagttaactgggcatggcggtacgcacctggagtcttagctacttgggagactgaggtgggaacatagcttgagcccaggagtttgaggctacagtgatctatggtcacaccactgcactccagcctgggtgacagagcaagatcctgtctctaaaataataataataaataaataaacaaatgttaaactaatctgtaaaattcctagattattagattaatagtaaatatgggactctaatatctgataacaaaattttaattcttaatactgtacattaattttactcttatacttggcttttcaaagatgtagtggtaatcataagttaggaactgtttatatttgaaatatcttaaaaattttgggatgtaattgaacttgcggttttcatacattttcctttttcattaaccatttaactttgtattagatatcagtagctgatcttccgggtttaatagaaggagcacatatgaacaaaggaatgggccacaaattcctcaagcatatagaaagaactagacaactactttttgttgtaagtcatatgtatactaatgtgatattcaaataaattgaaaaccagtgaatttagtttttctagaatttttttataaataagaaagtggtagcatatgttactccactaagtcttttataatatggggatggaagtgacattgtttactatatcatatgtaagtttggccatacttgccaacatgtatttccttaagatttccagcatactaccatattatatagtatcatagtatctctttcattcttcactgatgatgctagagttatatatgagattgtcttcatacaaattgtcttatcctagttttttattttattaataactgtaattttatcagaataattaaagttatcttaacacctcgatttctgttacttattttgaattactaagtaacaagtagagtatagagaaattgtttttagcttgagagagtaaaacattttaaaacatagaaatgtatagctattcttcgtatgttaaaggctgtctctttccttctcttttttttaggttgatatttctggatttcagctttcttctcacactcaatacaggacagcttttgaaaccataatactgcttacaaaagtaggttttctgttttactgtgttctgtatttggtctaatacataggaatgtaagactatatgaaataacataattacagtctatacatactccacctttaaagctttgatgtcagttaaagaattacttaaacttgttgtctccatttcctctacattcatttgctcctcaaactactgcagtggataaaacactcctgggcttccaaatccccattacatacttcccaggtttttatcttgcttcagctttggcacattgtttaattcctcttgtttctcattcttagttttgtgaccggtaatcttctggttctatttctactcttacactatttctccgtctactttttaggctcttttttctcatcctttaagtaacattattcagagttctgtcctaaccttattttctatcttactcactcccgttgctttagttacaattaataatattgatgactgccagatctgtagctgatacctaaatcttttcattgttctttctttttttttgagacagagtcttgctctgtctgccaggctgtagtgcagtggcatgatctcggctctctctgtctcccgggctcaagtgattctcctgcctcagcctcccgagtagctgggattacaagcgtgtgccaccacgcccggctaatttttgtatttttagtagagacagggtttcaccatgttggccaggctggtctcaaacacctgaccacaggtaatccacccaccttggcctcccagagtgttgggattacaggtgtgggccattgcacctggcctttgttgttctttagaccagatgcccatcggacatcttctttgactagatgtcccattagtcacttaaacttaatatggataaaagtaaacttttaaaaaacttttcggccatccccataacttagtgaatgtgtaagctatgatatactgattcttctcaccacctacacaagccctgtcagttttttatcctaaatctctctgaaatccatcctcttgtctttatctacgctgttataatcatcagcccttcttattggaatattgaatctggtcctttccattctccctgtgtcctgccttgcttctctccagtccattttttatatggcagctagagtgatctttgtaaaagcaccaagctgatgctgatgttccctgcctaaaacactttgatagacccccatagctgttaggttaaagtctaacctgagcatgatttatgaaatctgcaagtttaggcccctacctagcagtcctcctctgtaaccctctcccctagatgctatatttcagccatgtgatttctctctaagacaacatggtattgccttacctccaggattttatagatcctatttcatttgccactttttgtctataatgaataatactgctgtgaacatttgtatgcaggtttttgtatagacatgttttcatttctcttggatgtatacttaggagtggaattgctggatcagataataatgctttgtttaacattttgaggaactgccaaactattctgaattggtagcaccattgtgccattttacagtcccaccatcaatgtatgttccaatttttccacatgaatgtcaacacttgttattgtctgtcgtttttactttagtcatcctagtgggagtgcagtggtattttgttatagttcttatttgcatttctcttaagactaatgatgctaagaatctttttatgtgcttattaggcatttctgtgtctttggagaaaagtctgttcagattctgtgtgcattactatttgtattatttgtcttttaattgttgagttataagcatgttttgtatttttggaaataagtcccttctcttttttttttttttttttttttgagatggagtctcactctgtcgcctgggctggagtgcggtggcacagtctcggcttaatgcaacccccacctcccaagttcaagtgattctccagcctcagcctccccagtagctgggattacaggcatgtgccaccacgcccatctaatttttgtatttttagtagaaacagggtttcaccatgttggccaggctggtcttgaactcctgacctcaggtgatccgcccacctggcttcccagagtgctgggattacagacgtgagccaccatgcccagctggaaattaagtcccttctaagatacataatttgaaaatattttctccccttctgtgacttgtcttttcactttttcagtgtattttttctgtattctttgtggcacaaaactattatttatttatttaattttccagttttattaaagtgtaattgacataaaaattgtgtgtacttaaagtgtacaagtgatatttggatatatgtttaccttgtgaaatgattgaatcaagctaattaacatgatccatcatcttacatactattttatgtgtgttgagaatatttaaaatctgttttagcaattttcaaatatataatacattaactatagtcatcatactgtaaaatagatcttcagggcttattcatcctatttaattgaatctttgttccatttgaccaacacccctccatcttcctcccccaagcaccctggcaaccaccattttctctgctactatgaattcaaccttttaagattccacatataagtgggattatgcagtatttttttttctgtgcttggcttatttcacttagcatagtgttctccaggttcatccatgttgttataaacgacaagattttctttttttaaggctgaataatattcagttgtgtgtgtgtataccacattttcgttattcatccattgatggacactgaggttgattccatgtctcggctattgtgaataatgtttcagtaaaaatgggaatgcagagatctctttgacatactgattttatttcctttggatatatacccagaagtgggattgccggatcatatggtagttctatttttaattttttgagaaatctttatactgctttttacaatggctgtactaatttacattcccactcaacggtgttcaagagttcctctttctccatatccttgacaacacttgttatcttttgtctttttgataatagccatccttccaagtgtgaggagctatctcattgtggtttttcttttcatttccctaatgatcagtgatgttgaacattttttcatacatatattggtcatttgtttgttgttgagaaatgtcaattcaggttctttatccatttttaaatcaggtttatattacccaaagtgatctacggattcagcacaatccatatcaaaattctaatggcatttttcacagaaatagaaaacaaatcttaaaatttgtatggaacatcaaaagaccctgaatagccaaagcaatcttatcttgagcaaaaggaacaaagctggaagcttcacactacctaatttcaaaacctactacaaagctatcataatcaaaacagcgtggtactggcataacagtagacacataaaccaatggaacagaatccagagctcagaattaaatccatgcatttacagttaattttcgacaaaggtacctagaacacacagtaaggaaaggacagttttcttcgtcaataagtgatactgagaaaactgaatatccacatgcagagaaatgaaattagatccttacttcacaccatataaaaaatcagttcaaagttgattaaagacttaaagcctgaaaccataaaaccactagaagaaaacagagaagttccatgacatttgtctgagcaatgatttttttttaatgtgaccccaaagcacaggcaacaaaaagaaaaatagacaagtaggattgcatcaaactaaaaagcttctgcacagcaaaaggaacagtcagcagagtgaagaggcaaccaagggaatgggagaaaatatttgtaaatcatatatctgataagtggttgatatccaaaacataaggaagcaaaacaactctcaatagcaagaaaacaactcaaaatttttaattttcatgaaattccatttgtttcattcttttctttccttttttaaaattaaactaaaattttgtatagagatggggtctcgttatgttgtcaaggcttgtcttgaactcctgggcccaagcaatgctcctacctcagcctcctaaagtgctgagattacaggcatgagccaccatgcccagtcttacatatttatttatttttattacaaacagggcttcgctctgtcatgtaggctagagtgcagacatgatcctagctcattgtagcctcaaactcctggtggccttaagcagtcttctgccttttatctattattttacttgtgcttttcatgttatatctaagaaacagttgtttaatccaaggtaacaaagatttattcctaagtgcatttactttttccaagaatactacaggtataacattcagtgatcattactgacttctgaattttatctgtgtgaagtccagatacccatatttgactctagacgcaaaattacaactgtctctaggatatcatttaagctaaaacatactaacacatgacttaaccagagtcattttctgaaattcttccttttgttttctgttgttgggatttattgcatttcggtgatgtgaatgggttttagatcacctgggtcattaattaccaaataagtagtttatacagaaaccagtactaaaattattgggttttctcttttgatttaaaggagttggaattgtacaaagaggaacttcagacaaaacctgcactcttggcagttaataaaatggacttgccagatgcccaagataagttccatgaattgatgagccagctccagaatcctaaaggtaaacctatttattcatttaattctaatttaaagaataattacaatgtacagagaatgctgttataatcagtggaaaactgacagtttctgctcttaaaagtcaagtttgaagaaagaatatacaaaacatgtaaataacattgtaacataataattaccaaattctagaatgtttgatatggacagtaaattaaaggagacaaaagaaagattaatttgaactaaaaaggtcaggctacatgaagaataaaacttaaattgggcccataaggcatatgtgggatttgaataaaaggaggaaaaagtcagcatctacctgtgaagtctttcactttcattaacatacttcacaagctcttcattcgtctagtactgtacatcataaaattaaagacagaactaagaagttctaaagaagtatgtttcttggcaaaagtaactctataggtttctgaagaggatgagtcttctgaaaagaacttcatttttcctgtgtatgtgtgacacaataatagaagctgtgactccaaaatgatttatttgtctggaatttacttcctggactatatgtaaagtaacttaaagggattctccacagttttgaatattgacatttgcagaacaccttctatcctatggcaatggtggtttcattcagagtctagtagagaacctcatgcacaaatgaggaaaagtagggtgtatggtatgtggctaacatgtttttcaatatgtctctgtttttattcttggtaacaattgttggaaaatagattataggtactaagactgtcaaacagcaccagaaggtcctttcctctcaaaaatctttcccctgtgtaatctacatgttggagctgtccttgagttaataaattactcatgggatataaatattctctgatactaaatagccttcattcctaatgacatttgctttgtatggtcattagttctttttgctagttgatcttgcagagaagggaattttcagaggaaataccgaaagtgagggtgactcaggagtctgtagctgttctgacctatcgtgaaataaaatataggccctttagtgataatcctgagttatcctctctggactttcttcggggcttttgaatctcagaaagtaagctccatgttgtcttctccaccaatctgtttcagtccagcctttctagttcatatcagttaatccatctaatcagtatgccatctccccagccaatcagtatgccatggtgacagggaagaggtaaaagtaatataacaattgttagcccttgtggggtgatagattggactcatctgaaattatcttcccttgaattctctataatccctcttcagtttttgtatggatcctagcatcattgatgataaacctatactttggggaagttaaaggtctccagtgtactgaggccaagtagaatgtctcaaatcataaatgatgttattatttttacagaaagtatctttcagagaatcaatgctgccttgccttatttaaccccccccacacacacaaaatttattacttccttaagtaagtcatttttgtgattcatcttctactcatacttagtttggtttaaaatatatttatctaacaagtatgttatgtgccaagaaccttaccataatcaatggtaaaatccaaaggctctgagaacttattagaaaaggtgaaaaaaggcatgaaaaatgctggtgttggttccctgcttcacaaatcaaaccattaacatggttttaactaactttcgaaaacaatggaaatcagctttgtttgtgctctttcttttagattttctgcattta

SEQ ID NO: 539 - DNA, 27881 bp, Homo sapiens
tttataattctgctaagccaacaattaggtcttggctataattttcaacacagtccacccacttgctatgggtcataaaggtctctttaaaaattgtcatgggtgtgttctactttatattgtgtcctgagttatacatgtctgaattaattgaaattttctaccttctgttactgaaggcaataaacacagataacagctacataattcttacaattattattgcttccacacttctcaattgttgatttggcacaagctagtccatcctcttccatctgttcctcatgacaattcatcaaaaatgaaaatcgtagtaattgtgattgtactgcatgccaagtgataccactaccccatttctaccagtaatgtagtctctacagctatctagcctaggattactacaatgtaacactctgttttgagttccccaagaaacagacgctgagaaaagaatttgaatacaagtaatttttgtgagaatcatctcgaagtaacaccacaaaggcagtggataaaatgggatagggaaaagacaaaagccaatatgaatgcattaccaagtcacttgccactgcaggaaactgtgcatacatgtaaaaaaatagcataatatttaacagaatagtttatataaatatttttaaaatataaaataatattttacattatttaatgatagatacaaaatgtacaaagacatacaacagatgcaaagaattgaagtcacagttttaaagagcaaatgagcagccaaggtataaaaaattctatagtaatatttaatttcttcagatggctatcaaatatattaggattcatctcaagttagtgtaaaattatatgtaatacattataaaaataatttaaataaaacctttgagataaaggtagaaaattgagcttaatgctttttaaaacagattcatttgaaagtaaattaaataaaaataaagacttgagcaaaagcatttcagaaaatacaaacaagaaagataaagattttacaaaattaatgctggccagaatgcccaggacaagcaccttaaaaaagcatcttatagattgtgaaatgtaacaaaaacatgtaattttcacaaattatttttccatgaaaaatatgaactctgttatttcctcatttattttctgtgtgcttgtattatcaattactgagagaggaccatcataatctccaagtataaatgggaatctgtctatttctcctttaattttcatcaatttactttctttacgttgatcctcttaggtacacacatatttgtgattattatgtcttcttgatgaatttaacacctttacttataaaatgacctttattctcataataatcatttctctgaaggtctaatttatctaatattaatgcagccactccacctttactttactgttagtatcataggtatattctcattttatttttcacctttttctttatgagtttcttaagatagcacagagtttagtcttgctttttttaaaaaaatccaatttgacaatgtctaactattggtgagggttgtgagaactttacatttaatgtgattatctacatgtttgagttgggatttatcattttgctactttttttaagttacctcatctcttttttgttctttttttctttcctatcttcatgtttattagttgaacacattttatgatcctagttgattttttttagcttattaaatattctttttttgctctacctttgttgtggttgtgtgtaaaatttgcaattagtatcatttttagcataacaactttacgacagtatacttcctgtatctcttcccagattttgtgttattgttgccatacagtttacttctatgtattacaacttcacaatacaataaatatctgtagttatcattttggttttaagcagtcatttaacctttagtaatattaaataacattttttaagtcttttttattcattgacttatttacaatttttgtctctccattcgtctagatcgaaatttttactagagatcatttttcttctgccttcaacatttcttcaagaagtggtggtctatagaagattaattttcttggttcttgtagcaacaaaaaaaatcagcctttatttttaaaattaaattggctgggtattaaatttgctgggaatatatgtattaattatgataattttaatttattttagtactttttaggtgtaattgctgttttgtagcttgcattgctttcaatgagaagtctgttttcattctttttttttctttgctagatgaagtattttttaattttccttccatttttcagattttctttttattactcttcaatatattgattatgatgtgatagaggcattttatttttctttttacttggttaattgaacttcttggatctatttgtatatggaattcaccaaatttgaaaaatttggggccattatttattttaatatttttttctgctgatgctccttcctttaggatattgaaatagtatatgttaggatgttttgtttattttgtggggaagggagaagtgattatttctctttatttttcattttgtatagtttctattactatatctttaaattctttttttctatgctgtgtccaatctattaatactatccaatgtatttttaattttagatattgtgtgtttcatctctggtagtttaatgtgggcttgtttatagaaattttatttttctcattatatgcttacttttatgttcttttggccataccctatttttgtttttaggtctacactatagcacttatgtaaatttaaaatttacatacagaaatacagagcaactgctaaaaagtctaaagatgtatcttttcaaaagccccaggcaggaagacttaaaaaatcaataaacaaatattaaaattaattagtcttgtaagttgtccaacataatatcaaattacaaaattcaatagcattctttaacccagatacaagtataaaatgtaacaaaataagatgtttagaattgcaacacaaactatcatcgaagagttatcttaaagatactcaataaccacaagctatttataatagctgttttagagtacttgtctactaattctatcatgtatgtcatgactgtgaacttgtctgtttaataatatgctatttgttgctctcagtcatatatttatgctttgttaactacttcataacttttttttctgattttaccttgttggatactgggctatttttttttaattctgttaaatatttggacgctttgatctggtagagagatatttgtaatttcatccattagaagcttgcgtttaagtttattagatcacattctaacattttatttcggagtaaattttattccaccaaagaggccatacacatctaaagactctatttggatgatgtttggagacctttaaccatggcaaaaaaaaaactatatacatatgtatgatttttatatacgtatgtatacatgaagtaactattattggaccacctactatttctagttgttttatgacctgtttcagtattttccttacattcgtgtgcagatcagtattccaaaaaacaaaacagacttgaggatatttattgggtattatgctcactactgggtgatgggattattcatccatcaagccttagtgacacgcagtatactcagataacaaatttgcacatatacccttggaaactaaaatgaaagcagaagataaaaaataaaatacaatgttactactaaagaaagctggtcatttaaaaaattttcattattcattttatattcattaattggaattaagagattgcttgttcattgaactgtttatacagtataaactaaaatattaatgaattttattttatgtgttctattcattcatactaattatttattttgcttctcaaattgtcccagattttggaaccttcttcacagtagttcctgtattcttttgaaatggctccatcatttctgagcacttttcactttttggtattactagatggtttagactcgacttctgttttcgctgcctcaaacttaaaattaaacacttctccagtgaacggtattttattttattagataatggcatataaaactcaagatgtatattataggtatattcattgttactggagtttcatgtgttttcaatggacaaagagagaaaatatatttgcacatactgacacacacataaacattttctattatctatttctaaataatttttaacagtaaaaatcctttgccacaataacacaatgtttacctatttgataagtcttaataaatatgtgaaatttgttttggaattactcagagatttataaaaaaaatcaaatccactgcttatggaaaaatatttgtcttataaatgagtctcttaacagcattaaaacagtactactagactcatatcacatactacattactacataatagattcatatgattttatgcatagattataacaaaattccaaataagaaatattttttgttccataggcagacaggcaagcaggcaggcaggcaggcaggcaggcatgcaggaaggaaggaaggaaaagaaagaaagaagaaagaaagaaagagagagagagaaagagagagagagagagagaaagaaagagagaaagaaaaaaagaagaaagaaaagaaagaaagaaagagaagaaagaaaaaagaaaatctcctaaggccaattcaaactgttcagaaaaggactgaagaacaaatatatttaaggttcataaacactcatgaatacaaaggcaagtgtccctgtatcaaattatgagcaaactggaattaatgatgaacaagaaaatataaaatattaatatcacattgaaattaactcaagatggaaggagggataaatagaaaatttataaatgtcatagacaatattacaggttaaaagagaatggagataaaaaatactaaaatattattaatttttgcatactgaccctttatcatatatatgtcttacgaatattcacttccattccacagattgccttttaagtttgttgattgtctcttttgctggccagaagctattttaggttgatataatctcacttgtctgtttttgcttttggtgttatatccaagaaattattgccaaggtcaatgtcaagaagcatttccctatgctttcttccagggtttttgtggttttaggtcttaggttgaatatttaatttgtctcagggcatcaaaatgtccatgttacccaaaacaatccagattcaatgaatccatattaaaatcccactggcatttttttaaagaaatagaaaaaacaaaaccaaaatttatatggagccacaaaaaaacaaatattcaaagcaactttgtgcaagaagagaaaagctgcagacatcacactccctagtttcaaaatacactacaaagtgacaagaatccaaacagtattaaagcacacgtatagaccaagggaacaaaatggagagtctagaaagaaacctacccatatatggtcagctggtctttcaacaagatatcaagaatatacgatgaacaaagagtagtctcttcaataaatgatgccagaaacactaaatatccacaagcaaaagaaggaaattggagccttatctgaagccatcactcttcaaatttgatgaaaaaaattcttaaaacttagaaaacagaacttttttgaattaatacaatggttatatatttaacataagcttaaatgggagaaaaaaataaaagcattttctttaaaagcaaatatatgaatgatctagaatgcctacttctacttaatactaaatgtaaagtttcagcttacaaaataaaatacgtgaaatgcctaaaaactgaaaaaaagaaaaaagaccgccacaacttttacatactattatggtctatattgaaattcaaaggaatctacagccactattaagttatagtctacactgagagagataatctttcaatttccctcagctattagtctcaaaggggattcattgttgaacccaaattgataccaaagagaaagggagccaggtgatatcaggtgatacatggttatactcttctcctgaactatgttaaagctacctttgtcatttccccagtaccacaagccatagcttttttcaaacattgctattccctctccttttaaccaccttcacttgaattttgcagattcagtgatattcacacatgctactctgagctactacaaatgatgggaatattaatactcctccaggtagaaagggagccaggtaatacagtcaataaaagtagcttcctagcactatgaatagcgttcattcaggaggtgtactgcaaagtgtttactttgcaggtctggatttctcaacttgtacattcccaaaaaagactcatgttcttatattcaagaggggctcatacctggctcctaagagctgagttccaatcttttggaatacagtgcctaataagagtgtttttgtatatctgaggtcttggtccacattagtttgactagatagtttatgttatcaatgtgatttaccatgatcaccagtttttgctctgagggtctggagtctgggtagctgaggttagtcaaacaggctctagacatctatgtgattgagccttagcaataacccaagacatcaaggttcaggtgagttagttgataaaactgcatcccgtcaccacatatcatttctaggaatattaaataaatcctgtacaactctactggaagaggacccctgcaagcttgcaactgatcttttctgggctacccttcataggtcttttctctctccttattttaatctgtaatctgtattattttgttataatgaaccataaccatgagcctagcagcttctgagtcctgtgagtctttctagtgaatcatcgagtctcagagtagatccataagaataatcagtaagaagttatgaatattttggtaaaacaaaatgtatattatcattgcaatagaaatttctttgtaaaatattttttccttaatcttgaatgtacaagtatacttaaaattccaaaataccacatgaaaaataatttactggaatttatttctcatatttaaacgtgactttaaattacaccattatagtgtaattaagattatattaaaagattatattaaaatatataactaaaatacagccatatggatcagggctctaagtttccattcttgtagacatttgtctttctctttgatttaatgaggatataccaatagtaatagctccatctgcagttggctacgattcatttttttctcctgcaatttttgacgtagttggagtgaggccatatgcaacagggtctttaagccatttccttcttcccagatgtgccatgcagcgtctttactctttataactccccattcccacctcttcccggttacactcttatcctgactatgttaaagctacctttgtcatttccccagcaccacaagccatagtttttatcaaccatcactattccctctccttttaaccaccttcatttgaattttgcagattcaatgatatttacacattgtactctaagctactacaaatcactgtgaatatcaatactcctccaagtagaaaagggtcataaacagggaattataaaataggcctctaagaaaaccccagaggaatgcaagttaaaatgagacatgtactttcaacaaactggtcacaaaataaaaaccatttattatagccaagatgccaaggatgtataaaaattatatatgttttattatgttagcgaactggtatacagaccctaaaggtgaaaccgtgaatgcaattctaccgctggaggaattcctgatttaccaagtctccagcacacccacatacacacaacacacaaatatactatatatcaattatacatatattatatatatacatacatgtaagaattacactgtggtgtgtgctaaagaatacacgactaagtggcagagttaacaatactacttaaatgttattaataacttgaatgtgatctctgtgataggatgtcccagctctctagatatgaaatcatcgacataagctttctattgttctctttcttaaactataacactactttctcatttgaaaaagagaatcagtgatagctatctcaatatcaaatgctttatttttgacttcctattaacgtcttttctttagaaaagcagagagctagggcttgagtgaatcctagaatcacaaagatacctatactgttttagtgaaattagttaagtgggctttggaggtaaatagatctatcttcccatattttttcaaaatgatgtttgtcaaagagagagttacttaatttttatgtttttattttatcataaaattaaaatgataatattttgtaaatatattgtgaaaattagtaataataatccaaatgtttagaaaaatgcttcagtggagagttacatcatcataaattttaaaactaaactgaagattatagcacaagaaagtaggctgtcaacagatttactgcctaaccaccaataatgagaaatagtttagttatctttccaaggtatataacagaatatacaaaaatataacagaatgaagaatactatttgagatgagaagccataacttcaatgtagtcagatatttgtgtatctaaacctgccaagcaaggagaggagtgtgtacatgggcatttctgggtgtgtccactaattatcccagctgacaacctgaaaaagagaacaactgtagccactacatcagggtattttgggaatttgaagactacggacatattactaggctccactgatgctgggataccaactttaatgaaatcacaattgagctaaaaacaaagattggttgaattcaatttctattctaacacaaggctaccacttcacactacttttagttggcacttttgtcaagaaaagacagaaaatatctagaaacatggattccaaaataatatcattaaaatgacaatataagcaccacagtttgtataaatccaataaataccacattatagttattagtttttctttattcctaaaattgttcacttatgtgatgtatattaactttatttttgaaagagattcacgaaaatgaaagatctattcctatgtgtttattttcaataacaaaattgtctatgaattcaaagataattacattcacagcaatttttaaaaggttcaaggtgttttgatataaatataacagaaattacaaaataatttgatttgctaccatgaaggaagagggaaggcataacatgtaatgttacaaagctcaaaaggactaggttttggggttaataaggggtctgcattaaagataaggtaaattttttttccacaagtagggaaattcttttttagtttacacacagcacctttcagaattgaagttgagttgctgatgatgccagtacacccacgttatgatttctttgaaacatccaatggcttcatcatttaggccaaaagagcataatctcacggaggataatttctatttatgaccaactaaaaacaggagggtggcaaacttcttatgcacgacaatagtaaatatggaaatcatccttagtgaatatatttttataaagaagtaactggccaggcacaatgactcaggcctgtaatcccagcactttgggaggcagaggcgggcagatcacaaagtcaagagtttgagacctgcctggccaacagaatgaaaccctgtctctattaaaaatacaaaaattagccagacatggtgaagggctcctgtaatcccagctactctggacgcagaggcaggaaaatcgcttgaacccaggaggcgggggttgcagtgagccgagattgcgccattgcaatccagcctgagcgacagtgcaagactcggtcaaaaaaaaaaaaaaaagtaactacatttaagacaacttttatttttaatcaaggaatacgttatgcactagagattcttgatggcttacaaaccggacgtgggtgacaatttaatcatgatgttaaagttgaaatgataagaggatgtagtaaaaagtccaccaaagaaaactaaaagtgagtaagaatgaagaatgagaagtaagaggtaggagttactcagcctaagtatctgaaaaggtctgggtagtggccttgttagagaggaatcccagagaatgattgatgtgttagttacacacatacacatttgatgaaagaaatcatactgtacactttatgcactttttatcacataaaaattataccttaataaaaacaatagagatcaacagaatggttacaatgaaaataaataccaaaaagaacaataccaagtgttgatgacaatggagaagagctggaaccctagtatatggctagtaggtttactagtttgcacaaccttttgggaaactaaattttaatgatatctatgacctgtcaattccactctcacgaatatatccaacagtatggcatacatgtattcaccaatattaggtacaagaatgttcaaagcagtgttcatcataaggtggcaaaaccaaaatagcctaaatttccatcagcagtagaatggataaataaaatgtgatacattaattcaatagactccatatagctataagaatgagcacagcatatctacatgcaacaacttgtacgaatttcaaaaacataatattaatcaaaataagcaagatacaaaggagtacataatgtgtgattcaactatataacgtttaaagtcaaggaaaattgatccatggtttcagaagccaagaaagtgtttaccattaaataggagttgtggggactgataagcggatgaaagaggagttatggattgcattcatgttttgtttattaatttgagtgctggttgcaagggtggggttacttcgtgaaacttcaatgagctataaagtttaggatttatgttttgcagaaagaatatacaaaattttaaaaacccggccgcgcgcggtggctcacgcctgtaatctcagcactttgggaggccgaggcgggcggatcaggagctcaggagatcgagaccatcctggctaacatggtgaaaccccgtctctactaaaaatacaaaaaattagccgggcttggtgaccggcgcctgtagtcccagctactccggaggctgaggcaggagaatggcgtgaacccgggaggcggagcttgcagtgagccgagatcgcgccactgcactccagcctgagcgacagagcgagactccatctcaaaaatcaaacaaaacaaaacaaaacaaaacaacaacaacaacaaaaacccacaacactgatcacaggaaagctacatataagaaggaattggaaggcttaggtgacgaaagattaacagaaactccaagttttccagggaaagggtgggaagcagggtatgagaattagagtggggataggaaacggagagaagcaataaatacaacactgggcccagaaaagaaactatagttgaaatacaaataatacattattgtgattaatctagtttagttgcagacaagttggatagagggggaaggttaagaggctgtttttttcttaagttaattggggtttattccaaaaataaaaagttgatttaacaactgataatcactttatatattttaccatattggcggaacaaagagaagaataatataataatttgaatagatgcagaaaaacatttgataaaattcatcatccttttatgatgaaaatttatttgaattaaaaagaaaaagggagattcctcaatctaataagagatatctaaaattagcctacagcaaacatcacccttaatggtaaacaatgcatgattttccactgacatctagaatgagacaaaatgcccattaccctcatttttatcttatattgtgctggagtgtctcattaactgttaagagatttgttttcttcatgggctgggataaggtaacattagttctaagaatccatctaaaatttatcagcaggaaatgcttgaggggatggataccccgtactccaggatgtgcttattttacattgcatgtctgtatcaaaacatcctatctaccccctaaatatatactactatgtacccacaagaaagtttaaaaataaaaataaaaataaatttaaaaagaggagtaaggattaaagttcagatttaaattaaatattaaatgtcaaaaaataaaaatgaataaataaaatatatcagcagggaaagagggcccaacatggtactgacagttaaaactaaattttaccagccaagtgtcacatagcttattactgggctttctgctctcccgatctacagtgcgctgggatggatagagacagactggaaacccaaaagacacatgcaaaatggagccatccagtttccagtggccttacctgtctaaccattttcactacagtgttcaagggcttaacctttctattgctgcagcaaaggctagtctcaaattctacagtgagaactatctatttgctgtacagcagatctcttagaagttgaggaagaaataaagttcagaggctgggtgatgtggctcaagcctgtaatcccagcaatttgtgaggccaaggcgggtggataacttgaggtcaggaacttgagaccagcctcgccaacatggtgaaacctcgtctctattaaaaatacaaaaattagcctgacctgctggcagcctgtaatcccaactacaatggaggctgaggcgggagaatcgcttgaacccgggaagcagaggttgcagtgagccaagatccgccactgcactccagcctgggcaacagagtaagagtccacctcaccaaaaaaaaaaaaaaaaaaaaaagagagagagagagagaaataaggttcagttaaatttgatggtgccatgcagaacacttggcctgaccaaaatttattaatagattcacttctggatatgagtagcagtgattttcataattcctgatatccctgttcccttagctattaaaggtatttttaaaatgttaattgttttactcatttcatctgtaagatttaagagttcctcactgatatagaaaacaagttttttaactggtgcaatcaaatatgtccttgtacttattctgatgtccttcaagacatttggagttcttctttgtcacaatttaacatatcatttctcaagtctgtttttcctacacagaactgaagaacaactattgtaatggaaacgccacaaaaatttgacatgttgttagctctcctgcggtcaaacataattacgtaaaattgtgtatctgccctctttcaatatcagtttacagttagcaggtgttcttaatccttttgtttgtgatggcaaacaaaatacaaaatggggttttaccagttcttcacagtataccttaatttgaaataaaatattcaaggcagttatttgttgttcaaattatgttcagtaacatgagaagcataaaggttttaagtaaataggatatttaatttcttaaatgatagaatttctgaacctagattattattttgtaaaggtgagaagttgagaacttgctgttttacaaagcctttttcacacttatctaatttgttatggcttcctttgagaaggaaggtttagtacataccagaaaccatttattttttgtagatttttttggctactttccatttacagagccctgtggtaatataaaaagggttttatcattgcagatttcctaagtagtttggtgtaaataacatttaatataagtataattctttatagttgacatggaatagccacatatgatatcatatgatcctcctaacgaatatagtgaaatttttaaccctattttaaagaagagaaagcactgtgactctaaagtttcagttacttgtctgagatcccagttagccagtggaacctgaagccacatgcatttttcaggacccttcaccttgttactttttgtatgtctcttatttaaggtgtatagattgttaactcattcagtagctgcaataatcactatccaatacatagctgggtagttacaattattgtagaacacatttcaaatgtcttgagacatactcatgtgaattatacccaaattaaaagaaaaatgtggtttgaaggcatataaaatttgaaagccagaaaaaaagaaactacggttaaattatgccttaaaggaattttaaaaatacagaactatacttgtaaaattttagttatagcatcttcaaaaataaactcaaattttatttaccttgcatatgttttatatgtggtatatttaatatctttcctctagacaaattctaagaaaaagttgaaaactttttgataaaaaaaattattgcaagagttttgcaatatcaagagaagaaaaaagatatattcaaataccccttgtgaaaggtaagagtaagatcaagttagtttatgagtattcaagttagtttatgtgtatggcttgccacaggtctttgtacttgttcttacctactcctaaaaggcttttcctccagggatcttatggattctgactttcacttccctcaggtctttggcctgatgtcattctttcatttgatactttctctgcctgctctatttaaatatgcaaactcactctaagaactatctgttcttcttactttattattacatagcatatatcacaggctaaatttatatatttattttatttattggttgtctcctctcatgagaatgtaagttccatgagatagagaatttgatctgttttgcttattgttgtattcctaccacttagacaagttgtaggaactaggttggcattcaacaaatacttttttttacacaaagtaaacaagagagaatgaaggaagaaaagtaaaaaaggaaggaaggcaagaaggaaggcaggcaggcaggcaggcaggaaggaaggaaggaaagaaggaaggaaaaaaaggaaggaaaaaaggaaggcaagaaggaaggcaggcaggaaggaaggaaggaaggaaggaaagaaggaaggaaaaaaaggaaggaaaaaaggaacgaccaaggggagtgagggagaaaggaaagaaagtcaaaaggtatgtaaaaaagtctttcacattacctctgtgagaaagtaccagtggtagcatcatctgttaattcctgctattgattagtgtcccgagtactaagagatctggaggcaaaatcatcaagagagaaggaaataaaaatataaagggaggctcataaaagccaggaaaaataagtaatataaacaaccaatcaggactggccttgatggttaacattattgtgtttgattctcataaggaatgtttcatgcaaggaaacatgaggctggccacaggatagagagaaattaatttgagagatggtgtccaactacccagagatgtgtaaagatagagagacagtgagaaccagggtagagtgtaaactccagttttctattgcctgattctatgcttttcaaagctttctgcagacaaagaaaataatgaaggacaaaggaggcatggtaaatcatgtatcacctcgaaaatatttgccagggtatttttcagtagtgttataatgtatcctaatatgggcactttcatttatattttgaaattgatttatacattgaaaagctattacctaaatggacacaaagttgtttgcattaagagacaatagcatacatattaataccaccatttcattgttaaggatttattcaaagagaataatcagggaattgtttgtacagagatataagaagtccattatcttcagctcagcatatgcagtggaatggaaatcgtttgccatatgacaataagaataaataagggatgtggagtcattaaaaagagaaaattttagacttacctaaaattttgctatagtatgaattccattctccccagtaggactgaaatatatagtcttgcagagaataagatatggtatttttaatcctttcaccaaaggtcatctggtcagtgagctctgataaggctgccggtacataggagactggtgctgggattttcccacagtgtctctccactgttgatgctggagagaacctcaatgtgtacataaatggaattcctaatttcagagcaacaagatcaccacagattgttactgggtctgctaccaacacatcaaaaccacctttctgaagtcttgccatcaactttgggttctttagtacaccatcacagagttgtatgttaatttgaaagaaagtgtctagaagttttcctagttctttgtagaaagcccatattgtgagaggagttggtctatggtcaatccacagcattatcatatgctcaattaaggaatctatattgctcttcttgtaggaaacaggtatcacttcaaaattcacaggagaatcgggattggagttgatgaatagagttgctgatgaagccagtacagtcacattgtgatttctttgaatcaactcttctagaataatcttaatatttaaccaatggctaccatctgtaggccaaattaacacattcccacttagaacaacttcagtcagagtcaaattaaaaaccagcatctggacaaacttcttaggcatggtaaaatcccttatggaaaccatcctactgtagatccttcaagatgaaaaaaaaatcttcaaagtatatttaggtcaatttttaaataaagtaatatttagtgcgatggttacactcagtcgtaggtcaattgatctttagattaaaaggtaaataatataattcaaattcctatatgcactaacatcattatttcagtaacagaaataaaatctggttctttttaaagaaaaggaagcacggggttataaacctaccatctacatattctgtgataataactatgatttataaaatacatctttaatatatttttcactaaattgaataaacaactttcagaggaagtttgctcaaacatttcaaggtgttttagattatatggattatagggtaaaatactatgcatttgatatagaatagctttcttctccataaagccaactgattgttgtctcctatgcctttgttacagggaatttttcagtttcttccatatgacacagatcaagaagatatggcctggaactccaaagaatcacagactttgttattcagagaagttaggtagacactggagttcaatagacccagattcaaatattgtccttttataagatttctgacaccgggtaattattcagaccctcccattctcagttttctcaaagaaaaatgagaggtgagacattaatttgttatattactttgtggattaacaatagtatctgtaaagctacttttcaatcttcttggtacagagtaagagcgtagtaatgttagcggtttaataaatttgtccaaagattgattaggaaatcagtaggccagctacagaatgactggctagacttggatatagtgagatcagatatggatatagtgttgcaattcttagtgaatcccaaactgagcaatagcaattatgtaacaatgctgttttgaaatcattacaggctaccattaaaaagagaaataagaacaaatagagtgattaaaaggataaaaatcaaaaattaagattagaaaataagtgacagattttaagtttatactcaattgcccttaaattatgtaatttcaggcccttgagtaacaaaagaactgggaggacagagaacaggaaagacaagagagagaagtgatggttttagaatttttgcatttgtgtcctctcaagaataagcctcaatttgaatatagtggcagtaccttaaaaattaattagatttttgaaacaaggcagccagagaagagtgtaaataatcttaatggtcttcaaaataagcccagtaaaaggggtttaaaaatcttcataaagaaatctgttgctgtcaaactttcaataaaaagtaaagaaagcaaaacattatagaaaacatgaacaaaagtctatctataaaatacttagatttgttcaaatattgagttacatgtaagaaaaatataataattaattagggattactcacaaatgtagctgcaatagcacataaaagcttatcaaaatatgctccaaaatctcaatacatatagatatccctaaattacccagagtaagggaaaaaatgatgatattagtcaacttccacttttacgtaatatctgcagggcaataaaatatttacctaatttagtgaagaacaataaaatgtatataacgcttttaatttgagttgattatccttaaaacaacattttgtttagtaaaatgtatacaatcctattagtctgaattgataatcctcatagcaacattttggtatgaaagattttcttttccactgaagacatgcccttgcctgaaagtcttctcttccgaagtgctccctgaatattgcacctgatggctaggattcaactctgctggctcttttttcattgtctccccaaggccaaaaaaagcctggaaaccagctttcatactgttttggggatgagtgattcagttttatttgagtttcttgatttgtatttacctaattctctaaaagcttaaatttagatgtacttttagtttttctttgttttgctaaacagaaacagtatattctagcactttgctttttacctcagagtggagtctgatattaaatgattcaccactttctgaattgtaactaggcaagttacttagcctcctcatttaacaaatgatgagaacaatggcacctatttcctatagttctgggtatggtgtgacataatgcaggtaaatgattcagaacagcacctgggctccataagtaatagctagctatgatattttagggagagaatcttattttttaaatgatcaaattaatccgatctcattaccttgacccttctctactctttccctcctcctacactgacagactggggaatctagggtttggtgcagaatttctcaaacactgagagtctccccataaggcagtcactctcagtctttaggcagaccacaagtgataggctattaacaatgcacagagtaccaaaatttacaaattatttattttaagaaatatatgcatataaaactcaagattatatccacacaaattgtaacttccatttccttttgttctgatactctctcatgagtgggagcgaaaaagatagagtgatcactatctctgagaatttccaatgtcccaatgtcaattacatctccaatgtaatgccggtggctgtcattcagcttatggctcattgcagaaaagggaatgatactagaagatttttcaaagattctaaccaatcaagatcaatgtaaattaaaacagaaaaagaagaaggaaggaaggagagaggaaagcaaaggaatgattagtaagaaagagaaaaagaaaaaaaggaagacctaagtagtaatgtattattctacaggaaaagattccagtgcattttttcttctttaaaattactactgaaaatcaagaatcatggaaggatatacacttgaatgtgtttcatttctagcactttattttacattaattactcatgcttagtgagcccacagttcatgcaaagatctagatattatgatcattctttttgaaaatctagatttcttatttactagacttgctaaagtatgttattatagatggcattcatcttagagattattcacctaattattcatatataatgttatgtatttttacatattatatacctctaatatatagagattattcacaaaaaaaccttgtttttacagtggttaaagggtaaagtgctgttggtaacaatatgtaatgcttatggattataagtatttttaatgataaaaatgttacatttttctccccttaaatgtgcccagttttggtgtttttttttaaataaaagtaaaaatgaaatacctggttccattttttgaaatgcataaaaattcaaaaattttttgaaggtatacattcgaaactgtggaaccctttacttcctttcagttagaggtgacttagaaagctctcctaatgccaaaaatatatccctagacaatcctccccagacaacagaatcacatgatgacctactccttaatggatagtaaattatctggtgatacaatggcccaattatattcatttgacaaatcaaaaataggcaagaaatagaatagcagattttaaaagctaaacacattgaaaagaagaaaagcgttcaagaaaaatttaacctaaaatattctgaacagttaatagatttgcacctgaaatttaaaaagaaggaaaaacaattcctagaacaaggaaatatgacatcaaagctttgatatgagaaagattttcatttgaatactattttctcataattttaacatgtttgatatttccaagtctcaatattcttttctgtgttacaacttttttcttgcaatgaactgcaacagttcaaggattgatagaaaatatatgtaaatcacttatcacagtggctagtgcataggaagatattaatatatactgctatcattattatgatatccatgagtttgagctaaatgcccatgatctgaaataaaatgagtaattttacattataaatacccaatttctaccaattagcagagattaaggactcactctgaccttcttattgcattccactgcagagaagtaaacttagggagttgttctatttatttactcaggtgaggctgttcgaggcctgagtggatataaatttgttgcaatgatttcattaaagaattttaagtaaatatagaagatcaattcaaattacaaattggaaaggagttatttttacaagtcagttccatttatcattctcctttatcattctacatccacaaagacttgcacaaaaataagtcactctgtcatgtcaatactttacttcttacctggtcttttaaatatgactgttcatgttcctggcatcagtaagaatattgtgttttaataaagacaaacttaagtagtcattctaagtcagaagagggtaatttgatcagaaacatgatatatcaaaatcagaggataagaacatctttagaaatctttattatgttcctctgaacaaattgttaagaaagattagcctcatgtcttaagactgaaagaatagtgtgcttttattaccagcattaacttacaggcaaaataaaatggaacatgtgattctgagactgccagcctaggtaaagtaaactagtggataacttcacaaataaagagcatagtaatcatgaaaattagaattccaaggttgatgatgagcagttgacaaaactgaagtggtaggattgaaaatgtaaatacaaattgtgaccaagagacggtctatgtacattccgctcttatatgaacggagatgctgcacatattcagagtcccttttagtttaccatacacctgaggatatgaaggagattttgccatcttgacagtttcattgcttcacaaaacttcaattttttttctctgctttcttttaagatctagtttcaaccataagatgtttcccattcacttttatctttataggacacttgaaggtttatctataatcattgtagcaaggcttgtattctctgaatgacagaatagctagctcttcttttacatcccaagatttaaagatctgtttttgaattttgggccaattacttaacatacccagaggaggtgatgacttttgctatcagtgctaattataattggtttaccagcttttgataataatcattcacatggctgtagtatctcacatcctcattcacatactaacctatgcatatttattttgattgatacatatcaactttacagttgttttagaacagagatctgtagaaaagaagctaatgtgtcagtaggtatcactacacagaaatctcactttttcttttgccaacattcacgcaacccactgttttacacagtgcacttcgtcatctttaaattatttttaatagcatttaggatgttcattcattagctagtaaacatctctaggccttacaagctctgcttagcaaacattacagtctctgcagtctgtgcattattactttgttatcagtaacgaatgcacacaaattaatgtgtcaatgttaataacccatgagattacctctgagatctcatcccgtatatccagctgcttactggatttcgccaaatattcccaaaagtatcacatacacagcatgtccaaaattcaatgcaatattaatttttactctcccatattcgctatcagggttgattgggccacactattctaaaatcctttcagatgtaaactaatttagtccttttagtagccctgtcagagatgagataaatgaagttcaggtgcaaggagactgaattacttttcccagccacagactgctatgtggatgttgcctgtaagcacctgctctcccaattgtgttgctaggtagtctcatactgcattattttcctccatttatcagctacttctgtagggcaggctcctaccacatctttcctagagtgatacattagtctagtctcacacctctcaactctactgccacatctgtccaagtgttttacgtaaaatgaaaatcaggtcataatatttccctttagatggtcctgaattgcttattagattaaaatgtttttagaatgacatacaggagactttgaaatattcattgaattaattcactcattcttgcggttccgacgtcattagcatcttcctccatgtctccctaccttacacttgaaccttcagaaatactaaattatcagaaatatccatcgcacctgtgctgttttgtcttcaactttgagcacacttttccttccccattcttaccttgcagaaaaactcacattcagtattttaaaatatccttatgcattatctgaactctgaagtttttcagaataactcactctgtctgtcgcataatacctaactcctctacattttgtattttgtatatatttccatatttacataattcacataataaatattccttttaatgtctgatttatctgtttgtgaaatccttgaatccatggactttattttagtcttcctatctaaaagagtgcttagtaaagagtaagaaatctataattaatgaagaataaatgataaaattcaaaagcataaaaaatgggcaaggcctgtttgatttttagacaaatatgtgtataaatgtatcaacatgatcaatataggcttttattctagtaccattgattatattgtattcatcaggtaaacaccatatcacacttaagcaaattaaataagcttagcatggataaatcaccctgatcaatggttgtagttcacaccttacaattaaaggtgataaagccttaatgtattttgtttctttatgagccttaatatttattaagtgatgatcagagattatccacatatatgtatgttcttaaacgtgcatattaatgtctgtattaataataagcttgtggaaagtttaacattttccggctttctccacacatcactgcagtttctaggcaatttctattttgagcataattatctacatgagatccagcccaacttttaaattgaagtatttgtcactatattttatccataaaagaactgaattgatatatttaagtccatgcaattagaaaacaacacactgtacttctgaagtacaatgtcttttatcttcttttctgctatcaagtgatagtaatatatagtacatcaatacttggaattaaaaaagaatagacatagggaaataaagaagaggctctacaaaggtctgtttgttcaaattcaagtaataaaaacaaaatttgttacatacctaaagctttactatagtatgaatcccatgatttccaaagagtttcaaacatgtagtcctgtaggtggtaggagatgaaatttcttattctgtcagtgaaagacatttggtcggtgagttctgataaaacagcaggaacataggaaggagggtatggtaccttcccacagtgcttttccactgttgaggctggagaaaacctcaaggagtacataaatggaattccaagttttaaagctactatatcgccacaaggaaatactggatcagacaccaggacttcaaacttgcttttctttagctttgccatcagctgttggtttttaagaacgccatcacagatctcctgagacaccatgtggaagtccttgattactttggccatctcctgatagaatctccaaatggttgaaggagatggtctattttccagccatgtcaaaacgaagtccttaattactccttctattctttctttgccaaagggcaccctatatatttcaaatgtcagagatgggttagaggttggtgtgatgaaaagtgcaccagaggcaactaggacagtcacattatgctcctttttaatgagctcatctataattatcttaacatttagccaatgactaccttccattggccaaatcaaaacattcccaccaagagtggttcctatgagacttatctgaagggagaacagcagaaggttgtttaacatgatgtggcttgatgcagaagatttgatgagatgtgaagcaaatgtttttctctgcttttaaagaaaaaaaggaaagacaaaattatttctcaattttgaggcaaaccattaatatccttaaaagccttctttctagaaagtgatactagtcatagtagctccatattttaggatatttacagatttatgggtaatgtgtcttacttctcaaatctgttgttttaattttagtgttttagttatgattcctgctgtctaatcctccttttgaacttgatactccaacccttttttgtgtgtttcataattgttacatttttactattaaattggataaagcttctgtacatctcaactctacattcaggcctaggtattgaaacctcagataggaccaaaactcattcagaaatttaaagatgttaatgctgtaagtttttaaatttttaatgcatgaatataattccatttatcacaattaaacattataataacagttacaatatataagattgtcaaataatatgtataaatatattactataaatatttataaattcaaatatttataaattcaaataatacttataaataatatgtataacacatatagtattatattactactttagtaatatgtttacaaaaatagtttgttaatcctcaagaaaatattataaataaatgaataaaataaaatatgtgcaagagattataggtaatgctagtagtgaataggagctatttaagagaattactaagtcaagcatacatctaccaaaagtgctgttcaaaaactatctagcctgcatgaaaaacagctacttgacatctagattcagccttcaacaactgctagcgtttattaagtccttgttatgtcagacattacgcaaactctttaacacgttaatttcatttcttccttattttaaaaattatccaattatggatcttttataattactcccacatcaaagaaaaagaaaccactgcccaaagagattgaataatttgccatgttcctacagcaaaataagaaaatattacttattgggtacaatggaaatacagtgtacactacttgagtgatgggtatactaaaacctcagatttcaccactacacaatgtacccaaacaggacaactgcacttgaacccctaaatctataaaaataagaataaataaaagataggaactgctggtagcagtcttaaggatctctgactcccacagcctattgtattaaccactgggatagattgccacatcaaaatgtatcacgtccccttaccaactaaggaatccatatgaatagcagcctgccaaaagcatgctaacacaatacaaaattgtgtaacgcacattggataatatcggatcaagtaattcaagtaaagcgatctctgtgaaaatattatgtttgtatgcatatgtctgtgaataagcagagtgatccttttcatgttaataaatcttctgaaattataaattctatatttttagtaatatcataaaaatgtctcttctaagctctcccatcaccaaagataatctgtatggaaacatcaactgtttcattaaaacaattacttttataaagtactgttcaaagtttaacagagtaatcataaaattccttgagtgtatttccattgaagtttctctgcagaagatgttatggtgtgcacaaaatttttgcctttctggtgtcagtctggttcatagtgacttggcaagaaactttaaaataattgtcatgattcactaggatgtcatgattcactgatgttattttcttctatttatttattggcagggaatcaggtccagttttagacaactaaaatatagtattttattcaggtgctattgagagaggagaaagcaagaaaccagttaggcagatagttagaacaaggtccgttggtaaaattctttttaacaaaagggcagcctgaagctgcacaaccttcaagcacagataaacaggcaaggtcgaccctaaaacacccttgtcttttgtaaccagcaaaagacatatacatatacatatacatgctgtgggcttcagtgagcatgtttctttccttttttggacataatcagataaaataacttacacagtggggcttgcctacaacatgcctggaggtgcacagataagattagttacacagaaccagacatgtctgtaatggaaaagtccatctcctgacacatgcgcagtaaggaaacagggtaataaggagtaactcaggttaagggcctgcatgtgcatgagagggagtgggtggagttgtgagaaattcacacctttgcaaataaaaatctttttttgtgtgccatatgaaaattaaacaccccaccccactggcttgtttataaaagcctttgtattcaactgagaaatggcaatcctcttgggccccctctctgctgtggaaaactttcccctttcacttattaaactttcactccaacctcacctttgatgtccacgctcattaattttcttggtcctaagacaaagaactcttgagtaatacctcagatagggagactgctccagtgaccctgggctgcttcactatgtgtttattgggtacctactattcacacacagcagtacctactaggtagaagaggaatccaggagatctttctcatattaattttatagtctatcagtggaagataagaaaaatacatacatatctgtgacaaaaatcactgtagtacattatagtcagcaagatattaaaaacataatttagattttagaataaattaggccaaagaatcctagcttcacattatgctgcttaatatttattagactcaattttctcatatataaaatgaaaattaaaaacaacttgagtttgagaatataaagtaataaaataaaataaacaacatatctgttaataaattaaaaatgaatatacaaaaaataccataaattattatgtaataatacataccacatataagaaaactatatatttaaatagatacaattgtatttattaagcaacaagtatattacctggagtaaaagtgacgtttaaaaatatactatctttttcatgtaatcccttctctttctcttccctagagaaatta

SEQ ID NO: 540 - DNA, 29622 bp, Homo sapiens
cactgtggtgataaggaacttaactataagcatgatctagtaggaagaattacaacgtgatttgtatttaatctggaaatgggtatctcatattgcattaacataaaatgtcctgggtaacagaagtaaatatcctctaagtgtagctcatggcatatttgttcatcttttcctcaaacctcatgtgaactgcacaagctaaaggacacagatttttcatcgtaaaatatccttctcacagcttgaaaaatagacattcaccaattcacacagaaagaccactctttaatggtatgcaaatgcaaaaatgtttattatattaccaccatggcctctgcacaaagaattctggactcgttaaaacaatgacagtgaaatatagacaaataaatactgtataattatttccaaggatgccttcaaataacttccactaggatagcccttattactctgtctagttgaaaccagttttgaacacttatgaccacaatataactgttttatgagttttttgttttccgcatttagaggcgaaagcatggagcgtagagtcaagaacaaacatcagatttacagatagagcccttactaatgggggtggctttggggaaagctctcacattgtatgagctcatttgcattattcataaataggaatacttgttagcaggctctttccccagaaggcttcaggaaccgtgcttaagtttagggagcaagcatgtaggctaaggtggtaaatgaccctaacctgtcagtggcttagcaaaggaaaagtttctgtttttctcactcacactgcaggatggctggtacatgaagctgtacaggggctcaatcagcttctatgttatcactccatttcctttcaggtcctggggaggctcttttcagctgatagagagagaagaaaatgagaatcacatgggaagttctaagggttatgcctgaaagtggggcacgtgtctcactcagtttttacttgagcaacactaaactacccttagttcagaagcttgcatactatcctggcaaaacagggatgggagtggagagaggaattctgttgaggggcatcaaagtctaacaggaagaatggatggatccaggaacagagatcaacttgtaaatagttctctttggaatttgaatgagcctaggagacaggatctgttcaaagtgtggttacattcttggtcttacagggaggggaagaaaaaacaattgttctttattgtgggtccagacattaggcatataaaggaacttcagagaacaacttcattctggcttagggacagtgagtcagggagagcttgaagcttttttttttttttttttttttttgagttagcatgtggaagagtagtacttggggtattggtttctgagccccaaccttacaaatcttctgaagcagatcttttagtacccttcaaagaaaacagaaccttggaacagtaatgaggccaggtttataaaactcataaatagcaaagccaggattttaattaaaacctccttggctaaaacacttctctcttttttactgcacaccacgaactcaactctcaacaacagtatcacttggttgtgaggtcaaggcttacaaatatgaaacaaagtgtgaacctcctcacacaggatatggatctgcttctcaatatatggtcctgaccaggagctataaagaaagaggactggagaaggtgggtctggaataagcctcaggcaacttcctatagtaggacttctcatatatactatttaatacctggagaaaagaggcaggacttcctcacttagactccctgctcactagatggcgatttcaataccaaagccaaggatcaacgaatgagctgtgctatcttatctttagagattattttctagttgtatgactcaactggcaatttgtactgatgatttgatctgttcaagtccccaaattttctgagttattgaggttttgttccatgtaatataacaacaatggcatgagtcagggtcgctgagcccctgtaagcatgaggacagcttagctactatccagcggagccaggagcgggtgctggcctgcctgcaggacacatgattttacctctctgagcttcaggttgagttgctttcctgtttttgtttttagcttttttatgtataaaatgaagaatacaataatatcctcatcttcaaattcttaaaagtcatttcttatttaaactttcacctctttacctttttagcttagagataggttagatgatgtgatcaagtcagaggcctcagagaaataaaagaacaaataatgttatccatggggagggtgtgtcaagagtgaagtatcacagcaatctaaaggctttctttgctatgcatcaagctagaaagttgcaattgggtggatagatccttccagggcaacctccaactgtgtttggaagctaactacagggaacatttgaaagtttgtaaagatttcctggagactctgatactgaaataagtctctgaatatcatatccgattttttatattaaatgtacctgggtaagatgcatgagctcctacctctgtgaaggggaaaatacgcagagcaaagcctggcctgggttcagataccagcttcctgctgaatggtgagtggacttggacaagtcagagtcctgttctgagcctccttttacttccctgtaaaaatgaagctcaaccctgttgtatgagattcctgactgtatgtgagtcaggcactataggatcaaatggtaaccactaactcaagttgtaactatagtatcaaatgctaactattgttatcagatggtagctactatgattttgtctttagttccatgtgctataatcatctgttccatgaccatctccctgtgctgaatacatttctccccctcattatatactgtattgtgtagcatcctcaatttattctgagtctttggataatttgaaatggattacaatgacagatgcatttaaggcttaaatcttaccatagtattgaatcaacttgtaaacaattttttgccccagaaggaagaaatatttatatttttctttgatgtctgattgtttccatatgttatacccagatatatggagtccaagataaggtatagaatagttgtctccaaattctagtgtgcataaatatgtccctctgccaaacttaggtctcttttttaaaagatctcttattgcctctttctggctcagatctttattcttcctcagggggattgttgcaatagtctcctcgtcttttggggcctttgtatagctagttccactctggcttccagaaaggtctctcagaaggccacgtctttataaatcatcagtgatgcttgaattcagagtaatcagcctccaaaaattatttctggaaagacctcaggtggtaagatgataaaatcactagtcggagcagaattattgaataagtgagttgggaaacattcttaacttacatagttacatgatgactatttcccctaaaaaaaagtaagattactaggaaaaacaaaagaggagagaagaaatatatatagagacttagggttctgggaaaaggtaaatttattgttttgactagtggtatgttgatacatattggaaacttgagttttcagcaatgggtttaaaagtgtaaaaatctcaggcctgtcacgatttaataagagttaattttcaaagtttcctttcccttccctttctctttctttctttcttttcttccttccttccctccttttccttccttccttttccttccttccttccttccttccttttccttccttccttccttccttctttctttctttctttctttctttctttctttctttctttctttctttctttctttcttctttctttatttcctctttcttcttcttttctttctacaatgcttctgaaattttaacttgcaaaagaattacctgacactattatgaaatgcaacttccagatccctatccccagagattctggtttaataggtcaggatggggcccaataatttgcatgcctatcttgaaagctcagagtatgccaattgtcgtcggtctgaggaacatactcagggaaccaatactttagaaggtgtgtgtgcccactgagaaggttcaagccttgccgtatctttacataccaacgactttacttccaggcatctgatggcctagactcaattcagctttgaattactgggacagtttatattgagcttgcttatgtatttatattttaaatataaaccttattattatgtaaatctcatagattaatgtatcagatcatggagggtcagggtgacgtcaatgtaataagaatgttagtcacaacaacattctctacttatatttagcaactgttgctacgttttatcttaactaaaatgtgtggtggtttttaagaagaaaatgaagtacagatgccggcttgggtggtggtgaagctctaggcaggcacagtgctttctttgcctttctcacagagccagaggtcatctggctcctgtgttgccctaatcagacaccacaggccaaatcaagcagacaccaggctctggtgcagtgtgtcccgggagcctgaaacatcttttgggacctgacctacaacataacatcccatcctttaactttttttcaggtttattgaagcatatttcatagaccatacatttctcctatttaaagtgtacaggttagtggtttgtagcatactcacctggctgtgcaagccttcttcactatcttaattgtagaacatttcgatgccccaaaaagtgaccccatacatggtaagtcattcctcatctcccctccaccacccccagcccctgcagtcactaatgtactttctgtctctataggcttgtctaatttggacatttaacataaatggaatcatacaatatatgctctcctatgactggcttctttcatttagcacgttttcacgatttatctgtgttgtagcatgtctcattccttttcactgcctagtaatatttcatggtatggaaataccacatttgtttatccattcattggttggtaggcttttgggttgtttccactttttgactattatgaataatggacatgcatatgtcagcttttatttgggcacatgtgttcatttctcttaaatatatacctgcaagtgagattgctgacttaacctcctgcctcctttttcgactttgtaccttgacataatttatagtaaactttgaacaaaaaaaagcactgtgaggttctgtgtaccccagtttcccctgtgctaatatcttacgtatttatggcacgatatttaaaaggaaattgatgtcggtatactatatggagcttactcagattgtatcctttttacgtgaactcagttgtgtgtgtgtttagttccatggaattttaaccacatgtagacttgcacaatcactgccataatcaagaagcagaatagtttcatcatgaggattcctcctgctatccttgctgtggtttgaatgtgttccccaaagttcacatgttgaaaacttaatgcttaatgcagcagtgttgggaggtgggacctttaagaggtgattaggccatgagtgctctgacttcctgaatgggttaatgctgttattatgggagtgggttagttactatgtttctcatcaaaggatgagttttcccctccctctctctctctgtctccctgccattccaccttctaccaacggatgatataggaagaaggtcctcactagatgcagtcccctggaccttggacttgcaagcttctagaaccataaaaaaataaaactttgtactttataaattactaggtctcacataccctattatagcagacagcgaactaagacaatcctgttatggccgcacctgcactctcctatctccatttgtaacctgtagcaaccactaatctggttccatctctaccaatctccttttaggtaatgaaaatgttacagaacctatgtctattttcagcctgtaccagctatgtgcagactgggacaccaaaagatctattttctaatttaatccccagacacattgtttgaactaatttcagcactcccattagttttaacatatttatttttcttttcttcactgaaataaggccaaggcaaagtccctcaaacctaccgcacaaggggtttgataaacttaattaaataaatggctgctaaatgcaaaatgcttcacaagcatttacttaattactagaattaatttgatcctattgatgtccgtaggctgtgcatggagatctgtaactaaatatgcagtcatgtggtaaatattatattgctggggacataggaacaaaggaagaaacaggactgatacatttttaaggccttaaaaatatgtactcagcttcttgtctatttctatagttttacaataggaatataaatggcagtgcagaaacaccacatctctgaccttgatacttgaaaaggtgaggtctaaataaaactatttcgctgtctgaatactatcattatctttaatgagagtgggcatcacaaggacatttcaaattgtaccttaggcaataaattagctgccagaactatattcagactattttcctcaaaaatgaaaacactgatccatctgctctgtccagctacattatacatctgttcacattaatataaaaatctattctgaagagacttaatatgtctatcgttgtccttttcattgaagagcacatatctttctgagtacccctaataccagaccttcaaatgcaacaataggtttactagttactgttttttctaatggagacaaatcttgttactgataatgtttattttgcttttccttcacactcccatcttcttcccaacagaaaatgtgatgatttcctcaaagatgaccttcaatgctaatttagagcttgtgtaagatgtagcaagtcatttcatatacagtggatggtaatctctgtcttgagctttactaggtattgcagagaacaaagatattgccatacaatttttaagtttagctcaatttaacctttaccaaaggttaaacaagagagatcaaaatgctaatccaaggatttccatacatagcagtggagaaagagaaaggaagtctacctaactcagactgatgatatggaaaggctttctggaggaaggaagccttggatttagtcttgatgaacatacatattacaccgatatgtcaccatgttgcacccttgttgcactgttgctgttctatactgagaaggagccaccctgcactcatatagtgaacacctactcatattttaaagcttaccttaatggtgggaacatttatggtgtcttctctacctctgcagaaaagattactttataattacaagcagttcaaaaaatgcttgtttatggaacaatgtaaaaccaacaaaataagtcttcatcaaacaagtcttgcttttattcttattccttcttcctcttcctttccattctctatacataacctttataaaaatgctgttttcttaaaaaagataagcaaatacaaataagttcatacccccatttattagataaacattagcatagtatacatgcattgtctgtgcttttctctcatagctatatattcagaagctcagcttgtagtgttacgtgtggggatgcttcattcctgttcaaagctgaactatattccatgagtgcaacatagtttattcaactagtcctcaattgatgaacaccgaggatgatttctgtctttttgcaagcacaaatggtgtttttaaaaaaatatggaaacatcttttttcccccattttttaccagtgtttcttggagcagatcactagacatggtgtttctgggtcaaagtttaaatgtatctgtaattttgctagatattgctaaattccacatttaggatttgtatgatttttgcattccctctcagccacatatatatatgtatacgtgtgtatatatatatgtgtgtgtgtgtgtgtgtatcaaaataaaaggttaaatggacaaatatttatatataattagcaatgatccaatatctatgctcatgatatgagtgaccactcatagaaaaataaatgcaaataaatctacaacacataaaaacatgtctgaccttgcttataggaaaaaaaaatgctaaagaaaatgacattgaaatccaatttttcacatatcaaattagcaatgatccaaaagattgacaacactccactgctaagcctgctagggaaaaggcctttcccctataatataactaatattctcattttcattagcacttatttttctataagtaacgtcagacatcttttatgtgttttagatttatttgcatttatttttctatgagtctccactcatatcatcagcatatattcctataggttgctacctattgtgtctttatttttaacttgtaaaagtatattagaaatgttagtgctttgtgatgcaaattgtaatttttcccagtttgtccatttgccctttttttgtttattgtatcttttgccattcaaaaatgtttgtttatttttttaatttattttgaatattaggaaatttatctatatttttgttcattgcttctggattttgaatcattgttagtaatacttttgctgcttctaatttacatagaaattcagccttgtttttctctagtacatgtatgtattctatttttcaatatttatttatttatttatttattattattattatttttttaattatactttaagttttagggtacatgtgcacatagtgcaggttagttacatatgtatacatgtgccatgctggtgcgctgcacccactaactcgtcatctagcattaggtatatctcccaatgctatccctcccccctcccacctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcctagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtttctgttcatgtccttcgcccactttttgatggggttgtttgtttttttcttgtaaatttgtttgagttcattgtagattctggatattagccctttgtcagatgagtaggttgcgaaaattttctcccatgttgcaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcatcgtttattaaatagggaatcctttccccattgcttgtttttctcaggtttgtcaaagatcagatagttgtaggtaagtggtgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggcaatggcattgaatctgtaaattaccttgggcagtatggccattttcacgatattgattcttcctacccatgagcatggaatgttcttccatttgtttgtatcctcttttatttccttgagcagtggtttgtaattctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacaaggacaatttgacttcctcttttcctaattgaataccctttatttccttctcctgcctgattgccctggccagaacttccagcactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttgtagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgctacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagagttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagacatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttctgatctttgttggtttaaagtctgttttattagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttattcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgaactttttctctggctgcccttaacatttttttccttcatttcaactttggtgaatctgacaattatgtgtcttggagttgctcttctcgaggagtatctttgtggcgttctctgtatttcctgaatctgaacgttggcctgccttgctagattggagaagttctcctggataatatcctgcagagtgttttccaacttggttccattctccgcatcactttcaggcacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacttagttctcgagccttgggtttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcatcaaaatcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaatcaagcctgggcaatggcgggcgcccctcccccagcctcgctgccgccttgcagtttgatctcagactgctgtcctagcaatcagcgagattccgtgggcataggaccctccgagccaggtgtgggatatagtcttgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcacgcacggtgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccaccttcaatatttaaatctctgattcaattaaaatttgatcgtggtctgcagtatgaggagtggatttaatttcatctttttccatatagtttcccaattatctcaataccacatgtaattttttttgtttttctactgatttgagttgcctttatcaacaaatatctatagttgtgaattatttatttaaatatttagataaattattaaatattgaacctctcttgattttttggattaaacattcccttggccattatgtaattttaaaatacgttatttagttctgtttgctgacactatatttaaaattttgtgattgatattcatgagtgattctataattttggttttctttctttatgatgtttgtcaggttaaggatcagctttgcatttactttacataacaaatgtggaagatgggaagatatctttcttcttctgttctttggagaaatagaagtaccagtgagatgatttgttctttaaaaggttcatttgagaaaccatttactctcacaatattacaatcttactctattatctcagggagtttttttgtttttgtttttgtttttggagatggagtattacttactcagtgacccaggctggaatgcaatggcaaaaatgtggcttattgcagcctcaaactcatgggttggggggagctccttaaatacttttcctattttttataggaacaggtcgatttaaattttgtgtcagattgaggttaatgttggtaagtttaagacgctgaataacttgagatttagaaccatgtcttttttttttgcatgtgattttctcagagcttaccttagattagtgaaaaacaagtgcattctcaataaacgtgtgtggagtatttgttccataatgtgttaggcaagcaatgtaggccgaataatttagtaaacaaaagtgtatgcttgtacttcctgaaacagttggtgaattgcacatgtgtgtttaactttgtttccttacactcctcatgaagaatagtaaatggttttttttttatttttattttttaatggctctgtaagccagcagcaaatcagaggaactctttgtcgtttaccatctccaaaacagcaacttcagtgatggggtgctcataggagactgaaaattcacctggctagaaattaggctagaaatgagggaagctgaaggagaaggtagcccatctggagtaacgcactagtaacatgtatcagtagatgagcccatctggctgccacacactagtaacatgtatcagtagatgagcaatgatgtgtgtaaatctacagtagcacatcctgcccttcattgaccttacacacatggaatcaatgtctgtgctatgctcttgcacctgccgcatctcatgtaaaatgtctgttgtgggatatgctgaccagagctatgcaaggaaaggaattctggtaaatgtagttccagtttggcttaaattgacacaactcgaatccaccacaatggcatgacaaaaggagacaaatacaggggcacacacacaaaaacccccaaaatacaacaacaatactcagagagagagagagagagagagagagagagagagagaaagagagagaaagagagaagcaaaaaccacaggggaaaagggcaagaaaatgttgaaagcagaaagtgagtagacgaataggaacaggtaacagattaacataattataatgctgaatcttaatttacatgcagtgaaatccaagaaacaaacaaatccacattacaaaatcccccaaaggcacagaagtaggaatcatcagtcacctttgcaagtgaaggtgaaggtaagataaatacaggaagagtaaatctacatctgtgtaagaagtagttagattatcaatcctctttccagttgtggacacttggtgattgctccttcaccactgagagagaagactggaagtttttcttttggagaaaacacaattcctaaaactgagagaaaacatgtatggttgaagaaggttgtaccatattgaaaatggggtaaggtatgaaaacatttatatagaaagaatgctaagacctggccttcttctcttcagctccgagatattccacagccaagcatacatcctctaaatcatagactctaacaagagcaagagaaagacaaaagacactaacgtgagcatttctcacaaaattcttcagccagataagcctacattaaagtccttggaaggcaaaccacagacatttgtttacaaataccaagtagtatttcagggaccactatcaaatacgagagaacatcccagaaagcactattacatgaaatgtaagatagagaccaaaacaaaacacacaacaattaaagcaattaaccaaacaagcacagcttaaagggaacagcctatacggagcaaagaaaggatcaaaggtactgtaatatgattaatattcttagagacatgaatgaagtattgcgtcaatgagtcaagcatcacgtgctattagagaaaataatattcaaaggaaaaaaaccaatcttctataattttaaaaatactacaactgaaatagcttaaaacggaaacaacccaaatgttcttcagtggattaattattaaactgtagtatgtccatgttatgaaatactactcagcagtgaaactggaattgacaactgatacatcacaaagcttgaatggatctcaagggaattatttttagtgaaaaaggccagttttaaaaggaatatccagcttgagggtgaggagatgctttggggagacaactgtaaccagacgggtagctcaatatcccgtattacagcaagtcagaagaatccagaagatacttttgattttcaaacacattttcaaacatatgaaaaagataaaatcggccaggcgcggtggctcacacctgtaatcccagcactttgggaggccgaggcgggtggatcacgacgtcaggagttcgagaccagcctggccaacaggtgaaacctcatctctatgaaaaatacaaaaagtagctgggcatagtggcatgtgcctgtaatcccagctactcgggaggctgaggcaggagaatagcttgaaccaggaagtcggaggttgtagtgagccaagatcatgccactgcactccagcctggcgacagagcaagacttcaccaaaaaaaaaaaaaaaaaaaaaagaataaaggcaatatcatgtaattgtcccacatgtatccttcattcaggctcaacagttatcaatattctctcatttttatttcgactatcccctcctcacttgtttgatgcaacatcttatttatttgtttgtttgtgtttttttaaactgagacagggtcttgctctgtcacccaggctggagtgcagtggcttaatcatagctcactgcaggctcaaactcttggactcaagctactcttctgcttcagcctcctgggtagctgagactataggcacaagctacgcacccagctaattttaaattttttgtaaaaacggggatctaactatgttgctcaggctggtctcgagctctcagcctcaagtgattgtgccacctcagcctcccaaaatgttggaattacaggtgtgaaccactgtgcccagctgatggagaattttagaaacaaattgtggacatataattttactacaactacagtattcatagtgaacaactctctaacacaggacaactcatcttttaaaacataatcacactgccataattgtaactatcaaaattaaaaatacttaatataatctgttataaaatctgatctataatttttgtggttatcttaaaacatcttccctctctccctccctccctccctccctcccttctttccttcctaccttccttccttccttcttcttttcttcctttctttctttctcatcttttctttaatgtgtttgaattagggtctaaacaagatctaagcatagtgtttgactgactgatatatcttttgcatttcaactccatttttgccatttttgttgaagaaactaagtgaaacattccagtattgtagatttaactaattgcattcttacagtgtggctgggcatgtgggcctctttctgtaaattggtgtttagatcttggggctcgaatacatttatcttcaatttttgtggcaagaatgtgttttagatggtgttacatatgtcttattgtgccacattagaggcaccctgataatcacttttcatgatgttaagattgacccatgagttcaggtgttaattgaatccactgactaaaatatcccattaatgtttcaactaatggtttggcagtccttgatgatcattgtttaatcctttatctcactgggcattactaaaggatgattttcaaattctattattcttttgcagattctggtttggttattctctaaagacttttttcatggactgttaagttgcattcaaatacatttatacaagaaagacaggatatgatctctgttctttctaatattcaggacatgacttcattctctattaaacttcagaggggaccaatggacttgagtagagagacaagatagatgctacgtaggtagatagatagataaataaatacatacatacatatatacatacatacctacatacatacatgcatacatatataaattgattgatggatagatagaaactaataaattgtatatatttaacaatcaaagtgactattattttttatgcccaaattgtcccatcaaactaactcctgggctgttttgagataattccagtctttaataaaagtcttgtttttaggcaaagcaagacattccactttcattctgtacttttcatggtcccaaaattgactcagtaaaatcttttttccttttatgtgttaacttttatttagagacaactctctgtgcattaatttgcttcttgcactttcagtggtccaaatgtgaaaatgcatcattttttgaaagcattaaattataagcttaagcttattaccaattctaagatatattgcagaattttatctgtttgcattttatattttatcttttatgataagtaatttagtttctgttgataagacaattattagctttttcttgctatgtttaatagtttcataatataatagcaatatcgtttaaaatgaggttattaaatgtatttttatattttaaatttttttggtaggatacatcctactagtcaaactactgtttcaatatcaaatatgtttaaatctatacattcataataatactaaaaatattttcatccgttactttggggcaccctagggaaacatttcagcatttcgaaactgatgaattaaagtgaaagcatcaaccatgtaactcgcttttcccaaataatcttgtagtttagggaaatcaaacgatgaaggttgtttcagttttgtaaaacattcccattaataaatcaggaagggatgatagcattagattaaccacctacaagctggtttgtctttgggcaaagtacttatattttatgaactcatttacagtgtccataaatggcaatgctgttaccaggctttgccctcagagatctcccagttactgagccagcatttaaggaacaagtatatcaataacagtaggttaactaagatggtaaatcaccccaagatctcaatgacttagtgaaataaacatttattttatgttcacatcccatgctgtgtgacctgttcaatgaagtcaaacaatgataaaatccatgtctaccctattgatccatttcatttagcttcttgggatttttttctgagaattttggatgcctcactgatttgccttgggcaatggggcatcagcaaacatcatgcaagcagaggcctgacaagtactttgtttcttgctgttctgggaggctgtaccatgtaaactcccctgctacagtgtgagaggccacgtgggccgaagcaaagaactacagcttaccaccacccagcctggctgacccagcagctgactgcagatgcatgaactgcccagccaatcccagactaaatggctggcctgcagaatcatggcttagtcatgacttaaagtcaaatttggagttttatgtgtgtttgtttttatacagcaaaagaactgatgcactgaggatatagatgatggaagattagcaatatactgggagttgctgaagctggttgtgatgctagcaggatcctctctgtgctctttgtatttgaaagtttctgcaatgagaaagttaaaaagaaaatattaaatttcaatattgctttaaataattcctggttaaattatcttgttttcattttctttcaatgtttaagaactattattctaggctgagtgtggtggctcacacctgtaatccctgcactttgggaggctgaggcaggtggatcacacggtcaggaatttgagaccagcttgactaacatggtgaaaccctgtctctactaaaaacagaaaaaattagccagatgcggtggtgtgtgcctgtagtcccagctactcgggaggctgaggcaggagaattgcttggacctggcggaggttgcagtgaggcaagagcatgccactgcattccagcctgggtgaccgagcaagactctgtcaaaaaaaaaaaaaaaaaaaaaaaagaaggaaagaaagaaagaaagaatagaaagaattattatatttaacttttaaaaattattgaaaatagttttatggtttcaaaattaaaaatataagacattcagaaatgtctcactttcatctttgtcccctcccacatttttctctctctccatagttatcctcttatgttaattcttacctgaacattttggtagatattttagatagttgttagtaaatttggagttaaattagcaatttatatgtagaaaactaggcaaatgagaaaatatgacaattttaaatttcaagaaaaactaaattttgttcagaaaagaaaaagtaatcacattataatatgtagttaatctatgaatagcatttacaatgtcatatcaccaaaatagtaatcattgatgtagctaaaattattatacaactagactggatggatgggggaatggaaagttgtttttattttggggatggggggataaaaagggctaaattcccattttccaactgttaaataaatagataacttgtaaaagtaaaaaaaaaataagaagtaacaatatagacatgctatttagtcattccagtcaataacagaaaaatgaactaagaatgaaaagttatttctgtgcagaagggaagttggagctactgatcttttataccaaggcttgtggtttatgatgaaaattgaaaaaaaaaatcaggtatacaaaaactgtattagtccgttttcacgctgctgataaaaacatacctgagactgcgcaatttacaaaagaaagaggtttaattggactcacagttccccatggctgggaaaacctcacaatcatggcagagggcaaggaggaacaattcacatcttaagtggatggcggcaggcaaagaaaaaagagctggtgcagggaaactctcccttttaaaaatgatcagatctcttgagactcgttaactatcatgagagcagctcaggaaagacccgccccctaattcaattacctcgcaccaggttcctcccacaacacatgggaattgtgggagttacaattcaagacgagatttggatgaggacacagcgaaaccatattaaaaactcataaaaaaaggagaggcaacaagtcatgaaacaacactactactattaataatataggctcatattaatcaagcactttctatgtgccatatgtggattgtgtctttgaatccttactacaacagtatgagggaggctctttttgagttactgtagtctaatgagacaatttatacttcgagagttgattagctacctattgtaatgaaggattctaaaacaacacctggaaacaacagacattatcatctcagagtgtctctgggaccgtaagcaacttagctaggtggttctgtcttggtctctcatgcagctgcaaaaaagatgtccacagggctgctttcgttttaaggcttgatatggggatcttgctttggtgcccattctcagggcatgctaccaaaacttccaggctcactcctgtgggcctcttgcaagggctgccttgttacattggagttggcttctaccaccgtgagtgacctagaacacccaagatggaagtcactgttgttttataatctaatcttggaaatggtatctaccacactatcatattctatttgttagagcaagccagtaagtccagcccacttggagggaggatgtgattttgtcagcagaacatgaatcccaggaagtatctgtccatcacgggaattaccttagaggttgcctagcacaggtggggtagcttgtccacgcttccacagggagaaaggggtagccctgccaggaaaaaccacccattctgattccaaggtttatgttcttaactactatgcaactgctcacatgctgtggggtggtgtttcccttttgtgggacaacagcaactccttccacatagctgtcatcccgggaatgtgggagtggttgggaggtcaacatagacaacagctgattttcacctttgtgacaaacacccaagggcattatcaggtttaggcaaacaaaaataatctgtacattatgctcacaatgtggggcacagattgtggcactcccacatacctcctgctgcggaaagtttgctggaatgcaagagagaatgccatgagaacaaggataaccttgagttcactctaatttataaaaagtcaaaccctctcaggcttcataactttcctggtaataaattatttgagccacccctcacatttgatcatgacaaactgcagcttcctcttcctgggatgggacattagtcacaaggggcaggagttggctaggagaggagttggtactatatcttgaaagctgttgggagccactgaaatgtttaaagcatcatagggtgacatgattggagatgtagctgctgctctgagcaacagcattttgtctgaagcatcagacaacattctatattctcatatatgagacagtagatgtctcctttatacccccaacagatttattcatgttagcctaataaaatttatatatttcccaaacttgcagatttatcaaagctccctatctcaggacacctgaacctgcctctatctgagcatgcagacttttgtggctgccaatcaagctgtgagctttctggggtagagatttattgcctcctccatggttccatcctctggtggcaacctcatctgttgacacgtattaggaactcagtaaatgcttattaagtcaaaataaactgaacttcgttgtgcacttactacatgttatgtactatacttagtactaggtacataaaaataagacagtctgggccaggcgcagtggttcacacatgtaatcccagcactttgggaggctgaggtgggtggatcacgaggtcaggagttcgagaccagcctgatcaatatggtgaaaccccgtctctactaaaaatataaaaattagctgggcgtggtggcatgtgcctgtaatctcagctactcaggagtccgaggcaggagaatctcttgaacccgggaggcgagtttgtagtgagccaagatcaagccacggcactccagcctgggcaacagagcagactctacctcaagaaaaaaaaaaaaagaaaaagtctttaattagtaaaaagccatactgtatgtaagcagtaatttttttaattcatgagtcaaacattggctcaggccctgctgtgattgttgcactctgctagatgctggggcacaacatcaaatgacacgtgaccactactcttacaggttctgtaacccattgaaagagacacaatggtatttggatgatccaagctcagtatacagtgggagcaaggaggaaggtcatagagataagcaaagaggagggccatgtaagaggtgaggggccacattttgagaggcattacctctgcactgattttaaaagaatgaatgaatttaaataaatggaaaataaggctgggcctggcggatcatgcctataatcccagcagcttgagagactgaggcaggagaatcagttgaggctaggagttcaagaccaacctggataacagagtgagaccccatctctataaacatttttttaaaaaaattagtcagggtggtggctcacacctatactcccagctactcgggagactgaagtgggagatcacttgagcctgggagtttgaggctgcaatgtgccgtgagccgtgatcgtgctactgcagtctaaaacaaataataataaaaagagagagagagagagatgaatggaaaatctgaatgtcaaacatcagtatcaagccactggtactggtgtgttaaggcttggggaaaaagtcaaggatatagaaggagggaaatgaatacacatagagcaaatctaagtaggagttactgattcctgcaaagggatatgcagagccaagcaaagttttatctctgctgcctttgtctttccagccatctacgagcaatcctgcgaggtgtacaggcaccaggggaatacagccggcttcttctacatcgactcagatggcagcggcccactgggacctctccaggtgtactgcaatatcactggtaagggtgcagtagccctactcacacttaaccaccccacttcatggaaggaagcaaaaataaattcactggagggggatacctacgtgaataaaaatttgaaagaccaactggtctcctttggggaggaaatggtattctggtgagtaatgcaaatttgcagctaggttaattttcatgagacagaaaaaagaaaacttgttaatggtcttgataatgtttcactgaagcaagaattaattatcagtggttttctttagggcctccaagggcattttctctcctgaaactcaaaaacagaaagaaaaggtaaataagcaaacaaacaaacaaaactccaaatcagtgggaagccctgactcaggaagctggaaagcttgattccactctggccccaagggatgcatgacccttaggtgaatactatagtttctctgagctttatcagtgaaatgagaataatagtggctacccccagagctgtgagaattagatacaatcatgtgtattggagcagctagccaggctggttgttcttagatgcctaaccaaaacaaaacaaaatgaaaaggtgagttttttcatttttctctggaaatttcttgatagcttaaacttatttctcaaatgcagaaggacatggtaagaggcaatcattacatgggcttagaaatgacatatgatccttaatttaccatgaaatacatttccacaaaaccaaatcttgaggtaatcattatttaaaaatccagctatgcagccaggtgcgatggctcacgcctgtaatcccagcactttgggaggcctaggcaggcagaccacgaggtcaggagatccagaccatcctggccaacacggtgaaaccctgtctctactaaaaatacaaaaattagctgggtgcggtggcatgtgactaatcccaactactcccgaggctgaggcacgagactcgcttgaacccgggagacggaggttgcagtcagccgagatcgtgccactgcactccagcctgcgacagggcgagacaccgtctcaaaaaaaaaaaaaaaaatccagctatgcaagcactcctattatgagcatcattaattggcacacgcacattttttgtttgtttgtttgtttcaagcactggtcttcagagatgccagctgcatcatgtaatgaagcaggaacgtaggggcctctttaggctcattgagccttcaggcctcaggattttctgcaacaaagcaaccacatttatggagtgctttctgtaggcagacactgttttagatacagagggtatgaaaagtaagacacagtggctgttgttcatgaggcagtaaagtcaggaacactaccgtgaggtatctccagctaaatgcaagaaaactattggaaagaaatggtgagtaaggaagcacagtaatttgcccatctggatacaaagtcctatgctgtctgcgtagaaaatgctggtgacctggcattgggtgccacgtccttgcatttccgtaataactttctttatctctccaaaatggttgtatgatagctgcttttcaaaagccctgtaacataattagaaattgtgctcctgttgtcttttcatggttgtggtaacctatagtgttcaacaacctggtcaaaaactaggcttctcagtggatctcggttattttaaaaatgtaattaacatatggactcttgctaaaaaggcagatttcccagccccagaaattccaattcagtaaatgcacttttactgagcttttcaagtgattctgatgcaaattgtccctgttccacttttccaaaaaacagggaaagtaatttggctgcaaataaggcaaaagagataaatgcccactgctgagtggccaggtgtgacttgtaataataagagtggtataatggacagcaattactgagcttcgactctctctgggaattgagctgggagtttacaaataccatctcttttcatcctcacaacaaaaatcagaggcagacattttttttatctccatctaacgtagaagggaagagaatatgagcatttcatgactggctcaaggtaaattctgtgactaacagtcaagacttaggaagcgggcatagccttctggttcagtaataattcatatcactaaaatgttaattggatatgttctattacatacattttgtttttaaagtgttgttttattgttagaaaattttgtaacaataattgaagaaattttgagggaaaaaagtatgaaggaaatattaaagccaactgtaatccgcaatccagagattgccattgttattaaattattagaatttcctcaagacattttaaaatgaatgtttatgtgtgtttttgctatgaatgtgtatgttatatatatacatacagacacagaaatatacatatacatttaaattataaattttaattttaatgtgttgtgtagattttccctattaaaatatatattgaaattaagataaatatagcttagaaatgttaaactcttcaaaataatgcaaggacaaggacttagagagtctgactgatacataggtttcatgtacatgaaactctctgcctcaccatccaacagccttctcccagggtttatgtttgatcatttgtccaagaatggctaaaggtgagtgtgtacttgtatttaaaggttactgttttgctgatatgatcctgaagaaatcagagcctctgaattgtgtcccgagttgatcagcttgatgcgtatggtggggtatttattttgaatatgatttttttgggtcatattcagctgcacgatgtctaactttctgtttttgttttttaaaatacctgcaaaaataaaagcagaccaggcatagtgattcatgcctgtaatcccaacactttgggagaccaaggcaggaggatcatttgaggtcaggagttcgagaccagcctgaccaacatggtgaaaacccatctctactaaaaatacaaaaattagccaggtattgtggtgcatgcatgtagtcccagctacttggaggctgaggcaggagaatcacatgaacctgggaggcagagattgcagtgagccgagattgtgccactgcactccagcctgggtgacagagtaagactctgtctcaaataaataaataaacaaataaaaataaaataaaagcaaagctctgtgtaggctgaactacacaactctcatatttaaatggaaaacaattttctgatacatacatgtaatgatgatcaaatatgcatctttctatttgaaaattttataagttgaatgttgttaaaacatgagtgacttatcacagtatgaaaagtgtgacacagtggtccagggaagagagtcaggaagaagggagagaagaaacagaaggaaacttgtgctatctttaacactgggataatcccagaatgggtgtccagagcaccagaaggcaggaaaaccaagctctctttctgcaccttgtgcctgtcagctcagttaagtgcctggggcccaagcccacatctgtaaaattaagatctgggtcctctggcttccacagcctttcctcgttgagaattctctgagcttttctttgaggttccagagaaaagagacttttcttctaagaagtctacagatacttgcaaatggatgtcatgggactgaagatggacaggtttccattgtagaaagcaatagtacatttgagtcccagctgtctcctcttacagtgcaccctggggaacgttagctcccccttcctatatgcaaagtagtccctaacctgtcctgggagatgtaagtctgtgcatctcacctgcacacagggcagtcttcaggaggggagttccccaaatgctcaaccagcaaccaccctatgtaatgtaaaaagccataatctctgtgaaaggaaattaacttaagggagatgattaagcttactgataaagtggactgaatctggacctccgcacacttttgacggggtgccatccttggaactatgttctaagttgcttcaccacagggctatcagatgggagacgggg

SEQ ID NO: 541 - DNA, 30146 bp, Homo sapiens
ccagggctttttccttaatggtattttcgatttttctccaatctttttaaaggaaccagattgtgacatttgcagagaggaggggtcccatagtttctcatcatggttaactttctgttggaactcctcttctgccctcctactcttcttcctgctctgagttgtagtaatcctagtgctggctccaatccaaactcatagatttataaagcagagtctaatttagattcatatgtggttggaaaattgtacccataaggctagggttattgttcctgaagagaaatatatggttttgtgctgaagtgtgcaggagggttggtgtgggaggagggaggacatacaagcagccctggtgagaaaagcactggcggcatggatgtccacgtgaacttatgttctttagctgccacaaaacagcatttgccctgtggctacattaataaagatatgggctttagaatagggaggtgctctacagtgatcattcattcaactgacatttgttgtctgctagggatatgactgcttttgcatttagaaagcatccttaaagtaaaaacagaaaaatgtctggggttatggtgcatacgttctagatgcaggcttgtccaacccgcggctcgtgggctgcatgtggcccaggacaattttgaatgtgaggacttttttgcttatctgtggtgaacctgagtcctggagtgagtgcacccacctccctcagggtcaggagtgaatgctttaggaaccctccttttcagtgacctgcaaaagatagagggcacatttactgtgataacccagagtatcagccaagggggcttgaccttcaaggagttgtggggaaggttaataaagggtggtgtcccagggtcagaaaagatgggcagacagcaagggcactgcttgatatctatgataagcatgtggaattgaggagcaagcttcagattcagaatccagtgactaaggacatatctatatccctaagagaaagaaccttgggacacgatgatggttatatgctgggacaattccatcagcccttctgcaaaggagcctatagccatttaatcaggagatgggataagtattaacattgggtgtgagctgacattgctgcccagattcctacagcaccattatgtcccccatcacactggggcttacagaggccagggaataaacctagatacattatgccccatggtggaatcaccagttccataaatcctgtcctggttatctccccattctctgagtgcataattggccttgatgcactggcaactggagtcaccccacactgtgtccctagtctggagagtaagggatctcactgtgctgaagcccaaagggaaacatccctcatccaagccaaaccagaagcaatattgtgcctcagggtgggtcttgtggagggtactgcaggtattataggggtggcactgccattacagacctgaacgatgtggggtggtgttgggattgcctgttatctccatataactcagcaatctgtacctgcagaagcctgatatggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaatatcaccttaagagacctggacgaatcagacatcccacagaatactaaatctcttcatttcattggcaatatcacataaattgggaaggatgaacaacagcaggaaagtacgctgaattccctggcaaaacatgtgcactacagaaggtgaagataaaacttacagagcttcaagagtggccactgcagtgaagtgttatgggtccagtggttaggggcatgcagagctccccgccgccacacacacacacaaagtaaaagacacacttgcatcttgcatcctcaccagaaggaaggatgcacactaccttgtgagcctctctgggttctagcaacaccacattccacatctaagtttattgctttggctgacactctgggtgatataggaggaggccagctttgagtggggcctggactggaaaggacactgcagcagacccaggctgtggtgcagtcagtcaccatccctcagacccctggtgctggaggtggcggtctggggaaagaagcaggatggagctgaaccaagcatcagtgggaaagtcagaatgcagggcctgggatcaggagtaaggccatggagtccacagcagagaaacatgctccatgttagaagcaacttttagcatgttactggccctgataagatagaatgcttgagcataggacaccaagcaaccatgtgattccaagtgcccgtgtgtattggcttctatgtgacccatagagtcattcactggacaggcccagcggcatctatcatgagacgaaaacggtccatgtcggttgagcctcaattccatgttaacacccacagaaaacacccagtcctgatgtggccctgaataaccaaacaaattgaagacaaattgaagttagccagtctgcatcatggatcagcccaggcctgataggaaggacccgtgagtggagcaaccacagtggcagggatgaagctacaaatgagtccagcagcactgtctctccactaccaaggcccacccagctactgcttcctctgaatactctgctcgtgagcattgcagaccaatgataggcaccaatagggcactatttcttaaagtaactgactagcccctaagtgacaagttgaatagcttgagcaccatccatcctggaaggggcagaagtttatcctcacagggataggctcacagggatgcgatgtggtgtggttttcctctctgctctcagaccctcagtcaacaacactattggcattcctgatccactggctcagaatttcagtacactatctgcctgggggacacacctgttggggaaggggatgaagtgtgggccctgaccatgggatcccctggtcgtatcaccacctgcgcctctcaagtgctgccaggcacacagagtcatggacaggactctacaggcacaattcagtaccagcttggatgaaaccctctgaggaatgggtgccatctttcaggatgtgatgcatgtattgaatcaaagacgtctctaaggcactgttttcagaaggaagaatacgcgggtccaaaaaccaagaagtcaaagcaggtgtgtctcattccttatattcacccccagggtgatttacttataagtaaataaatacataacatgaatacttaaataaatttatttatgcatgtatgtatgtatgtatttattttattcattatattcacccccagggtgattttgctcttcttacttccaaaatctggactctgcagggtaggaggtcctggtttcccaaagagggcaccctggcaaggagacaaatgagagtccatggaactacacattgtggttgcacccagggatatttgaatagtatgtgcccagagacaagcaggtgagaagaggaggaggcagcgctgctatcacacaatgagggcaggagaagtgtgtgtggaaaccaggaatccacttggggacgtcctggtttcccttgtccgttgtgtgagcggaatcatccagcaacccagcctgagagggtttgatattcaagagcccagaaccctcaggaaggaaggattgagtgatactcctaggtaatgtcccacgtctctgcttctgtgctctgacatcctcagcaggattagtgcagaagccctgcttccatgagttgttcccagccagtgaccggtcacagcaagcacactaaggcaggccattactgggagacatgggactcctctgatggccaaatgtggctccaggactcctccatgcccttcctcaactctccttagactgcctctgctctaggatgcgtcgaacagaccttgtctccttctgtccagcacttggggtcacacttgcatcattgtctgccgccttttccagggatttctggctcgcgtctcatattcccttacaggtgtgtcccctcataagatgccgtagactttaagctcatcttggcatctgctccttggaggacttggactaaaaagcattgccatgtgcacaccaataactcttacttattccaacctgtaaaatccatctctttaaccaacttctgccacccccataaaatctattttgcgcgcgttcgtagtatctctttgaattaacagatatttgttgtattaagccactaaattttgaggtagtttgtgacacagcagttaataactattaaggctttcttaagtttctgttattccatggatgttatctacatcttttaatttcctgcattttaataatattagccacacttgctgtttctaatcctttcctcctattcttttttgaaaatgttcattttgtctttctctgtccttccatctttctttcctcctttcctccctcagagctttctccctccctccactttttcataaactctatgtggttaggctaaaaagaatcactatttgaatcttatgcttaaagtataatgccataatttacaggataaaagtaaagaaaaggaaggtattaatggaatatgaaaaaatgcctagggtgattctgtagccaagacaatggttttttaacatgtaatctccaccttcaactgaatgttttcagaacacatgagcaacataagttctttcccattcttggtacaagcacttgggaaatcaaattagccttatcttgtatgattaatgtccatacactgtataatcccaccatctgctcctgatcatacactctggggatatctttggctatgtgtcccagagacgtgtacaccaatgtttatggcaaaaaaactggaaacaatcacatatgcatcaatgggaattaacaaaattctgatataattacgaaaagtaaaattttagcagtaaaaatgattgaacagcaccctcccacatcagagataactctcctacacataacatgcatcacagaagaatacatatagtgtgagttctctgtacagcgaagttaaaaaaacaggtcagactgtgatttgggtatatatatttattgtaaaaatctttagagacagtgcaaaggactagtaaatacaagactcaagatagaggttccttttggtggataggattgggcaacagtctagggtggcttcataggttctgtttcttatgccaggagaggatgtccaggtaattagttacttgatcataaatctttatttatttatttattcatttatttttgagatggagtctcactcttgttgcccaagcgggagtgcaatggtgtgatctcgtctcactgcaacctccgcctcccatgttcaagcgattctcctacctcagcctctgagtagctaggattacaggcacctgccatgatgcccggctaatttttgtatttttcgtacagactgtgcttcaccatgttggccaggctggtctccaactcctgatctcaggtgatccacccacttcggcctcccaaaatgctgggattagaagcatgagccaccactcctggcccacaaatatttatagtggcaattttcaaaatgcaccttgtgtgccattcctgattatttggaaatgaaagagaaaagaaaacacaaaagttcattgcaaggatccttagcaataactacatgagttaaaacaaagccacagccaattgtaaggagccatgtgacagagagtaccaggatgccatgaaaaaatagcctttgatagaaataggtcatttgattcttggctaattggcaactctctacattctctggtgtacaatgttcaatctgatgtgcaaggcaattgtatctcgcaaagaatttgagaatttgatatgttgctcaattttaccacggatacaagtgaattaaacttttacagaatagaaaaaaagcactgtcgagcaaaataaattaaatgaaaacacataaaggaataactagtgatgaaatagcaatacgaatggaaaacacgaaagagcttcttttacagcaacattagaagcacaaaataactgtatttttcagaatcatactggagtccaaatcacttctaccacatctaattaaaaaacacagcgaaagatgttaaattgatcaatggatgcacactgaatacccagttattgaaaaatcgtgttcctagattggagttaaccatttccgcctaccacatcaaaccaaatctttgtcgtgatgctaagctagctgtacagacaaagatgtgagacacattttctctaactgcaaagcaccctgattaggcaaatatttttgtagaagcttgagtaagaaaattgacattttgggcattcttaaaaggaattagtagcttctgaggaaaaagaaagatagttatgattgtaaaggcattattatacggcaccagtcgtgggactctttggtctagctactgtattttctcaactttcttgcaactcatcaaagagaacattaatattaaaggcatttgcaaaaaaaatctgagatattgttgtatctccattctctgtctcaaagttttattcattactttacaaaagataattttaaagtattaaagaaaattagtcagatacaagaagtatttgatttacaaaatcctgaaacaataatgttaattgtggtgccagctacttgggaggctgaaggaggagcattgatggcatgagcccaggaggttgaggcttcagtgaatcatgagcatgccactgcattccagccagggcaacagagtgttactttgtctaaaaataactaactagctaactaactaactaaataaataaataatggaggcagtgcacgagccctggtgaagggcactttggctgcattgagcacttgcagatttgaggtgattacattctgtacgttacttaacatgcatactgtacatacttaacatgcatataaattctttgatactcctccttgcagaggtgcagcttcattcccttcctgtgagtgtggcctgaacttaatgactcacttacagactgatagagtaatgttgagataatagtttgtgactctgggtgtagatcataagactcactaagtctgggagcggtcactcacgcctgtaatcccaacactttgggaggtcaagagggcagatcatgaagtcagaagttcgagaccagcctggccaagatggtgaaaccccgtctctactaaaaatacaaaaattagccaggtgtggtggtgcatgcctgtaatcccagttgctcaggaggctgaggcaggagaatcacttgaacctggaagtcggaggttgcagtgagccaagatccagccactgcattccagcctgggtgacagggtgagactctgtctcaaaaaacaaacaaacaaacaaacaaacaaacaaacaaacaaaaaactcactgcagcttcctactttggttctggttttctctttctctgggatcatgagccttgggggaagccagctgctgtgtcataagcaggcctgtggaaagctccaagtgactaggaagtgaggcctcctggggccagacaataagaagatgaagcctcttccaacagccacgtgggatattcttgtgacttgtgaatccccagccccatttgagccctcagatgataaagccctggatgacaattagaccgcaattttgtgagtggccctgagccagaagaactttgagaaaactttcctggattcctgaccactagaaactgtgggacatgataaatatttgttgattttagttgctaagttttaagtgacttgttatgcatcagtagataactaacacaccttcacaagagaggatgaatcattgaatttttcatttgctctaaattgattataagatattaaacatgtcatttgcttttaatatttaacaagaattttcatggttatataagatatattttattatcactaacaatgatcaattttttttaccttcaatttgtatgttctattcaaacacaaaaggaagagccaggctatgctagggtgattctatgatgacaccccaataaccacccttggttgctcacattaccccagttactcggttgacactaatgtaggtgctgctgtgaagggattttgcagatgtattccaggtcccctgtcagttggctttaagatggggattatcctgcttggactgtcctaatcaggtaagctctgaaaaggactgggttcttcctgagaatagagactcacagtgtgagagggattcagtgtgaggggcttcctccattgtgggctttgaaaatggtgggatcatggtgaaagaacactggtggccaataggaagtagaagccctccccactgtctactctgatagcctgaaggaaacagggaccttagtcctacaattaccagaaaccgaattctgccaacgagctctatataagcttgggggagaatcccaatcttaagatgaggatacagctttgcgaaaccctgaacaaagaatctctgacactaggcctggatttctgatgaaggaaatgcagaaaaataaatgagtgctcttttaagccactaagtttgtggtaattggttatgtactaatagaaaattcataaacagattcaacagctaagcatatgacatttcctccaatggaatgaatttatgaactgatatgcatagtagttgcataaaaccaaatgtttcctaacttgctttgcatttttcattttgtgatttttgtgtgatacaatttttaacacaatcatatttcattcactcaagaaaattaacttagtgcctactatgtgccagatatgcttttagatgctgcagacacaactttgatcaaaacaacccaaagcccctgtgcttgtgccttccattttagaggcttcttgagagtgagatggagccattggagtgttttaagtgaagaaatgacacaatctgactcacattagcaggatttctgaccattgttgggagaacagtcatgggcagcaggcgaggggacagagctagggccgcaattcagtagtgacagagtagtagagactaaggggagaggagggcctgatgggtgacagggacagagagaagggctggagaagcaggaggtgaggtaaaggaacagagagaaagaattctaaagcaatggaattctcagacttaaacacagggttttatagatttttaatccatttatcctcagagcctggcacagtgttacttgcaccttggtctttaatacattctgtggggctgtctaataactaattgcctccttatgataaacaggttagaaaagaataccaggtgtcccaataaaatatgcacatagcttagatgtgaataattcctaaatataggcaggtgcatgagatggtcattgtggctcatgcctgtaataccagcattttgggaggctgaggcaggaggatcatttgagctcaggagttcaagactagcgagagcaacatagggagacctcatttctacaaatttttttttagaaaaattagccaggagtggtggtacaagcctgtggtgccagatacttggaggctgaaggaggagcattgatcgcatgagcccaggaggtcgaggcttcagtgagtcatgaacgtgccacagcactccagctagggcaacagagtgatactcggtctaaaaataactaactaactaaataaatgataaataaaggcggtgcatgagcactggtgaagggcactttggctgcattgagcacttgcaaatttgaggtgattaaattctgtacaggctcctggttgcaatatacggtaacacattgtgctttgtattgagatgtcctggactcgcgcacacaaactcagggctataagataaagataatttaaaaatacaacagaccagagtcacagatacacagtctgggaaagtaaaacttaactttgtgagtctaactgcaatgcgtttagacacatttatatataatggggccaaaaatcacctcttttacaaattagattcgtgaccattcaggggctaccaagattgtgctagccactgtactgcgctacccactgttactaagattgtgctactccgctgcgggaccagcggagatcctccacccaataaaagccccaggcgcctataccggattccattttcagttcaggcccaaatccccgggggttggtcgaggctgaggcggggctccgtcgaggctgaggcggggctcagcggcctgggctgaccgcagtcgctgggaatgggtctcacacccttcaatgggtacacagctgcgacgtggactcggactgcagtctcctcagtgggtatgaacataccctatcacggcgccagttacctcgtccgaaaccaggaactgcgctcttggactgcagcggacaaggcggctcagatgccctggcggaggaacaggcagagctgctcaaaacctacctgcagggaaggtgggcggagtggctcagcaaagtccttaagaatgggaaggagaggctgcagtgcccaggtaccagtggccacggggtgcctccctgatctcctgcagatctccttgagtcacattccaaaagaagggaaggaaaatgggaccaacgctaaaatatccctctccctcttgtgaggaggaagagtcctcccgggttttcagatcctatactagagagtgactgagggcctgccctgcactctgggacagttaaaggatgtagtctctgagggaaaggaggggaagacaatccctgaaatactgatccgcggtcccctttgtccccacagcagccttgggcaccaggaattttcctctcaggccttgttctctgcctcacactcaatgtgtatttgtgggtctgattccagcttttttgacctcggcctccgctcaggtcaggaccagaaatctctgttccggcctcagacactaaaactttctaaggaatagaagattgccccaggtgcctgtgtctagactggtgtctgagttgctcccttccccacttcaggtgtcccgtcaattttcaggatggtcccatgaggtggaatgtcccatgaggaatgcaaagtgcctgaattttctgactcttcccctcagaaccccaaagactcacatgacccaccaccccatctctgaccatgaggccaccctgaggtgctgggctctgggcttctaccctgtggagatcacactgacccagtagtgggatggacaggaccaaatgtaggatgcagaggttgtggagaccacacctgcagggtacagaaccttccagaagtgggcagctgtggtggtgtcttctggagaggagcagagatacacatgccatgtgcagcacgatgggctgccagagcccctcaccctgagatgggtaaggaaggggatgaggggtcatgtctcttctcacgggaactaggagcccttctggagcccttcagcaaggtcagggtttgaggcctgatggtcagggcccctcacgttcccctcctttcttacagctgtcttcccagcccaccagccccatcatgggcatcgttactgtcctggttgttcttggtgctgttttcaccagagctgtggtcactgctgtgatgtgaagaataagagcccaggtaggaaaggggtgagctccgagttttcttcttccattggtggattcccagccccagatgggagttggcttgtatcctgcctagtcatgaggcaccatctctgtctatcaacacttactcttttgtaaagaacttgtgaaaatgaaggacaaatttatcaccttcattggagtcatgggaacctgactcccagcagtcacaggtcaggggaaggtacccgcagaggacagacctcactaggacaattagtccagtttcaacacatcctcttacctagggtttcctgattctgacctgggtctgcagtcacagttctggacactcctctgggatctcatgaccctgcttcctccctggcctttcacagtttattttctttccacagatggaaaaggaggcagctatgctaaggcttcatgcaagtgtggtaggggtgggaagagtgatccctgagatccttgggatagtgtagacaggagcccatgggggagctcaccaccccaaaattcctcctttagtcacatcatctgtgggctctgaccagattttgtttttgttccacccgaaacagggacagtacccagggctctgatgtgtctctcaaggcttgtaaaatgacaacttagggggcctgaagggaaggaggagttggggcataggggacacaactaggctctggagattctttgatttggaatttttcagggtgtggtgggctgttcagtgtcacaacttactatgactgatctgaatttgttcatgactattttttttctaagactgccttgtgagggactgagatgcaagatttgttcatgcctcccctttgtgacttcaagggcctctgtcttctctttctgccaaggtgtctgaatgtgtctacatccctggtatcatgtgagaagtggggagaccagcccaccctcatgtccaccatcacccctgatattgtttggatctgtgtctccacccaaatctcatgttcacttgtaatcactaaggttggaggtggcacctcagggaggtgattggctcatgaggatggatccttcatgaatagtttaggaccatctctttggtgctgttcttgtgatagttctcacaacgtctggtgtttaaaagtgtgtggtacctccctgctctctctccctcctactccaggcttgtaagtcatgcctacttccccttaaccttccagcatgattgaaaatttcctgaggtcctctcataagttgagcagatgccagaatcatactttcatatagcctgcagaaccatgagccaatttaaaccttctgtctttataaattacccagtctcaggtatttctttataacagttgagaatgaataattcagaaaatcggtaccagaagttgggtactgcaataaacgtagctgaaaatgtgaaaatgtctttggaactgggtaacaggtagaggttggaagagtttggagagtttagaagacaagaaaatgggggaaaacttgcaacttcctagaggtttgttaaattgttgtgaccaaaatgctgatagtgatatagacaatagagcccaggctgatgaggtctcagatggagatgaggaacttactgggacctagagaaaaggtcacttttgttatgcattggcaaagaacttggaggcattctgccccctccttagggatctgtggaactttgaacatgagggtgatgattaagggtatctgatagaagaaatttctaagcagcatagcattcaagatttggcttcctgttgtaatagtctatgcacatatgtgtgagcaaaaaaatgatctgaaactggaactgatatttaaaggggaaatttaatatccaggacaattcccagtggagctgcaggagcaggacccctatcaggactactaaatggtggagccactggcaatgtgcaagctcagcttggaaaatccataggtattcaattttcacccatgagagcagctatatgggttatgttcagcaaacccaaggatgtggggctgcaaatggcattgtgagcccaccacttgaaccagtgtgctcaggattcaagatatagggtcaaaggagattattttagagctttaaattttaacatcttccatgatgagtttcagctttgtgaggacactgcattcatttcttttggcccatttattccttttagaatggaaatgtataagaaatgtctcttccactcttgtattaatattttagaagtaaataacctttttaaaactttacaggctcacagctatagggacttaccttgagtctcagatgagactttggaattttgagttgatgctggaacaacctagcacatttgggacaattgggaaattatcatattttgcaatgggagaaaaacatgagctctggctggctagggacagaatgtaatgatataaatatttacccccgatacctcatgttaaaatctgacccccagtgttggacgtggggcctaatgggtgctgtttgggtcatgggggccaatcttttatgaataaagagatcctgtcctctctcgcaagtgaatgaattgttactcttttagtttccaagagagacagttgttaaaaagagcctggcaacttcctaagctctctgttcctctcttaccgtgtgatctctgcacataccagctcccctttgccttctgccatgagtgggagcagcctgaggccctcaccaaatgctcaaacatttccagacatcagaatcccaagccacatgaaccttgtttatataaattagtcagtctctgacatttctttatagcaacacaaaatggaataagacagcgctctcatcacaggtatgtgtctctggcattcagcccccattctcaagatatccagggtccgctcagccatgagtcctctcatcaatattctaactcttatcactcaagagattctaaggtttttaggagaaaccagggacaaagactaaatgtttttgttatacctcagattacccgcttttctttgaccacatatcttttataggaaaaggattataaaagtaaagaggtattggcgtattatcagagtctcattcagtcattcaaaattagaacagttcaccatcctctcgtatgaatatgtctcccagaatgaagtcactcaggtttgcagacaccactcaaccttaccaggctccaaaaacaagaatggtctcaaggacatatggcttcactcttttaggcacccagtataattgacctaagagacaatatcttctcttgctcacagcacttttgaggagttaagctaatattgaattttcctcattatataaccctttgatttagtcacttaccctcagccattattcctccttctgtccctttatatcagtcttttccagttttagaggtgacatcaggtttgtctgctgtgctgacctagactgcaggcagcaatagtattctagcatgccttccctcggtctactcttggtcatagagggtaggttatgtaggtaaggaactagtgggggccatctgaccaccaggctatatagctctatttactgttaatcctgactttgccagatgaaatgaaggcatagcaccatctttgagttgcttgagaattcttatataaagatgtaaatatatagttatggtttttggcttaaagataattcctgtttctggcactttgattttcatccctattcctggtaccactgcatcacatatgaaaaaagaaatttgaggtgaagcgtagtcattattccagcatcctctccccttcagaagaattgtatgtatagtcataacagcatcatcctgatccatcaggtaaaagagaggaagctatctagaggagtcactcttgcagccccacccatgtggacagtgagcacattcatgaagatgtaaaagccagtccttcatgtttatattgcccaacaactatattgccagtttttagacaaacaatgcttcaactgaccatttcaattttctatcaaagttttcttctgaggaggacatctccctgtgcattgttagccatttgaggctgtaaagtgtgttttcttgcgtaaagaaatgggactcagcagtccacattggtgcaatctctttttttctggtgatttcatagcccttgaagcattgacctcttcccctggttgagcatagcccaatccagagtcagtgactttcctgtcaagatcccttggcagctcctttggggttgctgccatcagtctggcttgccagccatgtatgatcaaagccttcccactagagaatcacatagccatctgctgcctctgtctgttttcttgaccaacagtcaaaacagagatgataagaaatgagataaattaccaaaattgtgaacaaaagagagattatcactagtgaccctttagaaattcaaaagcattataagtgaagactctgaaaaacctgaagtcaataagttagaccacttagataaaatggacagattcatacaaagatagaaattgccaaaactgactcaaaaataactagaaaacctgaaataaggaaaaacaaaaaataataatgtattgcttgctgttttatctggcctaaaaagcccatttgtcagccttcagtcctttggcctaagtttagctcaaataaggactgtatatgccaagctttaattctctatgtgaatgataaaaccccatcttcacaagaggagatgggttatgctgtttgttggattagtgaattaagccccgtgttcccccttaaagagaaataaaaagagcatagtaaagagccctcacccagtgaaaagccctgggatcccctaacacgcttgccctacaccctatacatctcacaaagtagaggacagggagatcagggggcaaaaggaaggtcggaggaaaaggatttgggaggtcatgaaggagctaaacccaatgctcccttaaatccttatccaaacttgaggaaagaattagaacaatgtaaggaaggacaaacctgataaaaacaagcaatggggaaaggattcccgatttaataaatggtgttgggaaaactggctagccatatgcagaaaactgaaactggaccccctccttacaccttatacaaaaatcaactcaagatggattaaagacttaaacataagacctaaaactgtaaaaaccctagaagaaaacctaggcaataccattcaggacataggcatgggcgaagacttcatgactaaaacacaaaaagcaatggcaacgaaagccagaattgactaatgggatctaattaaactcaagagcttctgcacagcaaaagaaactatcatcagagtgaacaggccacctatggaatgggagaaaatttttgcaatctgtccatctgacaaagggctaatatccagaatctacaaagaacttaatttacatgaaaaaaacaaacaactccatcaaaaagtgggcgacggatatgaaaagacacttctcaaaagaagacatttatgtagtcaacaaacatatgaaaaaaggcccatagtcacttatcattagagaaatgcaaatcaaaaccacaatgagataccatctcacaccaattagaatggcgatcattaaaaagtcaggaaacaacagatgctggagaggatgtggagaaataggaacgcttttacactgttggtcggagtgtaaattagttcaaccatcgtggaagataatgtggcaattcctcaaggatctagaaccagaaataccatttgacccagcaatcccacaatcccactactggatatatacccaaaggattataaacattttactataaagatacatacacacatatgtttattgcggcactgttcacaatagcaaagacttggaaccaatccaaatgcccatcaatgatagactgaataaagaaaatgtggcacatatacaccatggaatactatgcagccataaaaaggatgagttcatgtcctttgcagggacatggatgaagctggaaaccatcattctcaggaaaccatcagctacgtgttctctgggtctctcagagaaagacccacaagaacagaaaaccaaacactgcatgttctcactcaaatgggagttgaacaatgagaacacatggacacagggaggggaacatcacacactggggcctgtctgagggtagggggctaggggagggatagcattaggagaaatacctaatgtagatgatgagttgatgggtgcagcaaaccaccatggcacatgtatacctatgtaacaaacctgcatgttctgcacgtgtatcccagagtttaaagtataataatgataataataataaattggatttgtaagtgtgcctttaacaagtactgaggttaggaattttaaaaaggaaatgaggccactctcggaagatcccctcagtttagcagaacagctagatcaatttttagaaccaaatttttatacttgggctgagataattcaatcatgaatattctgtttactgggaaaaagacgggaataattagaagggcagccataatcatttgggagagacagcagcatcctcctgggtaaggagtcctgccagctaagcagaaattcccaaatgcagatcctggatgggataataatgaccccagggatcgggtccaaatgcaagaccatagggagctaataattagagggattatgcagtccactcataggacacaaaacgtccccaaagcattcaagatccaacaacaagaagaggagactccctctgcatttctgcagaggctcagggatcaagtgaaaaaatattcaggattaaatccagaggacccagtagggcaaggccttttaaaggttaattttgtaactaaaagctgatgtaatattactaagaaactgcaaaagattaacggatggaataaaaaaccaattaaggaaatactgagggaagctcagaaagtttgtgtgtgtgtgtgagagaaagagagagagagagagttaagctgctatacctgaaggaagagagagccagcggcacagctgtgtgtggcagctggcttctaaaagctgttgataaaggttactgctgagtcatttccgcagagctgcctgtttttgcagacagacaaggggagccagggcacagcacggctcggctcatgcccagagaaagaggaagaagctgagtgtgagacagaaaggaaatgggatggcagagagagaatagaagaggaaaattagcaagagagactaaaagagacagagatcaaagagaaacacagaaggtaaaactggggagacaaataatgtaaaaggaaaaaagagtacaagacaaagtgagagaatgctgagaggttggcagggctgggggaagtttctggggacttaagcaacaaggaggtgcaggggaagggtgcatgcagtgcgtggccactgaggaacgacaaaacccgggaactgggggatggatgcaagtgagaaagggatgtggaggagagtttaggatcaggctgcctgaggtgtaatgggttgcctacagcaaaaactagatggctgtttatcaggaggtggtcaaaaggattcaagttatggaagagtaaatgaataagataacattaaggttttgttgttgttttagtgagaggctggaaggccaccaggggcagttagctgtcagtaaggcagcagaagggctggggtcgctacataaggaaaatcagtactagggctgtaaactcaaatgactacagggccagcaaataataaaaaggagggctgcagggctgggtgggaactgtggcggctgctcagctcttcttacagtgctggcactgtgttttcagattgtctgctttgtcagaggacaaaattctgactttttatgtaaaatataattttaaaatgctgatattctgttcaaataacttaaaaacccaaaacaggcaaaagaggatgccagtttgcaatccctgaagtagagagagctcgtgctggggaaaagtctgccaaaatgctttaaggtggaatgtgtaaaagttctgtttcccagagtcgggctgggccaggggaggatccttgcagcccaggaggaggaaaagccactaagtcccctcccagggctggacaaactggagaccctttacagttgctgggtcaccagtgggggttgcttgaaacacaaacagtgcacctctaggcctgccacggagaggaacggtgcctttgaagcacaaaaaaaaaaaaaaaacaggaagggagggcggagccagaaatgccttttctaatgagagtacccatcagggaaggctccataggctggcagatcttcaaaccagcagctcttggcccaaagccaaacccagcagggcccggccaagggcactctgggatgccagctgatcagtcccttgcctccccaagacctcctggggtcaatgggccctcgggaggtgactaaactaacaccagccagtttcttatgaaaaggagaggagaataagaaggcgtcagagtataactgtttagatatcacagagtatcaaactaaagttagtaccaaaccttaaaggaactctactacataatgggatgaggttgtttatgaatgggtcatcctgagtaataaatggtaaaagacacaatggctgtgctgtcatgaacaaaaacaaacaatccttatgtgaaaaagttaaattactcaataactggtcagcccaaacctgtaaattttatgcttttaaccaaaccctaaagctcctagaagatcaagaagacactatatatactaattccaaatatgcctataaagtagtacacacctttgaaaaaatctggacagagcagggcctagaaaatagcagggcaaaataattggtacatggggaacaagttttagaaagcctcctgtttccagcagagacagccatagttcatgtaaatggccatcagaaaagaaacactatagaagctgtagggaacaggcttgtggataaggctgctaagcaagtctccctggaggaaaaatttaaactgtttagcccagatatccctaaggtgatattaaaaccccaattttcaaaagaggaggaaaagctaggcaagataggagccacttaaactaagaatggaaggtgagtgctccctgatgggagagaaataataaacaaacccataataaaaaatctaatgttggccgggtgcggtggctcatgcctgtaatcccagcactttgggaggcggaggcgggtagatcacaaggtcaggagatcaaaaccatcctggctaacacagtgaaaccctgtctctactaaaaatacaaaaaagtagccggggcgtggttgtgggtgcctgtagttccagctactcgggaggctgaggcaggagaatggcatgaacccaagaggtggagcttgcagtgagccgagatcgtgccactgcactccagcctgggtgacagagcgagattctgtctaaaaaaagaaaaaaaaaatctaatgtctatattgcataagggaagtcattggggtccccaggacatgtgtgatgaaatactaaagaattatgggtgtatagaaatgtatgccctggctaaacaagtgtgtgggaattgtgtgaactcccaggaaacaacttaaggttaaaagaacttgtaacacaaaccccaccccttgagttcacagttcaccacttccagcctggcaactcagtgctaattaagacttggaaagaagacaagctccacccaagctgggaaggtccttatcaagtgaggcagctgtacaaacagctgatcaggggtggacacattacactcgggtcaagaaactggttaaaaaaaaaaacggaaggtaaattggaagtgtatagatcacctaagaaaccctttaagctaattctaaggaaaacctaaaagtaagccataagcaggctccatcactgggggctgatatggttagaattaatcctaacacaaggggtgaaaggaaacctaagtattgtataagaaccacacgccacctaactgtaaaaatttaaagtgcaatcctatattaattactataaacaacccagctactctaaaccagaaatcttgaaggtataaattaaaaataaatatctcagaaaggaatcccgtgggacggttagcttttaggttagtcaccaactctaccccaagcccacccagaattactagaactcctggtcccattaacttcctttaacccaccaaacaataaacctaagagagtaaaaataattaaagtaactgacttaaggcagactttaaaaattaaaacaggatatagagacataaatgcctgtgttaaatgggtgaaattttcagcacaagccctcgataaaagtaactgttatgcatgtgctgctggtcaacctcaggcacaggtggttccatttccccttggaggggatactaatcccaaaggaatgtgttgcgtgttggctgtataccaagacaaggttgcatggggaaataagacttgtaaaagtctgtcattgctctttcccactttgcagagatcagatcctaaagcaatcccctcattctctatagggaatataaatcactcctgttgtcactctagacagaaggtgaggttcgataaacctgtgggaaaactcgcaacctgcacccacatcctaaatgtcactggtaacccagactgtggcaaccattcaactctccatataccccaggcaaatgtctggtggtatttcgggaaagggaacctccgtaacttgttaccgtccaattggaccgggacttgtgctttagtacaattggccattccgttcaccctgtcattccatgaaacagctaaaaatacacatggtcatagagatcagagtaatttagcaatttattttaacccatatataatgtgtgtgtgtatatatatatacacacacacacacacaaacatatacatatacatatatatacacacacatatatatatacacacacacacacacatatatatatatacacacacacatacacacaaggcttctggaacagtggatgaaagctttgtatatctatctatccatctatctatctatttatctatctaaactccataggagtacctagaggagtgcctaataaatttaaagcacgaaaccaaatacctgctagatttgagtcagcacttttctggtggtcaactattaacaagaatgtaaattagattaattacatgtcttataatcagcaaagattcatcaattacacgcaaaatgcccttaagggagtagccagacaactaaatgccactagctaaatggcttgggaaaacagaattacactggacataatattagcagagaaaggtgatatatgtgatatgctgggtggaaaatgtgacacttccattcacaacaatgctgccccaaatggaaccatcataaagggatggcagggactaacaactctagtcaacgagctggcagaaaacacaggagtaaatgacctttttactaactggttagaaggttggtttgaaaaatggaaaggaatggtaccttcaattcttacatctctcgtgattatggctggggtcttaacagccataggatgttgtatcataccttgtgtgaagggtttatttaacacaaaggttaattaaagcagctattagtaaacaaatgcccctaatgtcccaacagaatgacttactattattaaaagccaaactaaacttctcctcctataatgaagaaagtaaaaaacttccagaacagttaataaacaaagatatgtaagtgaaaataagaccaaaaagggtaaaaagaaaaagaggaggtaagtgtaaaaaataacttacatgtgaagaaggttcattttcataagtgccttagaatatgtttaagcaggccacatggaaacaaagagataaagaagcaaaatatactaagccacaatcccctccttcctgctttccctttgacccagtgtccaggagcctactggtcagggccccctcaatgacccccctccccacctcaccaaagaatttagtttgggctagcttgccatcacctaagtgcagtcactaaggccgtaagtcaaatgctcagagtcttgagacagttgccatgtattatgggtggctgcaacaaaatgcagcaaaaaatgcagcaaaaagaccctaaagaacatacctgaagtcttaatacaactaccaataggtgatgcccaggaagactataaccccgtagtactcagctaatgaggaattggggaagggacttgcacactagggaagaaatagtttgttgaaactgtcccaggtgtacctgcactccagacacctgatcttgcaagactgtcattaaaagtctctctttcgctgttctctgggtctctgagtctattctttgggtttgaatgggtgagtttctttctcacagggatgtagatggcaacgtggctctcattcccctcccaaataccccaactttcatcgcctgttccagaagccttgtcacctacaagcctatctgcacagaaggtatgaggggaccctacagcccagacagggaccctcccatctctagcaactgtccccttttctcacctggaccctctgcacctgatgttgtcttcttcttgcatcaaaggacacagagaataataatactactaataatactaatgatgatgaaagcagcaacagcagcaacatatggaatggctggtcatcaactctgaagcaccagggccatccctgaaaaaaagggcctattacacactgggcacccacagccacagccgttcctgctgcccccaccctggcctgatcctccttatgttggaaccctcaagggtggtcccaggttcactagaggacacagggtgagtgctgtgattcctgctgtatcccatggagcagatgaccctctgctcctctccttggggaatcctgcaggccacctctgtgtggtaggtcccatcccattggacagaacaccccaagactgctgggcatcctggctcaaagacgccccatcctgtcaccaggtcagagagatattctggagatacaagccagagcccagcatatcagggtgatgttgccctccagggcctcactgcaggccacactcatggtggaggagtgggggactggagaagaaagggcagagacaatgaggcacatggccaaaccctgctcccctctaatggagatgcagggaatagggctggtccgctccactgctccgactctggcagaagtcctcacggaccccagaccttctgcaagtctgtcctcaccctggggaccaattcctcaaggctggcagaaggatgggcctcgagactgtgtctttatgctctgggatccctgcattgatgctgaggaggggaatgtcagggctgggctcctggtacatggggccagagggaactcttagggatgggcaggctgggaagcagatggggcagccttggccctgggggcttcctctcctgcctgacacccacccaggttcaggcttctgtcagagggcccactgcttccccagattgtgacactggacccttcaatccctgacccactgtctttttccagtggctctaacaggagagaaaaatcaggatataacacaccaacagaaaacacatgcatccatagcacaaggagggtttccctggacagagttgggggtcggggtgactctagtggaataggggagaggaaagcccctacccaggcccagtacctgctctcctgacacccacacaggattccagatactgctgtagtttctgcctgcagtctacccatatagggtgagagtgtgtctcggccggcatagcatcttccttctagaaatttgtgatgttcatagcaaaggtctgagttctggaggactgggatactgtccattcctgagtctccaggttgagagagaggaagagctacccataagagtaggaaagcctagagcccctggtgctgctggcttcctgatctcacaacccctaatctcctggagggaatgcaaggctacccccacccagcagttccaagtgaggaactcagaccagaggagacccctccctggccctcctccatgcctttctgtgtgggctgagtgccaggttacctccccaccgagctctgctgacccctattcctcacccctgcccccagccagatccagtggggacagacaggtccctgctctctgcccccagctctcctggaaaaggtctcccatcactcttgcctgctgccacctctcacctcccttctgtcccttgatatatgccagggcccttctgaggtcctgcccattctctgtcaagtcctcagtctctgtgtcccaggtctcagctcccagaactgcttctgcccactgtccccgggacccagccctgcctttctgcctgttgaagagcaggaagggctgaccatccagatgtccctcagcaagaaaccctgactgcacagatccatcccgggacagcaccgtgaggttgtaatgaagactgtggggccctggggaacaagaaaccacggatgaaacttcttcctggaagtaacttcacattgatgtttaacacacaggtctgctgtctcaacctttctgaggaggcaggaaatgtacatatgcaaagggacaagaatgaggatttcagatacaaggaaaactgggagggcaggaggatggaggagcagactgaggaacagaagaagggggaatggagatggcaaacatgtaggccagctgccaaggcagggtggctacaggccacctaagggtatagggaggaggccaaggagagaggctgccctgcagtggtgagggaggagcacgaaggcagtggtggaaggaaggtcttgccagaggggagggtggaaatgggaagggacccaggctcagagggacccatgaccagcatggctgtgctacacaggtgagggtgagatggagtcgcgggccgctgcctttgaggaaggctcatcatgtacaagatgggagtaagggaggatcagtgcatcttttccagaaacagtgccaggaaaacgacattcacatgcaaaaagaaatgaagttggactcctgacttacaccacatatacaagttaactctaaataaatcaaagacctacactcaggaactaaaactgaaaaattcttagaatgaaacattgggaataatcttcatgacataggttttgacaacacttttatggatataacaccaaagcacagacaacaaagaaaaaattgataagttggacccatcaaaataaaaaaaattgagcattaaaaaacacaatctgcagagtgaaaaagcaaccattagaatggaagaaaatatttgcaaatcatttatctaataaaagattaatatccagaatacataaagaattcctgtaacacaaacataagactcaaaaaaactatgtaggcaaagaatttgaatagccaattctccgaagaagacatacaaatggccaatagacacatgaaaagatgctcaacatctgtagttattagggaaatgcaaatcaaaactgcaatgggctactacttcacaccaattaggatggctataatcaaatacacacacacacacacacgcacacacagagagagagagagagagagagagagaaagcaagtttggcaaagaggtagagaaactggaacatttgtgtagtacattgggaaagacaaagtggggcacctgctatggaaatcagtgtgttgcttcctccaaaaactaaaaaattaattactatgtaatccagaaattctacatctgggtatttacccaaaagaaatgaaagcaggaacattaaaaagatatttgaacactcatgttcatagcagcataattcccaataaccaaattcatagagacagaaagtagaaccagtggttccaggggccagggggaaggaggaatggggagctactgtttagtaggcacagagtttcaggatgcacaaaaatgtgaatgtacttaatgccactgaactgtacacttttaaatggtgaaaatagtgaactttatatgtatattttacaacaattaaacaacaaaaaagaaattgtcaccgcgtaccaaacaataatatagaattagaaagaggctggggtcctggtcagagagaaaaaaaccaaggcctgaggaagggccttcagagaggagtggtgctgaaggcggagcagtcacactccaaaagagggctcaggttagaaaaccctcacaggaggaaggtggtgctgggagaaggcccagaggaggggatgaccacagcccactatgtggtaagtgaagattttggatatgaagtctaggaactgacagcccaccggggtcaaggaaccgaaagaggatgagggtcaaggagccgttggactagagcctgttttgggtctgggtgggggtgaggagatgggcagggcaaggactaaagggtggcatgagaaggaagtgggggtgaccctgggagaacttggggtaaagtgagaacaggaagggaggggttgtctgggggagggtggggtttggggaaggtgagaacttgctgagggccgaaggcagctggtcaagaggtgggaacagcataaggtcccaaggcagagaggggcagagggaccagggagggatggtccagcacctgagggtttcagggtggggtcctcaagagggtgaggctgaggatgaaggagtggggaacgggtcacctgaggcagggcccagagcaggcatctgcactggaggggagggggcatctgcgctgccctgcgccctgcctaaggcccaactttcattagcaccagggctccccttaagtggcctggaggggagtgggatggagggaagactcccccgacaaaaggcagcaccagaaagttagggtcagggacagctgggaatggagaggcataggggcagcactgggtgaaggctgcttgtaggaaaggcccataagggaggcaggagggacgggagcaggggatgagggcagaggacaccctacaaatggatcagagaactgcagatagaaaggggtagcagggagcagggagggcaacaggacccagggggccatgagaaaggaagctgaggaagtaggagggaacttggtgtccttagatcattggagtccacagtagctgggagggttgacagagaggaaagaaccctgggaacgggaggcgaagggataatgagctggggatgggagcagtcgcaggaagaatcctctgcctggagccggcaggctccaacccctcagcttgagagtcaggagccccatagtccccacagcaataggaagcaccagctcctggtcccgaaaaaaggagggccccaactccagggactgcggcccgccctggagctgagaacacgcggactccagggagaggacagggcttcagggacccgagagccgctctgagcaccgggggatgtgactgcctcagcggcagagctggaagggccctcgaatgccattcacaggaacagcccaggaacccagggacttcagaagggctggtttgtccgaaaagtgagaggaggcggaggagaggtgaggagagcaagtgcaagaagagaccagaaagtgcagggggtgggggtgatgcgcgatcccgaggaggactgaaaagagactgaaaagcagggctgaggagtggcggcaaccggcagcgtccagctcccgcacctcgctgcacatcgcacctgagccccgccgcgaccgcatcgcgctcgctgcgacccattcagaccccccagaaacgccaagccgctcccgctctagccgagggctagaacaatcctgccacctcagcctcctgagtagttgggactacaagcgagtgccaccacgtccagctgtcatttaccatctggtaccaacccccattagacaatgaaccatccatgatcacgaactgtgtcccttccatcttcgtcagctttaggagcattttttttcccaatggaactccacctatgattactaaccattccccaggacccctagcctacacttttctgtagatgaaaatgtcatacaccacagagttttaacaattacttagttttcccatccacattcactgattatttatttcgagcattatcatttattgagcacagcagggactggggtcttgtccccaccttagagggattatttacactgctaaaggtcacaagggtagtgaggggcagagagggagatggacccagctctcctgacgctggtcccaagctcttccctccacagtgtctaccctctctcgaggactttttctccctgcggcagttccagcaaaggatctcattcagctcacccccaagaaga

SEQ ID NO: 542 - DNA, 31605 bp, Homo sapiens
attggtagtgaacctgctgtttaacatcacagtgactacattgaacccagtatgccagttggcaccagatgctgtggacttggaatgaggccaagaggagtcgccaggatgtgagaggagagaggaatccacaggaccaccagagggtgagtgaaccagatatgcaggtcagagatagacgaagtggaaccagagagctgggagggaccaaggttgtaagggtgcttaagccccaccataacagctaaggagtcccaggagatgatggctcatttccacccaaccccaggatttccacagcacacacccacaggcctggacctgggacgaagatgaatgaagaatatggacatgtggatgtggtttggctcacgtgtccctgcaataaacaaggagtcagtactcagtccttgggtgtggttgaggcttgaggtcctgattgagcaaggcagtactggacaaggtctacatcagcattcaagttcaatggggggcactagtggcttcaaacttcctggtctaattatgtctttagacacttaataactactgagggccttgaggagctcttgtttatttgggttgatatttgttaatatttatggcatttgacattaaaacagaaaatgttaaaatgttatttactaattcatgttaaaatataatgaatgaaccaaatgtaggttaatataaatagaatgctttctgaaaaatcaactgttgtgtccaaacaaaaaaacaagaagtgtgacactggttaacttgtttcaaatctgatgtctggcttaatggaagatgtttgtattctcatatctgcttttgtattaaatctgttggtatatcataccctaccaagagaatgagatcaaaaacaacaaatgttatattatgatgatgatgatgatgaaaatagtattaagattggggactccttaggagtatatcagagttctccctagacatccccagaccatgtttggaatagtggatcctggaagtgaatccatgagctgcttaattttaggtgtcaacttgactggattacggaatacctagacaactggtatattatttctggatgtatttgtgagtgtgtttccagaagagattgacatgtgagtcagtgggaaattctcccctcctattggctgggggcccaatataacaaaaaggcagaggaaaggcaaattcttctctcccctgagacattcttcttctgctgctcttggacatcagaactgctggctctcgggcctttgaactttgggacttgtaccaggaagccctgggttctcaggcctttcactttggactgagatttacacaatcggcttccctagttctgaggctttcagacttaaactgagccatactaccagcatcccagggtctccagcctacagacgagctgtcatgggatttctcagcttgcataatcacatgagccaatttccctaataaacacccgctcatcatatgtatctatatctatatggtattggttttgtttctctggagaattctgactaatacaatcaggcatctaaaattctgacttgaatggtagtattttaggtttgagacaattcaataatccaacaggaatgaaaaaaatttaaatagtccaaaattgtattactgcagttacaaaaaggcacattattgaaagaatccagagttgttgcaggaagtcagggaccccgaatggagggaccagctgaagccatggcagaaaaacttaaattgtgaaaatttcatggacatttattagttccccaaattaatacttttataatttcttatgcctgtctttactgcagtctctgaacataaattgtgaagatttcatagacacttatcacttccccaatcaatactcttgtgatttcctatgcctgtctttgctttaatctctttatccctttatcttcataagctgaggataaatgtcgcctcagggccctgtgatgattgcgttaactgcacaaattgtttaaacaatatgaaatctgggcaccttgaaaaaagaacaggataacagcgatgttcagggaacaaaggagataaccttaaggtctggctgcctgtgggccgggcagaacagagccatatttttcttctttcaaaagcaaataggagaaatattgctgaattctttttctcagcaaggaacatccctgagaaagagaatgtgttccgaaggggaggcctctgaaatggctgctttaggaacgtctgtcttttacagttgtagataagggatgaaaaaagtcccggtctcccgttgcgctcccaggcttattaggaagaggaaattccctcctaataaattttggtcagaccggttgtctgctctcaaaccctgtcccctgataagatgtcatcaatgacaatgtgtgcctgaaacttcattagcaattttaatttcaccccgtcctgtgatcttgccctgcctccatttgccttgtgatattttattaccttgtgaagcatgtgatctctctgacccccaccctattcatacactccctccccttttgaaaatcactaataaaaacttgctggttttgtggcttagggggcatcacggaacctgccaacatgtgatgtcttccctggacacctagctttaaaatttctctcttcgtactctttccctttatttctcagaccaggtgacacttaaggaaaatagaaaagaacctatgaagaattatcgggggcgggttcctccgatacagagtgattctttcaacctctggggttgagggccagatcatatatgcccctgaaagtcatcatgctaacctgggctttacctgtgagaggggagccactggaaggcttggcagaaaaaaaaactggacttacttcagatgctagaccaagatgggctatgtgtaggggtggtggatggaagcctgaagacccagctgggagctactgcagtgatccagaggggagatgccgatgacttgtaccagggaggagccatggaatgatctgatgctggatttattttcaagacagagtaaaaaggctttgctggtaaacctaaatgtgctgtgtgaaaaaggaggacatcaaggatgaccataaggttttaatcctaagaaatggtacagatggagttgctacttatggagatgaggaaactgagggagaagtccattttggaggccagaggaggagccagcatagaatccaaggtcagttttggatacgttcgggttgaggagcttactagagatccccgtggagatgcagagtaggcaggtcaataataaatgtgcatgccaggcacagtggctcatatctgtaatctcagcacattgggaagccgaggcaggtggatcacctgaggtcaagtgtttgagaccagcctggccaacatggcgaaatcccatctctactaaaaatacaaaaattagatgggtgcagtggcatgcgcctgtaatcccaactactcaggaggctgagatagaagaatcacttgaacctgggaggcggaggttacagtgaaccgagattgcaccactgcactccaacctgggagacagagtgagactccatctcaaaaaataagtaaataagtaaataaataaaatgatagcaataacaattaatgtgcagtccaggcaacaggtcagggctggaaacacaagttattctttctgtattctgtatcttcatgattgttgccactgcctgtttcaatttaatgcattagtgatctattgctgcttaacaaattactgcaaacttagtggttcaaaacagcagacatttgtcattttagtttctctgggtcagaagtccaggcagaccttagatggcttctctgctcagaactttacaaagcaaaagtcaaggtgttggccaggctgtatgtagcctcatcttgtcttgactgtgggagagtcctcttttcagatcactcaggtcattaacagaattcatttctttacagttgaaggactccctgcaggctgaagctggaggctgctctaagctcctacaggccacctcagctccttgctatgtgggtctccaacgatgactacttttgtcttcaaagccagccaggaagacagagactctagagtgggtcagctagcaagacagagtcttacactacattatgtagtcatggaagggacatgccatcagctttaccatattttattggttagcagtaagccataggttcagctcacactcagggaaagtacaggctgcaaactgcaagaggagtaatcataaggggtccactccagagtctgtaggctacaccatatacaagctcaaggttctcccactgtaactgccctgcttcccctttcccagggcaatacaccacacttgcctttctctaggtctctacttccatgaaagcaaagtctcagaaagagaacacatgcatggccgtcaggcactgtttgccatgatgatggccactgctgtaccacaccataaacattgttttacagttactagtggattcccaatcattaaatccattatacatttctattttcccctcccaccgccatgctttttttttttttttttttaagagagataggatcttgctctgtcaccccccaggctagaggtcagtgacgtgatcatagctgagtgcggccttgatctcctgggctcaagtgatcctcctgccttagcatcccatagtgctgggattgtagctgtgagacactgggccttgcttgtctttatacacctctgtcctttctttatggacaaccctgagttcttcatagacctgcctgagtaggtgttcctgcctatgtggcatctgcctcatcaatccccagggccctcttcttggtctttccctgctcctagggagatctttctcagaattcttgctccacttgctccagaactgctgaaattccttaggctttggtcctgggctctcatttcacaccacatatactcatatggtccaatccattttcagagcagacccccactggcacctatcccataagcagacccccactggcacctgtacttctgtctccagccccacacattccctgaactcagtgcccactaggcatctcacaatgagtgtatccaaaataaaattcccatcaaccctgcctacccatcatcatctgaatgactgacaccacctaagagtcattttagccttctcttgttctctcttaacccaccacatccgactgatagccaagccctgctatttgtacttcctttcaatagtccagcttagtggtttgatcaaagactctggagtgagacagcctgggctcaaggcccagctcagaaagaaactacttgtgtgaccttgggaagtcatttaacctccctggacctcagcttttacgtctataaaatgtgggaaataaggtacctcttagtgttgttgtgaatcttgttaatatatgtaaatctctaagcacaatactagcattgtagcaggttctatgtaagtatttcctagtattaatgtgagtaatcaatcaagtcccctctcctccattgccaagctgccatcatttcttgcctagagtgtcacagtagcttcctttctggtctccctatctcctaacgtgtggcccaccggatgaggatgggatatattgtgcaaccccagcaggcatcatcccatggaatacaatgtaaaaggtgccccctacctcccatcttccctggcacctgccccactgctattttcagtgtacacattttctcacgtcatacttttcagatattttcccttcaccttcacactaaaactccaactcacagcaggcaactgtcgatgttttctccaggggaggtggatttaggagtcatcaatgcagggatcagaattaagcctttcagaatggaagacaatgaaattcatttagggttaatacatgcaggtgctgtgctaactcttccttaaataacttatggaccatgtctcatttccactatagacaaagaaacagaaacattgagtgattagttaaccagctttgggttccagggctaatgagttgtgcatgacaacagatgaagatagaaaaaaaaaagcctagagagagtagatagtaagccagtgtgcctgggacatgctgacagatatctagatgtagcataaagaaaatttgtgttcatgggaggtcctaatggcagcaagaggtgagataaccatgagaaatggacatttcttggtgagactaactcgataaaggagacaaatctctgggcattttgccacacctactgcatgcaggacactgcactagatcttataaaagataaagagaagatagcatcaagtgcctaggtcttgaaggagggctgagtgcacttttcatttagcgtacattcttatgacttacttttttatcatacactgttgtaagcaaactgcatgtgttgtctcattccatgctcacagcaacaactcttaaaagtcaagtactattactgtcattattttacaggtagggaaactggggcacaaagaagttagagaactggccaaaggtcacacaggccacctggcttcagaattagtgctcttatccactctattatgcaacctctcctcactagttttgaacttcagtggctgagacctactacatggtaggttctcaataaaaatttgttgaatcactgaattcatttctgccccatttcacatccatttctttcccaagacttctttgtcagagttcggtataaaggactgatgagaaatggacccagggcctcacactttggaaactacaaagttcaacgatacaaactattggtcccagaaactcctaatctgaagcttagcacctcagctgctgtgtcaaaaatgacttggatccttcaggcaagggtggggtgatcattcttactgatataatttcaagcagcacagcttctgatagactgtgaatttaaaaatgagcaaatgggctgggctcagtggctcatgcctgtaatcccagcactttgggaggccgaagcgggcgtatcacctgaggtcaggagtttgagatcagcctgggcaacacggtgaaacccagtctctactaaaaatacaaaattagccgggcatggtggcacatgcctgcaatcccagctactcaggaggctgaggcaggagaatcgcttgaaccttcggagccggaggatgcggtgagccgagatcgcaccattgcactccagcctgggcaacaagagtaaatctccatctcaccaaaaaaaaaaaaagaaaaagaaaagaaataaaaatgagcaaatgaacatttaaataaataagtatgatggataaatagggaatgaacagtggtatggattataataaagtaagaaagtttcgtaaaatattaagtatatcactataatctacatggtaggcatattggtattcaccaaaaattctttcacctttgctttatgttttagaagtgttatggtaaactgttgggaaggaaaagggggagggaagaattgtgggattctgttggtaacagagaccagaaataccattggcttaaacaaaacaagggttttcttgttttttcttgatgttgttgtttgttttcatgtaaaatgaatttagatggcggtagtccagggctgacctggcagctcagagatgtcattcatgccccagcctgcttctgacttcattctctgctgtctctgcatgtggctttcaacctcaaggttgcctcatggttctaagagggctgccgcacctctagttcaaaagtctacatccaagacaagaggaagaaggaagtacggagagtgtacactcacactcccagctatcttggcctccattctgaaggatctctgggagaaacacaagcccacaactttacctacaaactattgattccaacttagtcccttgttctctggtatctatgagatagcagagcctattgaagtacccaagaaaattaggctttatcaccaagaagaaagggggactgcatgatgcagaagggaccagccatctcaaccagatactgcacagcctaaattcaaactgttacaatataatcaaatttcatcaaccccagtcacatcttaatcttaggagttttgatcactgacttgcaaatccaaaaagtgtgttttgaggtcctaggccacaggaagaaccagtttgtctcacagacctcttacagagatggcatttgtagtctatctagattccagcttcagataatatgtactccactggcagcacgagaaataaatacacaggaaaatacaatatagcacaaaccaggagctgagggcgaatgaagatgctcagaaacacctgcactaaaagtttcctgaaaaaggtaaaaaatgtcaatcagcactgcctctggaaaccagaaacattatattatttgataacagatcctaagtctggatgctggaggtgcttaaaaatgtgcattgcgtctggctttctttccatgtatacatttatttgacgctgtagtaaaatctcctccttcaggtacccatattcatgcaagcaaatgttagcaaactgccacagtagcattttaattagtgcacaactttctctcttcaccacattataatcttttctcattttgttctgctgctatttctattatgataaaagacttaagtaaatatgtagaaatacttatatacatggacacgcaataatgattcaaatagataaacacagaaacacaaacactaagggaggtacggctggaatttttctgcaacgtgtacaattcaatgtactttcacttttcatttcaaccctcctcagtggtttcctcccagcaactgatgagaaacatcacctctgagccaatcaaaaaactaattcttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaagtaagtggggaatgttgattagagcctgggctacaatgcctgggaggacaagagctgaatcgctgagagtggtgagtgggcatgcagggagagtacttgcccagggaaaggggtgcagtgcctctgtgtgtgtgtgtgtgtgtgtgtgtgtgtgtgtgtgtgtgtgtgcgtgtgtgcgcatgggcacccatgcacacatgtgggcacatggagaagaggcaagtagtgcaaagaataaagacctgcagatattgggatttggtggaaggagagggagacaacataaatgaagaaatattccaactgcatgttcttaagaacttattgtggtcagaaaagggcaaaaaagtcgctaaaatctgttttggccaacacaagccatctattctaagagattctagaaagagatgtgccttatagattcatatgtaaatttgttcattacagaaatacttataatatagaaaaatctgaaccagcatacacatacaacaggcagggggtagacaaacagtgcgtggctctatcataaaagagatttctatgcagcttttaggcatcatgtttttaatgaagggcaattatttctcattttaacagcattagatccatacattaaaccttgttttgtatgttttaggtacagtatctgtttttccttccattaatcatttcctcataacccaatatatgtgtttcaatggacacaatctatttcattgtgtgaatatataattattttgtaatactttactaattttggctatttcaattatctacatttggctactgtatagattttattatatttaacaacctcagacataaatttttgtcttaatttctgtcttttttttttgcctcaacaataattcctataagtggaacttttgggtaaagcatacaacttttttttttaatagcatttccttggtagagcatgtaactttttaaagatgcttgctgtatatatgaccaaaatgctttgagaaatatttatatttctactaccaaagtatatgattactactacagagttttaattttattgattgactaatttgtagaaatgggggtctcattatgttacccaggctgttttaaacccctgggctcaaggaatcctcccaccttgaccatccaaattgctaagattgcaggcatgagccactgaacttttattcctttatgcttttcttcatttgcaatattgactataatcaggaagaaaatataaacatcctttaaaaagaatgaaaacatatgtctcactctaagcagagcagagaaattgttaactttgaaaccagtgataataaaaatgataccccttctatagcaacataaagagaagttttgaggaacagaagatgtgaaatgcaatatttagtctgggtcagtgcaagatccaggcgagggtggaggatggccggctgcacagacctctgttccggtgctttctcttcatccctccccacctccctctgcagaccttgttctcagaggccattcccagactcaggtagctacagcagcgggtgttgtggctgcaggcctcatgctcctttgctttggaagaaactgttgaggagttagtatttactgagcagcttatatgttccagtcagtattatcactcataataattactgttaagtaatacatgaaaaatcttaaatttaaagcatttcaatattttaaaagtaaagggagcaaaaggccaacgtgttcttttgctcacttaacttccgatcttcagtttagcatgcatctttttagactttttcaggcgtttacatctataaatatgcagaaatgtatagctttgtttttgtttttcagttgaatcattagtgtagttctgcaacatgctttttgaccgcttagtgtatcaccattatctaggttcatgacaataaatcaactctttttacctgctgcattgaattccctctgagggatgagccgtagttcctctaaacagtctcctgttgggtggctggttcagtcggttaccacttttatactttaaaaacagtgctgcagtgtcattctcacagaggcttctctctgcactcatgcaagtactttgctagactagacatcagaaagtggaattgctggacccaattgtgcacattcgaaatttcacacttcatgatattgtatgaatcaataaagttccaatggttttgtcccatgaacaagatcacacagcttgtgaatcttagagcctttacctattgcttaccttctttatgtccttaacactaatatagtaggcctcacccattgtgggtgctcagtaaatacttgttgaatgactttatgaagggaagaaagaaaagatgagtaaggcctggtcttattcaaagctctcctaatcaatatctttgtgattaaacgtggtgggttcagcccctgactgacttcagagcctctgccaggcagtctgcctggatcccaccaggagccaccaggccataagttgactgtagtaatggccaagagtttgatgcttgaggagtccacagtgttggacacccacagagctgaacaagggtgggaccagggaatccagtgaagagggtccttcatgaatcagagggggatgatggaagcttggacctggcaagggaagtgtggggaagtgataggattatgaatattttaatattttaatgcagtagagtcagagatgtcctgatcagataacagatattatttttacagatggttttccatactggaacccaaaggtaaagacactcaaggacagacatttttggcagaggtaagatcttctttggtcaccatacttgagttagccctggggaagtggacatttccatgcagaagcctaaagcttcttccaggccatagtgtctgtcccacaccttctggtatctcttgatatgcagcatagatgaaaatggcaagttccctggctttccttctgctcaactttcatgtctccctcttcttggtccagctgctcactccttgctcaggtagggaatgattccatgattccacatttatgtttctgaagcagacaattatctcaattacctaattaagcagacaattacctaaatgccctcttagaacctttaactcattcccatacctggaagtccatcccaacctgaaggaccacctgtcacaaagagacaaatggtccttctgttaggattgtgttcccctctaggttctctgtatctcgccttccctgtctgagaaggacccttcctctcgtgaccccaactccaaaaccctctgatggagcttcccccttgtgctgacagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcaggtgagcctccaggttttgttctgagaacacttctctgtaggatctagagcagatgcagagtccctcttccaaaagtactgcagacactcctggctgctcactagcaattgtctgcactgcctcccaacttagcttctctgcaacccttaagaaagacacattctttctttagaaagaattcctgctgtaccttacatgccgaagtaaacaactccctccctctgacaaccagagatataagggaaatgaaggacgacggataggaaacattagaaatcatctctttagtgactggtacacagtcattttggtttagtcatgtaacagacggcttctgttgtgtctccaagtgcacgttaccgtgggtcctgggaggtggaatggtgactgtatctgctgccagtgttttccaatcagtgactcccagaaacatttttgtagtataatgaggcatgtttcttacttgttgctttgaggaagaacacacatcatggggagctgtggcgaggtctcagtaaggttttagagcagatttattttacaatttgggcttgtgttaggggatttgggggagggtttatagacttagctctcttctctggatgagatactgtcaggaaggtgtggggagatgaattctgagagtgggagccttaatcaagcttatctaggaggaaggagactagggtgagactaaagctgtaaatgatgaagaggcagcaattcctcattgctgatgggggatgtttggttattgttgtggtttgtacaatgttcatgtttttctctgcactcacaaaagattggggtggtcttgtatttcccatgatctgtcacagtgataaagtactattttttgtgttctgtgaaattacttatgttcaacaggaggataccaagacctggtatcaggttccagacgccgaggagagcttttttctttctcagtgcaatcccttgcctcatggcttctggttgggtttggtttaaggggagctgtagcagacaatggtaggaagaagagaaaagggagaggtctgggtgcttattccctggcttccttcctgcaagattccctcaggctggctgcattgccttgctgaaggtcacaagtcaactcaagaaagtcctcaatgcatcaatctttttatgtctccggaacagatccctctcctcctccctctggtaattggggtggatgggaatagccccacattactgaccctgggatactgcactagcccatttagttttcttttcatcatgaccacacttgtgtaaatagctcctgaatgaaatcttccttggattatcaaatgtgagtctgccattgattcccattgagaccctccctgatacaggagctctcaagaatttagggcaatttatccttctacagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcaggtcagtaccctgcttggcctcagctttactgagctgagctgtggcaggtgatgaagggggatgtgtgagtctctactgtgtgagtctctgcggtcaacctgggtctctacaatgcatgtaaggctcaaagcagggacctgaaggctactcactgctttaggggagcttccccacgccacaaagctgttcatgccacaaacatttactgatcacttcctgtctgacagaaacagaaagtgtgacaggcagtgggaattggggaaaaacattaagagaagctccttatgtaaagtcaaatgacaaaatgggaaaacatatatatatttacaaactcatagagaaagagctaatctttttgaaacagaagagtttgaaaactgagtaaaaaatattaacaaaggtcatgaattgttaattcacaggaaaagaaataacccacaaaagagtgctcattctcactcattagggaaacatatctgaaatcatttttcacttatgatattagcaaaaatcaaaaccccactgccttgcttgataccacatggctatggcaggagtgtaggaaggcagtgactctcagtcatttgctcgtgtcacttgtatttttggtgtgcattagcacaagctctattgggggatctatccaaactacatatttattgatccaaaattccagttctgggatatgcttgcatttgtatgagatgatccatgtaaaaggtttctgggggtttttttgtttgtttgtttgtatgttttttgagagggagtctcactctgttgcccaggatggagtgcaatggcgcaatctcggctcactgcaacctcctcctcctgggttcgagagagcctcctgtctcagcctccccagtagctgggattacaagcatgcaccaccacacctggataatttttatatttttactagagatgtggtttcaccatgttggccaggctggtttcaaactccagaccccaattgatccgcctgtctcagcctcccaaggtgctgggattacaagtgtgagtcaccagcccggcctataaaaagtttcttatagcattgattatgattgtataaggttagaagctatggagatgctcactgatggtgaacttccatacaagggaatactgcccaactgtgaaagaaaaaagagataattctctctacactaatatggaaagatctccaagacacactttacacagaagagtgagatgcagagtgatgtgtatagaatgttatttttagtttaaacaagaggaaaaataggaacatattttaatttactttttttagttcttgattctgttatttaacttacatttttaaaatttaacaagcaattttgtaatactcactgtacatcaagtactttatttacttatttagagacagagtctcactctgtcacctaggctggaatgctgtggcacaatcttggctcactgcaagccccgcttcctgggttgaagcaattctatagcctcagcctcccaagtagttgggattacagggacatgacactatgcccagctaatttttgtaattttagtaaacatgggttttcaccgtgtcggccaagctggtctcgacctcctgacctcaagtgatctgcctgcctcggcctcacaaagtgctgggattacaggcatgacccactgcagcccattaggcccttttaaagtattaatttaattcttctaacctcaggagataggcattatcattaccctcattttatagattaggccactacaaacagagaggttatgtaagtagtccaacatcacactgctagtcacataggggagccagcatttaaacccttgccctctgactccacagtttatgtccctaagcatcatattaagtggactaaggaaaagttaatagatggagggagggagtactaggtagatgggagagttgcataactttatgtacatgaagtttttgaaccatgtaaatgtgttactggttgaaaaaatatttagaaaaaaatgagtatgactctgctgaagttaatttccatacgagaggcagacctctcaagatagtaatagtagtagcttgtagtgagggtttaccaaagtcctctctacagtcctctgagactttagggacagaacgcttatttaacctcatgagatggattccatgcccccaacctgggctgagcagctaaagcttggggtgctgaggctggggaggctgagtgcactagctcccatgacccacagctctccccttcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagaggtatccaacgcaagcagagaatctaagcccctggcttgcatgccccagcctgaagatctcacccccattcccaccctgacactgcatcaagtttaaggtttattttcccaaaaccccccttacccataactgttctttttttcttttctttttttgcttattttccagagaagctccaggaggaactcagtaagttcccattccccaggagacccaggcatgtcttcttatccccactttgagcaccttgataacccttccctattcattccattgcagagtggaggaaaatccagtacatggctcgtgagtgactctgacattttctctgaatttgaatcttgaatctatgactctcttctgcttggaaattttccagcccataagtctttgcccagggttgaaaaatggtcctagatccctttactcaggaaaagaaaataagtttggctctttggagaaaccacccagaaggagtctctctctctcgtctatctctctctctaagaaaagaaaaagaggtcttcaatctctttgtactaggggccacagacctttatgccctaaaaagcactgaggaatatccaggggtacacttcaaaaggaagagagaaggatgaggtgcattttctgtggcaggaaacttacttgttgttttccataatctagaggatgttgaaaggaaaacaagaatggaagatttaagagataagaaaatcagaaaagagagagggagacaagtgtgtctaataaagaggaatagctacagtggctcagttggtacagatttatcataactgctttcaaaaactagtccctgaaattgctcattaaatttcccaaattctttttagagcaaggtaggaaatgatacagattgagaagggtggatcttgtactcctagacatacacatatagacatggtgacacctatgcccaggtacaggagtatagacagattcaaaatagattagctggactccactgggaaggaactctcacagtgactgccctgccactagcattcaaccaatgttcccagacttgatattaagaagaagaggtgaagagagaattgagcttgcagagtgagaccacagggaagagtggaatggtcaaaaagaaagtctagatggatgcgaaaggaagtggaaggggccaacagagcaaaggcagtgttcaggtgacacctctatctttctttcattgtaggtggagagaagtctttggcctatcatggtgagtgagcctgatgctctctgggtttgctgggtcatgtacaatgaacatttcaactttttctctgctgtgacccattgacgttctcagttggattaatcagatctaacccttagactcaattttgcatggtagggggttgacttctgcttttctggagcctctgagagactcctgaccctgcacatgcccaggcaaagcataaccatgcagcctgcaccccccatggcacagggagccgagcctgacattgtttagaaggtgccacctctgatctatcagagctgtagaggaaggaagctgaagcctggaagagactctgaagaaaaggagagaaaacgtgtagtgaaaggagaatggagtggagaaaagaacaaaaatactgacctttttcttatctgtgtctccttcctttcagaatggaaaatggccctcttcaaacctggtgagtaaatcactgtatgttccctggatcaacaacctgagggactatattcctttctcctcctccaactcttgtgatttagggaagaaaagttcccttgactaagaaagtttggggtagacaacattaaatcccaatctgaaaagtgggcccatctccaagacccttcccgctgagagcccagggaaccagggagaattgctctcttgggcttcctcagaccttcctgggaaggaagacacataaagggtggagctgaggggaaggagacacacactgagtgatactgcagggagagtgaggatgcaaatgccaaggagaggaggtgatgcctgcccaaagaactttgcacttcccaggcttctcatgccccctactgcctgtgtcacctcaaatgatttaatgcttccgagctttcgcctccacatttttaaatgaaaattgcaatctgtgttttgtgggggtgaggtgaagactgaagtaataataaatatccactggtcaaaaaccaagtaagaaagagatgacaagttcaaactggttggttgaaaaaggtttgcggaaaggagggataagggtaagcaataaggaaaagtgcagtgcccccatggttcccaacagtggggagctgtcttcactcctagcctgggaggtctaggaaggggaggcagttactggaacccagagaaaagtagctcaaaagagagggctccctgagaagagtcgtcaggccttgttagagtagcatcagctgctgctggcagggaggaagcaggagaataaacagtgtgtctctcctttctttctccttccaatcttctatcagggcctcccattggccaaacccaacagcaaaccagaagacaagggagcccagtggcactatccttagagtacagattcctaggacccagaagagggtggaaaaagctgaaggctggagagtgaatctggggcccctcatagagcccagcatagagacggccttgcagctattagaacatcaggagcttccttcatgccctgctgtgggctgagtaaataacatgattcccctatactacgctagagagtcatatttttatccccatttttcaggtgacaaaatgcttcagatgaggctccaccttgttaaataaattggatgtatggaaaaatagactgcagaaaaggggagctcatttagttcataagcggtcgagtgaagattgaaaattaacctctgagtataaggcattagggggcagagtcaatgtggggagggaaacaagaaaaatgtagcaagaggatccttattgcttcctgaggcagcatcagggtattgggttaggcagatactgaccttactttcatttcccctctggacacaagaccccttgagctttctcccatgacattgatgagagagtcatatttagagcaggctagggacgccaggttctggaaggacctccttagcatggtccaggccttgcatgctgaggctctgaaatccaggaaaaatggctgaccccatggacacctcctcaaactctctgcagcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgcttactcctcagcttggctttttctagactgtggtgtctactcagcacagtagtctgcacacccactgtactcaccacagtctcagtttacctcactgcagcattttcacaagacccttattggatgcattttctgttgttgccatctgaattaccagaaatgtatagacatttttttttttttgagattggattgtgccactgtactcccaggctggagtacagtggcacgatctcagctcactgcaacctccacctcccaggttgaagtgattctcctgcctcagccttccgagtagctgggactacaggtgcgtgccaccacgcctggctaattttttgtgttttcagtgcagacgaggtttcaccatgttgtccaggatggtctcgatctactgaccttgtgatccacccacctcggcctcccaaagtgctgggattacaggtatgagccaccgcgcctggcttcagaaattcatgaacttaaagcaacacaaatttattatctcactgttctgtaggtgagaagtcagaagtcccacagggatctcaccaggctagaatcaaggtgtctgcaggctggattcctttctggagtctctaaggaagaatctgtttccttgcttattcagactattggcagaatcagttcctttcatttataggactgacgtcccagttgttccctggtttttagctaagggctgtacccacttctagaggctgccacactctggctcctagctcccttcctgtatcttcaaagcagcaacagcgcattgaggctcatctcctaggtctttttctccattgtgtctctctgattcttttaccttctcctttttttccttcctttcttttttttttttttttcttctttgacaaggactcgctctgtcacccaggctgaagtgcagtggcgtgatctcagctcaccacattgtcccctgggctcaagcaatccacccatcttagcttctcaagcagctgggagcacagagccacatcaccatgcctgggtattttcttgtagagacagggtcttgccatgttgcccaggctggtctcaaactcctgagctcaagcaatctgcccaccttggtctcccaaagtgctgggattataggcatgagccaccacgctcagtctgccttttacttttaaagactcctatgattaaactgagatcacccagacaatttagaataatctctctattttaaggtccataaccttaattctgtgtaaaattcattttactgtgttatacattcttttcataactttcatagtgaatatagctcaaagggtgggtgcggggagcactattcagctcaccacactgatttgggaagtgattccaggaaacacaagtgcagaaacaaattgagaaatgaaaaaaagccaattacatgacaaatgggataaagggttcactcatgagtcagttaccatgtggataacttggctgaatcccttttaggactctctaagaaaccatatgaaatgtgtgatatagctcagaatcttcctaaggactacagggcctgggactttatctccacttcccatcctcctttgcttgaattggttgaaggttggcctgggagtgttaattctaatgcactttaagattgggctatgtaactgcagaaaagcaactatcacgggtgtgataaagctcacaggcaaaggagaagggagatactcactggaggtggaaaggttgtcatccttgcagaaaactgtgcctcagctattggcaaactgtgataggccaagagaatatgggatggggcatcaacagcgtctgttataagggctctgcctctgagaatatagtgaatgcctttcaaggtctctctgccctcgctgtaccacatttagcattagtgacctcttctcttccaatacatgcccacatcacatggccctgcagcctcaccacatggactgggtctgggatggacacctgacccaggctaggccagaggaccaagtgacatgtggctagttactcctgtagcagatgtgcatgggagctgtgggaagaaatgctccattcatggtgtggactaaacaatggtggattgcagagaagaccaaagcagatgagcagagagaaggctacaagatggaaagagtttaggcaaatttctcacgtttggttcttttagaagcccagtatcatttcttctttttgaaaaaatgtgttcttttgaggcaagataaatgtactcgttaatattgcttgtagtcctaatattcagaagcttatgcaactattataatatgttcagtgattctgtgagtcaggaatctagaatttgaacagggcagagtaggaatggattttctgtatgtcaacatgtctaggcctcccctgggagtactccatagctggagatgacacagctatattaccttcacagactgtagtttattgtaaagcaaaaggaaatcaatgcttaccctgtatcctggttcttccagggttggcaggtccataaagaaccttgccaacgtgacccttcctgtctctatccctcccactacagagcatgattgggttaggttgttactatctaaccgggcacaccccagtagagcctgatttctttctaagctaccccatcgtcaactgatcctcttccttctcagaacacacacgtttccctctagctcagatcaactttggcagaggctgaagcctggcttagctggatgcttctggcaaaagggctacttcaaagccctgggccttatttcttcaggtaaaaaaatataaagtcagatctcatcctggctggccatgctgttagaccctttcatccttctcttctgcctcttctcaacagctgcccagtcctgtttggaattcatatacatacagttctaatactgatgtatttaccctcataagccactcaacccagaatcttatttgaattataatccagaaacatcaggtgacgtgtgagactactgtatgagaaagagacagtttaagggtcagtccaatggaaaaaagagttctcagagctttctttagcttattctcatcaaagagctttctctgcagaaggaacctactggttcctcctttccagtcctagaaatcctgacctagagtggcttaatcctgctagcacctctctctcgcactctggtgccaaatgactccaggaactgggccatgatgtggtgggaatgaccttaccctgagcatgtcactcatgcattgaacaacagctaagagcagagcttagagcttagagctgggccctgtaaggtgagaggaatcacatcctgcagaagtctgtcctgagaagcaggtactcctgtcacagcagagacacagtggatacctgagtaacaataatacaagacaggacgtgggaacagcaaaagatttgggtgtcagaagaggccgagaacacttcaggcaggaacattcagagttgttcttggaggaagtaggcacgaaggctgggcaggatttcacggggcagagatggagcaagcaattgaaatgaaagccatggcatgggaaaaggagcactggccacagggagtgcaacgttgtgatgcaaggccactgtggagccattgctagcgtattaactgcaaagttttgaattgaatcagaagggaattggaggcctccagactaagcatttagacacttgaggggaatattgacaactgggcctcgggaagattattctggaagatatctttacaattacaagattggagcctttgggagagggatgatgtttacgggaggatggtatgtgtgctagtgtgtgtgtctgtgtgtggctcttggacccaacctgaccacctactatctagaaggtgaaggacaactagaaagttttgctcaattccatcttctgccaccaccagaatgccacctccctgagggaaaaggtttttgatcctcagtcaggattctcagcacctcttatccgatagctttggaatgaatggcaaggccttcataacagccactgcaactgctgtctcctttcctttgctacccctcccgctccagccatgccagcttcccccaagccctcctgcgctccaggcccaacctccaaagccagcaacttgaacaggagtcctctggctttggaaagggggcggcttacgttttcctgctcatgtttcctccccagcaaaattgccctctacatagagaggcctctccttgtggacaccagcaaagccaccgacctcagtgacaaaccccagggaatctccccaaggaatctcaaagcgagagagagagagagagtcttgagagagaaagagagagagagagagtcttgctttcgaacaaagaaaaaggaaataaaaagacccgataatctcaaaaggttatttgctgcttgaaatttgtgattcggtgtattctacccagcaactgctgagaaataaggttcgacaccattggctggttcactcacacccggccaatcctgggctctaaaatacttagggaactcttgggactgtggaagcccaggagaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggtaggaaacggaggggaggcgctacagctccggggtgggcacagtaggtgggggaagcggggtctgctgtggacacgagacggggtcctgggacagggaaagcccaccggtggggaggcgcggcctcgcctgtctttgcctcaggctgcccggcctgggtcgcggggaggaggaagtgaagggaggagggtgtggtagaatccagcgacaactgaagaaactgcattctggccagagaagtgagccgaggagggcggaaaaaggcccccttgatcttggcattgatggcttacttcatggaatgtttaaggaatccctctctcgggacatacctgagccttcggatgcaggggactccctgaagttggggcactgatgagacctacttgagtgacgggagaggttgggcccgaccagcactgaggtgccaagactcctaggctgattctcctctgtaaccctaggcctcctgtccctgcctgctctgggtgctcatggaatcagctgctgccctgcacttctcccggccagcctccctcctcctcctcctcctcagcctgtgtgcactggtctcaggtagggatgtgtgccacttgctgctgtcacctatcagaaaggaacatcaaccctgtagtctgcaaagggaaagaaagaaggactgtggagttgttgacttaccctttcattctgaacatgttcattgaatttataccagcactgtccaaaaggaatacagtgaggcacaaaggccgagtgcatgtacaattgcaaattttcaaaaaaaattaaattttactttttattttaaaaagtaaaaagaaacatgaaataaatttgtatactatattttgtttcgccccaaataatcaaatacgaatatttaaatacttagttaatataccatattaccaatgagatagtcaacattttgaaattttaaatcttcataatcctgtgtgtattttacacttacagctcatttcagttggaactagctagtggatatgtgtcctattgcacggctcaagtttacagtacactcaggcacagcactagattgggaaatcgaggaaaatcccctcaagggcacagggtggacagagggtgctcagggcaggttcctcagggtttccttcatgaagcagaagcacactttatagttactgctcccaggggtgctgtcgactagccacagctactggtccccagatttctcagcccaaagagaccctatggccatggaaaaaataagtttgtccctagaatatctgcttcctttcttgccttagagatgtgatggctggtgtctttgtctgactctacccctttgttgaacagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggtgcgtcgcttcattttgctttgttactttggcacagtgtgactttggggaaagtttctctcctaacctcaggcccattgcagaccagcaaatttttgtctggactcccttttccactctccctgtggaaacggaattccagggaaaaatccttcctcctgcacaagggacacatgagtgggtttgccctgctaagctaagggcttcacttcttgagaagcacatgcagaattcagctgaggccgtgagcaggggaaaatggtcagtctcggaagagaagtcttatacctgccttaggattgaactgtgcacttcttttgggttttttttttctttttgagacagagtcttgctctgttgtaccctcgctggcacgatcttgtctcactgcaacctctgcctcccaggttgcacttctgagagtgagaggagacactgtcaataattgttccaagacaactggaataaactgattacccagagaactacaacatatcaaatcttatttcttgataaatattaatctttacttcatctttcccaaaatgctgattgcagagagagtgacttattgtaaatagatggttttattaaaccaagacgaaatacagaagcaaaattatatatagttcctgctaactccatagagaaagactacgaattttgctgggaggtaatagggaagccttccacataaaaatgcatttaaactgggatttctaggaatttgttaaaatgacattaagtgattacttcagttttggggttagtgtattatgctttaaaagatatatttgggctgggcgtggtggctcatacctgtaatacgagcactttgggaggcagaggcaggtggattacttgaggccaggagttcgagaccagcctggccagcatggtgcaaccccatctctactaaaaatacagaaacattagccaggctttgtggagtgtgcctgtaatctgagcttcttgggaggctgaggcacaagaattgcttgaacccaggaggcagaggttgcagggagccgagatcttaccacatcactccagcctgggcgacagagcaagactctgtatcaaaaattaaacaacaacaaaaaagatatatttgaggactgaaaaagcctttaaggtgcaggataatctgtggtggcatttcactccatcagaccagacagaggaggtgaggactagggaattgggtctttccctgggggcctcaaatcataacaggtaggagaccccatctttgctacacacaaaggcaaccttgcatctgattaaagcagaatatcatggaaggagggtttcttgaccctgcatcatgactgtgttcatagcagcactccagggttgaccagttatggtttctgcgcggcaggaatctgccattctttgcctataaaactgacagtggcctggcctttcccactctgaattggattgcttaggactttttgtttgtttgttcattgtattctctttgttaggttggttggtggctgattttgcccttaaatctattttgtcatgcttgcctgtattgaacctcatagaatgttttgaagaatttcgttttccaatttgctgagttattttaattcttattccactgagcctttaaatgtacaagtagttttatctcttgataaaaattaaagtgaccctgggccgagtgcagtgattcatgcctgtaatcctagcattttgggaggccaaggcgggtgggtcatccgaggtcaggcgctggagaccagcctggccaacatggtgaaaccctgtctttactaaaattacaaaaagtatccaggcatggtggcacatgcctgtagtcccagctacttgggaggctgaggccagagaatcacttgaattcaggtggcctaggttgcaatgagctgagatcctaccatttcactctagcctgggctacagagcaagactctgtctaaaaaataaatcaataaataaataaataaataaaaataagcctgggcaacatggcaaaatccagtctctacaaaaagatacaaaaaaaaagtagctgggcatggtggcacatgcctgtagtctcagctacttgggaggctgaggtgggaggatcacctgaccctcagaaatcgaggatgcagtgagccatgatcatgcttctgcattccagcccaggcgatagagtgagactgtgtcaaaaaaaaaaatttttttttattaaattgagccaaagcaccagacttaagttattgatttaatttcctgtctttggtaaaattctttgggagactttacaaaggaattactcagaagaagtttagatggtcacacatggctgaaaggtctcccaggaccacgcttttgcagctctttcatacctggtgttcactcttatggaagattcatttaaagatggattgtagttagggtgagtctagtttcttaggatttttggtgatgatctctgatattgaaaaagtggtatggttatcttagtccctggatcatccagatctttctaataagttgatgttctccaagtactataagaaaatcacccagcctgggcaacatgttagccaagaatggtggaaaatgcctgtaatcctagctagttgggagactgaagcaggaggatctcttgagcccaggagtacaaggcacagtgagctatgattttgccactgcactccaacctggacagcagagctaaaaccctgtccctaaaacaacaaaagcaatactgcctaatggatggagcctctgggaggtaaacagtgtgaattaggattagagttggatttgcaggctagatctgtcaagtctcctaaaaaccatcacctcctatgggtggtagaaagcggtggttatgtgaagttctgaactagacagaagggtcaatgtctttggatcaaaaggtttcttaggattctgcccgcctggcagactttcgtccttctcgttattattctagagcttctggaagctgaggtctactgagaagtcgtcccagaagcagaaagtgaaatccaaaacctgcctgtttgaagttggagtcgacacacccatctcaaagtgagaaaattagtctggcaggataaattgaacaagcatttatggcagacagatagatgcttggtgctgtgatggggcctataggtggaccgcaaagaaaagggtgcaatgggatcctttcctcttagagagctcacagtttatgtggcccattggcctgctggtgttctccaacatcaatgttctttcttccttaccctcatcctttttttcttccttcctatttcttgtttcctatctccctcttttttacctttactttctagcttcacagaagagatgcaataggcacagaagagatgcaaaaggcactgacttttgcctgaaccc

SEQ ID NO: 543 - DNA, 32318 bp, Homo sapiens
caatggaaaccagtcacggcttcatagagggaaatcatcagattagtaaattttacacacgccccctggtgctttgaggaggagggattcggacaggggcagctaatggtggtggctgtgagatgtgttgggttaacattgatgagagtttgggatggatgagtggattcggagtaatggaaatggagggcccaggcccggcccctggagatctagctgcaatagctgttggctggagaggctgttcacttagatgggggatggggtgggaggcaggtgagatgagagctccagagttcagcctggggcacggtcattgggttcaagatgccttcagatgttggggcttgacagtgacagtggctgcagatacccaggacccagcagagggcctggcacagcggggcccagggacacgtctgtgagtcaggctggcactcaagtgtgaatctggacaaagaaggtggcattgttggcattgaatgctcaggggctgggtgaagtcagctagggagaggggctctcaaggcaccaggactgactccgtgggtgagggcggaggaggagacggcagaggctgagagaatagccagagacaggaggaaggtcagcagagccatgcacagaagcctggagaagatttgaggaaaggaagggctgggtggtcgtcattccctgcagctaggaggcaagggtgacccctgtgtgtttcattcttcagaggattggtggctccatctggtcagaaccccaagtccagagatgcatctgagcttcatgccatggtgcaggcagcaggagccatggagcaggcctgcggggtcacggcctgcctgctgcttcctggtgtctctaccctgagctcaggggttgcttggatgccctgtgctgcatccccccaggcggtgttccagagaggatgaaagtggctatctcaaggtgtgaccaggtagcggtccatgcacactgctttttcctggggagagtctgggatggaagggtatgtgtgtgtttctgagactccttgaataggctccatgtacctatccacccatcttaccacccacccacccatccactcactcacccatccacgcacccacccatccacccatccactcatccacctgtcaacccatctatccactcattcacccatccactcatccacctatctacagtcattcactcatccacccatccactcatttacccatctatccatccactcatccacctgcccatccactcacccacccatccactcatccacccatccacccatctatctatgcactcatccacccatccactcatccacctatccactcattcactcattcactcatccacccatccactcattcacccatctatccatccactcatccacccatccactcattcactcatctgtccatccactcatctacccatccactcattcacccatttatccatccactcaaccatccactcatccacccatccactcatcatccgtccactcacccatctatccacccatgtatccatccactcatccacccatccactcatctgtccatccacttatccacccatctactcacccacccatccactcacccatccatctacccatcctctcatctatccatccactcatctacccatccacttatccatccatccactcatccgtccatccactcatccacgcatccactcacccatccatctacccatccactcatccacccatccacttgtctactcatccactcacccacccatccactcatccacccattcactcatctactcatccactcatccatctatccactcatccaccaattcactcatccacctatctactcatccacccatccatccagtcattcatccatttgctcattcatccgccaacccatccattcacctgcctgttcatccacctacccatccattcatccatctgtccatccatccacccacccactcacccattcacacacccatacacccatccatttatccaaccatccatccccatccttacttcagaaagcatttgaagttgctggggtgtgcacttggaaaatgcgtcataagctttcataggcctctctttggcttcctcacttctttgattggtctttctttcggacatgcaggattctgagcagctcttctgggaggtgggtgcagtccaggtaggctgcctgcaaagctaggaccgagggagccacatccaaggcactgtgggttcccaaggcgatggcactgtgggcccactgcttccagacctcctcaactcccaggctcctgagcaggaggactcctggggcagggcctggagacgggaagagaaaacaattccagtctctcaactcttgtcagtccaggtgggtgctgcatggattgggggcacctggaacagttggccccttcacccctttcccccacctttccagcccctctggctataatcagacagttgtgtgcgatgtctttctccctcctgaaggggtcatttagtcaggctcctactcatggcccaggaatgtgcccctccctgcctgtcccctacccccaagcaggccgtgcctccagccccctgctgtctctgaagggcctgggcatggggcagcctctgcagcatccccagggcccgagctgatctgcacagcagaagggaattgggggaaagctttttttctacccagcacctggcagggggccaccctgttgcaccccagagacccttgtctaagttttgttatttcagatgatttcataagttgggggaggcggagccccagcccccacagcccctgttgttgcctcactgctgagctctgctgtgtatctgctgacaggtctgctgatagcagaaggggctggagagagggaagctctgggccctgccctccccaacccctgcttaggggacatccctgataagaggaaattccagcctgtgacagatggccagtgtccacccacccacgggggaacttttctttctctttgtaagtttgcagatttgccaggaactaaaggaatctctggttgacaggccactgtggacatggctggagggctggcacgggctggatcttggggttgctttgaggtaggggccgctcctgctggaaggttccttggggtggggaaggcatcagggccattccctgaccctccctctgcagtggatccacttcagagcctgagacaaggcaagggggcagcagaaaacagaatataaaatagccccccccaccacacaccgcaccagaagtcagaggattcatccttggcctgccctccctgcagcctaagttctgagagtggctctttaggaagtgaatggtgatggtttgcaggtcagagcttgctctggcccaagattgatgtctcaataggccgcggagcctgggtgaaaaaactcaggctagggaggtggtgggttgcaaatgaaagaacagaggagggcctcttccagaaagcggcgggtggtgtgaggagcccttggaccttgtccaaatttgactttaccgactggggccaattgaaaccgtgctggcagaaaggcaaaactgcttgagattccttcctccacaatagaggagaggtttgcttgaaagggtttggcgagggaaaagctggaggaaccttggccggcagtaaaagtggggacccccgccccctgcctcgggggcgcctcggcccctgaatgaatgaaagaggaggctggatggagacagactcacaccacctgtcccttccaggtcctgcaaaggagcacacagggttcttgttggctcttccaccttgttagtcaccaagaaggagaaaacaccaacaggggaactgtaaagctgcagttttgtttaagccccatagtggaaaccggaaagagctccagctcggagaaaaatgcagctctttgcctttgcaaatccgtgtctttctctgggaggccagagccattgtgctcgatttctaagcagggtttcagagtgtctcaggaggggaaggcagagtctcagatttccggcatcccaggtcctaaccaggctttgaggagacgcttcctgtcccatacaaagtgtgaagtgtaatttgatttggagttagttaacaaattagatgagctgtgtgcattttaaaaattcagtccttgatcccccacccacacacatttgcacaatttggtcatttatattcagtgtttccatctttagaagagaacaggaagtccccagtgacatttatggagtgtttgtagtagcttgggtaggtcagtaggaacacaatgcagtgaaaagcagagttgagatgggaaaatatcctgttttcagagccccccagggatgacattccttatcgtctctgtccacccgctctggagtccactccgcaaacagcaacttgttctcacttgagagcttcctcctgccggagctcagggatggagagcagctggcctcagtcttctcctcttacctctttgtttctcagactcatcttccaccttgaataattgtttttaacctgctctccctcttctctagctgtagaacccagaactttgtgtgtgtggtcaaaagtttagagagtgctgcaggtaatgctgagataaccctattaaattctgtaagttctcatcacaccaagtttgtttgttttttttaattctcattttattttatttcattttatagggatggggtctcgctacgttgcccaggctggtcttgaactcctgggctcaaacgatcctcccgcctcggcctcccagagtgccaagttatttttttaactgggatccacgggcctagggattctttgatgaaccgttcaaaatacgtgtgtgtctgtctgtctgtcttcaatgtatacttttctagggagagtctttacttttcaccagaggtttgtggcacacacatgtcctgtactactgtatcagattgtgaattccttacatgttaaagactgcttcaaatctgtccggaagtctcggctaataaacatttaaataaatgaacttcaaattcccatgtgccaccactgttttcattctgactactctcaagcctgtagtgtcatctttttgttactgtgaagtagacactcaataaatacttgtcaaatgaatcaatgttatggtcctggtccactaggaccccaggatcatcgtctaccattattgtctatagtttctttaccatcttgttccagagcagttctttctctgaggtctgctcacctctgcacgtgtgtctagtttccagccctgtcgccttaccattctctttcctttacctgcatttcctgaactgttaatagttaacaatagcttctccctccacccactcactcatacctgaagtgagaagtcatcattgaggtctctgtggattttgtcagcccaacctggggcggcctcctggaggtggagttttcagatgagggatggacattttggtgtctgctgggtagatctacctgggagctttggcaggggccccagggcagctctgcctctttattttggctgtgggacccctggtgcactagggtttctcaagtaagcatctgtgtcctgggagagccataggcaggcctgagagggcccctggaatctgggacccccagcccggcccagtagctggtaccatcatctttcttgcaagggaagttatggaaactaagatgctaatgtgctttgataggcctggggtggctctaagccctgggaagagccctggcaactttccctggctggcgggtagaatcttctcctggcagttcagggctctgcctccagctccctgggggagagcaactgagggaggagctggaggccaaggcctcagtgctgagctgcctgcaccgcagctgcaccttctgggtcctggctgcaggaaccccatacttctccagcctttccatggttcccgaagacctggcctggggagggggtcagcagcctggggctcacctacctggcttcaaatcctggctctaccgcttactcgctttgcgaccctcataattgacaaaagccctctcggtctcggtttccttatctgtgaaatgggacaataacagtggctaccttataggattgtgtgatgatccatcagttataatagctcctgagcagcgtttagagtaacacctggggctcggtgcagtggcttatgtctataatcccagcactttgggaggccaaggtgggaggatcgcttgaggccaggagtttgaaaccagcctgaccaacattagtgagacccactctctaaaaaaaaaaattagagtaacgcctggcacagagagcccccagtaaacctcggctgctgtgatgagctttgtttcttcatttgttcattcattcaccagactttttgccggggcttgccgtgagccctacgctgctctgaagaaagccgggctggggtgagcgtgatggatgaggtgtctggcttcacaaaccctgtgtgggggggttgtggtgagaggaaaccgcacacatcattattcagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgtattttcacagttccagaggccagaggtccgaaatcaggggctgtttccttctgaggccctgaggaccagcctcatccatgccttcctccttctggtggcgcctggcattcctagttgtattgtaaaggcatcacatgctctaatctctgccccattgtcacagggccttcttccctgtgtctctgtcccgtccctcctcttcctttttttttttttttttttttgtttgagacggagtctcgttctgtcacccaggctggagtgcagtgttgcaatctcagctcactgcaacctctgcctcctgggttcaagtaattctcctgcctcagcctcccgagtatctgggattacagtcacgtaccacccacctgacttaatttttgtatttttagtagagacaggatttcgccatgttggccaggctggtcttaaactcctgacctcaggtgatctgcccaccttgcttggcctcccaaagtgctgggattacaggaatgagccaccgagcctgccctctttccttcttgtctttggacaaggatgcctgtctttggacttagggcctaccctaagtggatgatcccatttggagatccttaatgaatctataaagaaagacgttttccaagtaaggtcacaatcatgggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaaatgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttctttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctcagcaagcagctggcatggatgatgggaatgttatcaagaggaggggcctccaggttggcgggggcaggggtggggggattccgggagccgttctgccattgtggggatactgggctttccaacctccctccagattattcctcctgagctgcagaggaatgaaaatccgagcccaggacttttttttcctggggacaagggcaacccagccctttgccccaggccacctgcctgccacaggccatagtcctggaggccggtggtcacccactgcttccaccctgccagcaccctggacaccggcctggagcaacaatgctccagccctgtccctctgagtctatgcactgtccctgggccctggacccagggccatagggtggacccagagggagacacatgcactggaatatgtgtgttctgaccgagtctgggcttaccagggggactgacccttcccccaaaacgtgtaccagatctggtccaacatggtgggcctgggggaccccatggggagccaagcagtcgggatggggagtgggggtgggggcaggcgggcctgagtccgaggcaggccgagcagggcccctgccccgctgcccccaccccgctgcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaaggctcctgagtgagaatgttttttctgcccctgaagtgcagttctttgggcctcgggacaggttggggtcagctgcaggtgggcaagaagcatgggcaagaaaaggtaggccgggcgcggtggctcacgcctgtaatcccagcactttgggagactgaggcagttggatcacaaggtgaggaatttgagaccagcctggccaatatggtgaaaccccgtttctactaaaaatacgaaaattagctgggcatggtggtgggcgcctgtagtcccagccactcgggaggctgaggcagaagaatcgcttgaaccccgggaggtagaggttgcagtgagccaagatcatgccactgcactccagcctgggcgacagagcaagatgccatctcaaaaaaaaaaaaaaaagaaaaggtaaggccaggtcaga

SEQ ID NO: 544 - DNA, 32997 bp, Homo sapiens
tacttattcttcctcaaggctataattagcacttcctcaatgcacctatggcatgggaaagtttgggacagaggatcagtccattttgcatttctcaacggacagctcttaggtcacctgagatcgaatatttgttttaaaagtacagagctaagctagcaggcctaagtattgtactatcatttgctctaaccacggggaagaatggccttagtcaagacgatcaggaaaagtagtttgaacagcgttatgacttatgtatttaaagcaaaatggtaagagtttcctaatgttcacaggcagatacccttacagaacaaggttcccttgaagatgtacatttatcttaggaaagagttttaagaaggccagctaactactaggaagctatgttttggctttctaacttatcttaattaaattcctggctttagagtggagccctttaaggaacagggtcagtaaagcatgcttctgtgtgtgtgtgtgtgtgtgtgtgtgtgtgtgtgtgtgtgtgtgtgtttagttcttcagcgatgtttatttaaaaatctaaaactgcaaaaaaataaaataaaataaaaaacaaacaacagccagcaccctctggggataattattcactgtaagcaactgccatgatccatttttaacaatgcatttcttcccgaagtattacacttaccaagggtattttcttgcgatgcaaagtgatttctgatatacacccaaaagccaaaagatcaggtaacacaacagaaaagagagaagaggttttagacctgactgaatctgtccgctgaccactgctgggatcccatgaggaaacacaggatcccctcatgaaaggaaaacaaaatctcaggaacctaaactcacgatggaaaagtgacacttggaaactgagtcacacaacacactgcctttcctttccatcctaaaccgatagacaggtgctaggcagaaggccatgtgtctcccagggtggccgccctcaccctgacactgtaaaatcacagttcatcttcacaagtacgtgacacaagacgacactggaaaccatcccgccacccaccccgacacaaatgcatatgtcagtgcttcctgtgctctatgttgactttatctcctgtcgatgcggatggactgggtatgagacgaatgcagaactgactgttcctctgcctgctcctttcacaagcagcaggtggatttagggagcactaatcaaaccctcacaagacagtgaacactcacccactacgtgccctccctctctttttattctttcctctttctcctcctgcccactgttctccctttaaatattgaagctctcaaaaccctcttaggaaaaagtgcaagccccagaacctacagcacctcgtgtctcttctacccaggctcatcctcaatcgtggctaaataaacctctaaattgctggagacctccctcagacacattttgggtttacaattgggcaactgcaaagaggttctgagtggaagttgcccttgatatgggcaaatctcctgtaggtgcctggtattgtcttggactatcttaatctctcaaacaaataggatgatttgctggcatctgggagcttttccttccagagatccctgatatctcatgtatacaccttcaataaatttgctagccatttttgccatgaattaatcaacctcaggccaatgcttttttcatagtgatcagagctgttcttgtctcccagaagtcatagtgatgagaacccaggcacctgatctgccagctaaagggtaggaattttctaccagccaggctcctggcctctctctgtgtactacaggtgaacagatggtaaaaatcactgttggcctcatctgcaaggttttgattaatgggggtgcgagcgggggaaggtttgtgtgtgactcatcttggtctagcaactctggtgaacatttggtactttatggtctattggaataaaggacaccagggaaaattctaatcattaatggccataaaacagataaaaatgattttctaaacaactgatgaaaaactcaacattgaaaaaggacacatagtatcacagctagctttgagaaatctattccaaaaaatctcacataaaaattaaaatccctgcaggacgcagtggctcatgcctgtaatcccagcactttgggaggccaaggtgggcagatcatttgaagtcaggagttcaaaaactggcctggccaacatggtgaaaccccgtatctactaaaaatataaaaattagctggatgtggtggcctgtgcctgtaatcccagctacttacgaggctgaaccaggagaactgcttgagcctgggaggcagtgattgcggtaagcataaatcccgccattgcactccagcctaggtgacagagagagactccatctcaaagaaaataaaaaaaataaaaaactaaaaaaccacacattaaaatctattgcaggttttaccgcctgttctggattctggtttgatatttgtgtgattttgcctttcactgatccttctcccctccatggatagctattgatttctgtcttctttctgtgggggacatagagggaatttttatctttgtgtataggagatcagctattctgtatcttaaaaacaaacaaaaaaacacctccctgccacctcctggaagatccctcgggcgcccatggttaagtcacaaccttacttcaggcttattggtttcactaggaaggttgcctttggtagaattcaaacaccagaaatatcacctgtatgtcctggctaacatctggtagtaagaggtgtgaaaggattttttcagagctctaaagtcacaagtcaacttcactgaaactgatattaaggctgtgtatgtatatatgtatctatctatctatttattgagagagagagagtagttatggccattattctctctctatgtctcagtcacctcaattctgtctgtttctctgtttacttctgtctttccctccttcctcttgccaccctccatgcaatcaagagaggacctacagtagtttctaacagctgagatcctttgggaaaaacagaaaaaagcaccagagtccctgctggggaggaacctctgttttcctcatgcgacctcaagagttggaagtggacagattcctggcaaattcaaaactgttctcttctatcctaaggcatatctctgtttaaagttcttttcctggacctcttaactaaaatttgcttatatcgttttgtaatcaggcagcttaacttcaaactgcattttaaactgggttttccttcttctttggtttccagatttaaccttgaagcaaactgcagaagccttttttcttagacttaaaatagagtccatgcccctccctttctcaccatatataccccctatatttatctaagtttgtgctagtgtctaatcatgtgctttctcagaagttccataggttaatcttgagacacacaggccaagcctggagacccagctacaaatttccagagagtactcaaggcagctagttagcaatccagccatcgttgagatgacgccagcccaagatccaggtggactgggacccaggagagccacagggacaggacatacacacatacacaattctagcatgctgtccttatcaagctttcctttttaagccccggcctttacccaaaaacatcaaactggtttctttctttctttttttttttttccagtgaaaagtttcattttttccttcagctgttattttaagttccgggtacatgtgcgggatgtaaggtaaatgtgtgccatggtcctttgctgcacagatcaacccatcaccgaggtattaagcctagcatccattagctattcttcctgatcctctccctccccctgcgccaacaggccccagtatgtgttgttccccttgatgtgtccctgcgttttcatcattcaactcccacttataaatgagaacatatggtatttgattttctgttcctgcattagtttgctgagaatgacagcttccagctccgtttatgtgcctacaaaagacatggtctcattccattttatggctgcagagtattccacagggtatatgtaccacattttctttatccagtctatcattgatgagtatttgggttgattccatgtctttgctattgtgaatagtgctgtagtgaacatacatatgcatgtatctttacaacagagtgatttatatttctttgggtatatacccagcagaggaattgctgggtcaaaggggtttcttggacaaattgccaccctgtcttccacaatggttgaactaatttacactcccaccaacaaagtaaaagtgtttctttttctccacaacctcgccagcatcggttgtttcttgactttttaatgattgccattctgactggcatgaaatagtatctcattgtggttttgatttgcatttctctaatggtcagtgatgttgagctttttttcatgtttgttggccgtatgaatgtcttattttgagaactgtctgttcatgtcctttgcccattttataatggagttgtttggtttttttttcttgctaatttgcttatgttccttgtagactctgaatattagacctttgtcatatggagagattgcaaaagtgattgctttccaagggaatccagccacttcccctttactcgttttggttaataaaaacactttctttctagcagacctcgctcttgttaattggatgatccaggtggggagcatccagacctgcgttcgcttccagttgtttttcttcccttggtttaagcaaaatgatacaatatttaggccaaatgttttagttctactttgagatgtaaaatctctatctgatgtcacctaagatttgttcctttagagtgcgaactttgggccatctggctgacaattgctgaggcaataaaacaggttatcaagaaattggtgggctgggcgtggtggctcacacctgtaatcccagcactttgggaggcagaggtgggcagatcacaaggtcaggagatcgagaccaccctggctaacacggtgaaatgccgtctctactaaaaatacaaaaaattagccgggcgtagtgacaggtgcctgtagtcccagctactcagagggtgaggcaggagaatggtgtgaacccaggaggcggagcctgcagtgagccaagatggcaccactgcactccagcctgggcgacagagtgagactctgtctcaaaaaaaaagaaagaaggaaagaaagaaagagataaagaaagaaagagagagagagagagaaagaaagagagagagagagagaaagaaagaaagaaagaaagaaagaaagaaagaaagaaagaaagaaagaaagaaagaaaaaaaaagaaagaaagaaattagtaatctaaagtgggggagaaaaatttggaaaagtgacaaataaaaaatcttacaaatctacaggatctgggtctgtacgcatctctgtgtgtctatgtatttatatgtgttataggtatataatatttccccatcaaaatatatagaagggtctaattaattggcttgccaaaaaaagcacttaaatccaatattttatcagaaaaatagaaactttcatttgaatagcattcacttcatgtgactttaataatctttgctagagacagtttaaaaattattggtaaaatagaaatgtcttcaaaacttaatttagatatctgggctgaattagtcaagcaggtcagatactattgtctgctagatgtattaggataaaaaagtttgcttctgtaatacttttaaagcttgcttatctcatctgtaaacctatgtgtcttgagaatcaagcctttggactaaccccaggcattgcccttcatcctgggatacgcatctggtgcataattaaaactgtttacctcctagattcttcaataaaaataagagttaccaagagttcacattacaattaatgtatgtaattaaaacattacatctattgctgcctagaccaccttctggctatacacaaagtgtattgtgatggttaatatgaggtgtgaacatcactagacggaggaatgcctagatggctggtaaaggattgtttctgggcgtgtctgtgagggtgttgtcaaaggagattgacatttgggtccgtgaactaagagaagaagacacaccctgaatgtgggcagtaccatcccatcagctgccagtgaggccagaacaaagcaagcagaagagaaaagggtgagcagcttgctcatcactctctctgtcttcccgtgctggatgcttccttcctctcctcctgcccttggacatcagacttcctggtctttggcctttggactctgggacttgcaccagcggcctcctggaggattacagggcttcatcctaagaccgagacctacgcagtcggcttctctggttttgaggcttttagacttggactgagtcacactacgggcttctgtctttccccagcttgccaagagcctgttgtgggatttctgctcgtaatcatgtgagccagttctccctaataaactcacttctatgtgtatttctgtgtgtacatgtattctattgaccatgtcactctggagaactctgactaatgaatgtattaaagagataggatgtgttttgataaaagggttgaaagagggcatgggactgtggttctttttaagaaaacatcattttgtttagtttagaggttttaaggatcatttcaagttaaaagaaagatatggcaaaaaagaaattttaagcaaattgtagtaggtttgtggaagattgatctcataaaagaaaccatgtgtgatgaagtttggctaaaatttaaaagaaatcatttagtttttctataaattgaacatgaacataaatagcacatggatgctgggccagcctctgaacctctgtgtcagagtaatagggaatactcggtatattgatctgctctttaacagaaaaatcttaaaagctataaaagatttatggaaattttacctcatgatcaaactaattaaaatttgatagatttgtttataggattgtataaaatgagcttcagcattactaatccattaatacaaaggtaacatttagtttttctcttttgaacaagatttttgtgtaatatcaaaacatgatggaagagttttgtttgcctgttgagcaaactataaaagagaaagaaatgagagagagaaacagattcagttggcctcatgttgtctatatgatgtcttattctttgggaaactgagtcttctgtccatcacagagaaaaggtttctgcttttttgaaatctttaattctgtgtcctttctctctggatcattccaatacatacctctactcttcagttggtcagaggatgtttaagtctaatttgtttttgttcttgcatttgcttttgtcttggttttgctttgctgtgtgctgcttgcatccaaaggatcttgactgatttaaaaaaaaatgataccaaccagttggttgcagataacagaccctcaggatggttggtatttgtggaattagcgttcaggctgagagggagggggaacaacagtgaaactccccacgccgaccagcatagcacctgctgccacctggtggaacgtggctgagacaaggaacgctgggacctgaagcaggacctacacttcaaacaaacatctggctttgaaatgtttcctgaaggcatcaaataaattgtggctgtcgatgttgttggctgactctcctcctatgagaataaaattcagagactgattctgtaggtttctggttgcatgataaatttcatcctagccagatcttctaagtgcagctgagggccctgatggggagagtggtgtattagttcctcccctgctgtaacaaagcaccactgacctggtgcccacgctctcttttcttctggccataacctgcctctcccagagttggcctcttagaatttctcctaaagagaccagggtcccagcccctccccaatttcagagagttcctggtaatccattttttctttgtgttcacttaaaccaacacaaagttgctctcttccagttctggaggtcagaagtcctaaaatcaaggtgtgggcatggctgtgtttcttctagaggctcctggagaagccattccattgccttttccagcttttagagacacctgctggccttggctcctggctcctcccttcatcttcaaagccagccttgtagtgtcctctgatctctctcagtctctctccccttccatcatcacatctccttttctccctgtcaccttactgcctctgccttataaggacccttgtggataccttgggcccaacccagataattccagataacctcccatctccagatccttggctggatcacacttgcaaggtgccttttatgatggaaggtgacataatcacgagttccagcattcggatgcgcacatccgtggggggctgttattcagcctaatacaagatatatccagaaaattgcaatagggatgtcggagggggattgaagaatcccaactccaagccacatctaaggacgcttccaaggtgcagcccctgatggaggaagctgctccatctctgttgcccctgccccccatgagtttctagacagccagtgttcaagtcagtgtggcatgagagtgaactgcagaatggaaaggagtgagacgctgcagcaggagaaggagcccaccatcaaactccaaagagctggagaccatttgtgcggtggagtccgagaaaggtcggcaaggaaggggaaacatcatttgggttccttgccatagttgtcctcagctggcatggtttgctccagcagcaggctgggatgccagctgtgcccagggctggatgagccaccctcaagtaaatgctggccacttcgttgtgacgccaaaaattcagaaatgacttggtatgacaaagaagaaggaggactcaacgtgcataggagattggaaggttagattggatttctcaggtccttcctgcccacactgcatcctgtgagggcccaggagatttctctttcctttggtgagaagaatcaatggataaccaggaactctctggaatgggggacgggctgggaccttggtatctttagggtgggagaaattccaagaggccaactcctggggaggcaggtcatggccagaagaaaagagagtgtgggcaccaggtcaggcagcagggagtgcacatgatcacggctcagggaaattccacaggcacacggtcccaaaatagagccggcggagagtccactgactttgcacaaccaccaacttggtgggcagacacctgtcacaggtcatcatgctggatggcccctgcttgtcacccaattctcaggcctgactcataggacagacccagagcccttgaaggaaagggaggtcaggagtctgcgaaaggccctgtcattccccttaagtgcagcctgtaagcgttcctcctacctgttctccctggacctggagcgtcctctcagatcacaggggacggcttaaaggaaactcatccccaggacttctggatcctggctacactgacaccaactcctgggacccataataactcagagtgccactgtggccttccggtcagaggaggagattacagggggacaagtaatcagtgaatacctgatttcagtttagctttcagtgagtccattaggaacctcccctcacctggtcatcatgttttcagttcctgggtggatcactggagtgcgtattcttggaagctgcagattgttaacccagacctcctgaactaggaagaggagaatggatgctgttctctcccatgaaacaactttgttccatccctgggccctaaatgctgacatctttgattgtagaaagcagacatctacctctagtttgcaaaaactacatagagatgaatgactaacagcagtgaaaagaccatgagggctgaattcaggtgcttacagtgagtcatcactgtaagaacaggcctctctcaaattctgctgcactttccgcccaatccacctgctccagccagacctggactgctgtggaacaactctcaaggatgattcctgaagagcaatggagcacacctcacagtccaggctgcctggaaggggcggcgtcctcgggccaggatctgcattgtttcttaggtaacagctgaagatttggctggaagttcagcctgaggcaagcccatggggataaaggccatggataaaggcctccctctctcctccctggagacaaagattctgaggacgcttcttgaaggcacctcggaaggtctcattgcccatatggatgacccattcaaaaacttctccttgtatcaacttttcctccttccctcctggatcctcagttctgctcctagaatcacttcccacacaaaccctctacaccagaacgttgcccctggctcttccttcacaggaccccaggccacaacaggctactttaggcagcatcatggcctacatctttgtgctaagagtaatgggaagccattagagggttggaagcaggtgctcaatcaaacctatgttcttaggtgggcatggtggctcatgcctgcaattgcagtccattggaaggccagggtgaacagatcacctgagctcaggagtttgagaccagcctgggcaagatagggaaaccctgtctctacaaaaaaaaaaaaaaatacaaaaattaacgaggcattggggtacacacggatggtcccaattgctcagggagtcaaggtggaaggatagtttgaggccgggaggtccaagatgtggtgagccatgattgtgccacggtttgccagccttgcaacagagtgagagtatctgaaaaaaaaaaagaaactatattgttaaagcccaacctggcccagtgtggagcatggtccaggacatgggagggacaggggcaggggcacagagaagaccattctggaagttcttgcaggagtctgggcaaaacgtgaggacagactggatgggagtgtttgctgtctggatgtctctctttgtccctctatttttcgctgatcctctcccaatctgcacacaggcccctctgacactagttagcctcgagtgtcccgtgtcaatcccgggctctgactcacagatggaaaccacacctgtgctcagccagagccagacatgtacaagctttccccgagtgccccaatgggcttggggttttgaggtctcagggaaatgaccagctgggaaagtgagagtccagtgagcgagcagaaggggtcttgaaacttcgctccctgagaccctggaagaaggatcatgaggaaggttaagtcaggcacccagagcccaggggagcctccatcggcaccacaaagtcacagccatcagtcagtgctgattgactcaagtctccagaacacaagatggggagagcaaggtggacctgagatatcaccttttccagcccccttctacagctgatgaggaaactgaggctcagaggggtgaagtctcatgaccacaagcagggttgaactcctggacacacctcaagcttccttgacctgttcctggcatctcctttcatttttcctttcttcccaaattaacctctttccaacacagcacttcaagttcccctggaacttcatcggtccatcggtgtcccctggtctggaagagcaccgaccacttgccaaggcccccaccactctgctgccatcacaaccaccatcaccaccattacgagaaaaacttgagactgatggcccccaaagcttagaaggagctgagagaccaaagaatgactcgaacaagtccagcttggtgagtaggtgagtttattgggacttacacacaggtcaatcctgggcagcgacaggacagctctagagatctgtgcttcctcccaatgctaaactgctttcatgctaatcttctgactgtttacttaccggctaagagcgatgggactgttttcattggttggttctcagatactctctgggaagtttgggttctcagggacacctgctcctcagctggggattgtggccatggcctaccacctgcctctcagggttcaagcaggggacatgcaccctttagtaacctggaggggacccgtcacatgacaaccaccccaaccaccatcatgaagaagccactggctgactgtgatacacccccagaaggacaagggagagtggatgctggaaagacagagcgagagaccatcaccagggaaagactttattcttggaaggacatcaaacctgggggggggtcggtagtggagctgctgtttcttctcctgtatccaacagttctaactctggttttctccattttcagctctttcttttcctggccttctcattgctggttcctgcaagctccccctctattcttcgcccaatatattctttagtccaaagtaaactacttcttcccattccccacactctccagtcctctctcctcccttattgcaggctccagtgttcctgccttctccttggtgcacttgccatctgcattaacccctcccttgctgtgctcagctacacaaatgccaaagtcactaacactcagttccataagctttaccttgccctccttatccccctaataaaatgtctgcattttggccaggcgcggtggctcacgcctgtaatcccagcactttgggaggccgaggtgggcagatcacgaggtcaggagatggagaccatcgtggctaacacagtgaaaccccgtctccagtgaaaatacaaaaaaattagccgggcgtggtggcaggtgcctgtagtcccagctactcgggagactgaggccggagaatggtgtgaacccgggaggcggagtttgcagtgagccgagattgagccactgcactccatcctgggcgatagagcgagactccatctcaaaaaaaaaaaaaaaaaaaaaaaaaagtctgcattttgtcctggcctgtgcccggcatttctgccctggtggctgcactgctctggggtcattggtcttggcctggctgcagcatctcatggatcttggtgagaaagttgagcttcccctccagctcctgagcccgcttcttcagctcctcagctgactctgactttgccccctcaagcaagtgctttgactcatatgcaaggctgaccacatccagcagaagcaagatgcctccagtggctgcacccacgatcatggttcctctgctcattgcctgggcggggccttcaacaaccctctcaacctgttcaccgccttcagctgagattcgcccaatgatatgcgggggtggggcatacgctcctaactgagggttggctctggctcgtctgatggcacggatgttcctcccaatcccttgtgtgacttggtaccaattgtcaactaaggtaagaacattgggtgtgttcccacccacaaactccttcatcacctttgctacattggtgccgctttggtccaagttgcgggcttgggctcgtgcccgcaatttgtttactagttctaccacactgcaggtaatcccagccacagcagctgctgctcccagacccatgccagtgtccaagagcacaaaactgattccttctgtgaagggtgccagacccaggccgaggagggtcaggatgccagaggtagtgccaacagagttggacaccacattggcaatggtggtgcctctgtggacctgctcaacctcctctgcaagggcacggagcttccttatgtgatcctcaagctcccttttcaaccgaggaaactctttcaaaaaccactgcctgtgctgctggtctttatcgtggcggtttttgtccttcatgaccatgtgacttgcaagcttgttcagagctttacggagctcatctgcctcatccctgcacaaggaaaggttaaaggattaagaaatgcagtttccctatctgtgaaatgagctccatgcgatctctatcctgtgtaaattgcagagctttcactatcaatcaaatagaaacaaattttacaaatggaattaattatctttcaaactcaaacacattttgttcatcatagatattcctcagtacttattccatatggaaataaatatcttaaaggcacctcagatgctctttcatggtaggtgtttgataaagatgcctcctcactcaagggcaggtcaacaccgtgactgccaaagtgtttggagagggaaaactctgcagatgaacaaagagcagtgagagtgagacaaagagaccttattaccaggatggcaggaaagtgaagcatgaactttacccaaagagaggccttccctttgtcctcagctcctgggaagtgatctccaggcccctggaatgtcctgcctggtaggaacatctttctttgcctggtgatttggccacgggacagtatagcgatgtgatggatgatagggtttggggctatttggtgtctttcctgacttccagaggacttggggactaaaggtgtgagatctcagggaagggctggagactctagccatgagggcagcttgtgatccagccccagcagatactctggacactaaggcatgggttgagaaagaaggactttctccttgaccaactccagctgggctcttcagagcttcttctccactaggcgccgaccttggccttccacactcacccactgctttctggacttgcaccaccttggctcagcaagaatctccccaaatcagtttagggagggtcctccccgcttgctgtctgagcaccgtttgttatctgatcatgctcctcacccccaccactggtggttgagggtctgacctgcctttggcgagaatcctgttaggccagtttagcaggaaccccccactctggcgtctcctgtcagtcctgttccatctcccgcccccaccctggtgttggctgtgactccccctctgtctttactatatttggagctgggctcagtctccctcccctgtaacaacaatcctgaataaaggcttcatttctggtttaatgtgattcacaggaatttttccttaactgggtgagcttccctggttggcaacaccgcatgtgttttgtcccacattcacacaggagaacacagcctcctgaggacaatgaagattcacacctgaaatcctcccagactctgccctgtgtgtctcttccttaggctgattttaatctgtgttctttccctgtgataaaccacaatcgtgcaatagcagttttcagtgagttacgtgagtccttctagtgaattataaaatctaaggatgattttaggaatccccatagatttgcaggtggtgtcaaaggtaagggtgccctcagacattgcagtctggctatctctgagtactttgaattcaaacaaaaacaaaacctcagaaagacaggagatcactttgcctggcatctgctcccttccaatgcctcatgccctttcacctggctgaaggctactgggtgcggccactgccccagctgactggagtgggagatctggctattcattctggctccacatggacgctccagccaccttactgcctcctgacctaccacctgcacccccaaccttccaggtctcactcgcaggtgtcaccagcctaactgatgccttagcagtgacagcttcacctgtgtgcacagcaaggccatgtgcaattttatggaaccactagaagactcaagacactttcagaaccatctatataaattgctaatgctgaaaagacctgaatttggtcaagatggtagaggaagtgttttcctcctcggttgggactttgtgagtctgctcagtacccctgaaattacacaaattggcagcaactcattctactttggaaatggtcactaaggcatgccatggtaaggagcttctctgtgtagaagagaagaaggtctgaaagggtagtccagaactcaccagttccaaggcatggggtgagagacacaggctaccatgaccctgtatgcccatgagtgttgggatcatccagacagggaagaaatatccctctcccactcacatgtcctctgcaagttcatgacctccttaagtttcaagcccttggtgcctctctttccacaccctagtcccagccctggtgccccagccttcctgcttgtcctaccaaaccaaggctgactcttactccatcctgactccaggctctgacactggtcccggtctctctgggcctttgagcaggatcttagtccttggttccccacctttgacctggagttgcctctaaggccttcaccacactcctatgacattgaattgctattcctattggacagaagacagttccaagtctccatgacataagcccagagcccaggaactaggcctctcaggatcctggaccagcagaagggtcctgctgtgtttgtggaattcttcagatgagaaaaaaggccccagccagcatccccaggaacacatattgtttaggttaggatttttctgacttttcccaaaggaagtcctgctgggctcccatcttcaagaagaagatccttaaccctggtctctttccaccaagcttgtaagatgttaacgttaactgtgcacctactatgtgtcagtcattatgctaagcactttacatgcatgatctcatttttctcataataaaactccattgatgaagaaaggctgaaagtgagaaagtaactggcaaagttcccatcaccagcagatggcagaaatgaccctgttcctgtgggcttcctatcccctcagcctgaggctactcactgccagcgaaggacatggaggaaatattcctcctggagtgccgagaaggtcatcctcaagcccagcagagggggctgcctggaggaggtgtgcctgtcagggacaaccagcccaggggagatctgagtggcatcgctggggcgccccatggagttaaccccatggagcttacctgggcagttcagcagcagccacgaatccattccaggcttcatcatcagtcagcagttgtagcagattctctctgctcacttggtcctggaaatacttaaggtaatcctcaataaagatactgctctctagttggaaagaagaaaggataaggttggaggatagtgtaggggagcataacagccattgcacattaggtggttacatgttaatttttcctggacaactgtgatgtgggacatgtttgatggagtcatcagtgctatagagggattgtgtgcccccaaaattcatatgctgaagccctaaactcgagtgactatatttgaagattgggcctttaaggaagcaattaagactgaatgagatcacaagggtagggctctaatcctactagagggctagtgtcctattgtaagaagagaaagagaaacaataaggccaggtaagcacacagcgcaaaggcagctgccgcaagccagcaagagagtcctcccaaggctccaaccccttaatttaataaaccatcaaagacagaaaccccaaaccccactgggcccaactggctcttctgagtccacctgcacttccatccctgagcctgtgcttctgctttgcagctgatttgttttttctttgactcaaattttttctctcagtggagtcaaaaacctggacaaggctaaggtctggtctctcctggattcggagaacttcctaaacccaccagcaccaatgtgaccaggaattttccaaaaaggtaaatcaaaacaggcagttttgtaactgcaaccaatcaaataatgtccttattgcagtttcatatttactcgataaatacttgtctctgacactttttcatcataacatgaagcctcttccagtttggttttctcaattcatgaattccttcttattcaaataaatgttactgtgcctcagatttttctttgacaaggggtatctgagatcatgggaatgaggccctgcctgaggcagtcatccctggtcagcaggtgcttgtgatgggcagtgcagggcgggtgccctaacacagatgaggggactgggtggcttccacctggaatcaacaggggatagatagaggagatagaggggatgcaaactaattcttagggaggccctactgtgtggcaggctttggccaggccaggtacccttataatatttaatcttcgtgacaacatggggaaatattattttcatggtacacgagaggggaggtaaggagctccaggtcacacagaagggacttggaaaaggccagaccggggtccatttaagttggaagctgggtcaagcatgatacattcccatagggccactcagaacagaggggctggtgcagggcaagagctggagggaggggaccggcctgtgctggaaaaaaccctgggtcagcagggagaagagcggtagataagagatcagggctgcaggtcaacctcctctcccacccctcccctcctcctggaccctgctcttcccccactcccctctcttgcttgttccacttcctcatggctgtcctgccccacttgagtcatctgctgggtgacagggtagggaggaagtgggcacctgggccgtgtcaccccgaggagaggtcaggatgcagatgacccccagacccctgggtcgggggactccacgtgacctcttctgctgctcggggcagactcattggcctcctagtccatctgggttcttctggggctcactcagctgtggaggtgccaccctccattctaggtgcgagtaggaactagccaggaaagaggaagcgagcctacctgggttcatggtgccagcggctgggttaccgaggggctttccttggagctctccagtcactgtccagactggaaggttttccttaacccttgagaacgagaaaacaaattgtgggatcgaaggtgagcctcctgtgtacagagggaggctggaggggctgggtctttgcagatccctctgtggtagcagcaaatgtccagagtgtttatctcctggggccctgccagctagtatttacagaaactcacctcgttccagcttcctcttccctcactctcacaccaaggcagggtcctcttgtcctgtaggggtatgagaagaagataatcagaggaggggcagccatctgatcattacagaaactacagagtctatacacaggaatagagatgggagggaacattctgacaatgacctgggcctgggaacatgtatgataactagttgatgatagccagtgtgtattgtgtgtctgtgatgtgcatggcctctgacatgtatctcattcgatgatcacacacaggacaggagatgggtaccactttcccatttgaacacagaggaatccacaaaagttagggaacttatgggtgttttcacaatagtgctagagccaggacttctgcttcaatcccatgtcttcaattactgtgctctactcccttaaatatacaatattgagtcatgtatacacgctcatggtaaatgactcctcattgcaaatccctgtctcacactctgtgctcaactcttcgtcttggtgaactcactggtgctgcagtggacagcctgtgtccccgttgcttctctaagattctttgtcccacaaagacctggatcctgctagatgccggcccagcccctgctgtggctgccgagccctcctgatgcttccccgtcccctctgctgtcctcccctagctgatggaccttagggtgtttctaattcttcatataaattatgctacaaagaatatcctccctcacgtaaaactgctcacatttgagattatttccttaagatacttttaagagtagaatgactaggtcaaaagctattaacatctcaaaagtttttatacctagagccactctgtatgaaaactgtacaaattcacactcaaactaacaggatatgaagatgtccattctttcagtcttactggctctcagtagtcttttcttcaggaaaacaaaacaaaacaaaacattattccttgagacaaggtctcactcctagtatgcagcccaggctgctggcaaaatcctggccttaggggatcctcccaccctgccctctaaagtgctggattacaaacatgagccacgacacccggcctgaataaatgctgatctttatatagaggaaagttcttcacattctgctcctgattatcttaccctgggaggtgagggaaaatagcaaatgttaatcatattaatcatctttaggcactgttttaagaagacagaagagcatttatcaacctcccctcctgagatcaaactacagccatagtcaaggcacttacaggtataatggcacttaatgttaatgtgggcaaacattggtggattttgcaccactaattgctctaagatgttataaatagtaactcacagaactcttccaagaacctaggaagtgtgtaccattggtatttccattttcaggtaagaaaactgaaacagatgttcagtgacttgcccaagctcagaatctactacgtggtaaagactgggttcccacccagacagacggactcaagaactcacgcactgcctctgcaccctctgctgccaatgaaaatttaaatgagggcaacaggagatcagagatgccaagagatgttggaaaacagaactggctgaagaaatgacaactgaataaagaggggtgaagggagctgtgaaccacagcaatgccaagagggcatccagccaggcagagtggtctactaggcagagcctcagagaggggaggagttcaccaggcccacgtgccatatgggattcatgccagccttgagtctacaccagtgaaaaaaatcagagagttcatgactgaagcaatatgccccagaaataatatctttgtattctgacacttcagtgggttcccattcaatcaccctacagggaagactgccagtagacctgccccccaccccgttcaatatgaatagatctaggatcagaaattggagaaaggtgaaagtggggaaacagaccaagatgaccaaatacaaaaggagtccagaacaaacaagtaattttttaaatctcaaacccatgtcctcagggagattaaaaaatattttattcataaacttaaaacaagatatatagaaaagaagaaaaatcaatgaaacaaacaaaaaaagagattttctagaaactaaaaggtgatgatcaaataaacaagtctagagagaccatgtgaaagaaagtcacggaaatcctccagaaaataaaccaaaaagatgacagaggaaaaggagctatatggggaatagaaaagttaccaggcacagggtcacagggtgttctaagaaagctacttgagaatgagccaccgggaggaagaaagggtgggtgggtgggtgtgtgtgtgtgtgtgtgtgtgtgtgtgtgtatgtgttgtgcatccatggagggcaggtggggataaccaagaaagaaaaagacatgggatccagaaaacaggaaaatcaacccagagagaagggaatctgaggatcacagtgggacatgcagtaggcctacaaaacgaccagtccaggatggaataaaaagggaatggttctgtgggaaaaagggactcaatagaatacctcaaaggattcacagtttgagagaaactgaggaaatgaagaaggcaagcagtacaagggaggaaaaaaaacaaaggcaattagaaacatcaggaaaaagtaaagctgtgccacaaaacatgtgcaaacatggtgtacaactcagctccacagtaaatagtatttaaaacatcacaaaatgtaaacactcttgattgatttttaactttgagaacagaacagagcatataaatatgagaactaaatatacttgttaccgattagtacaaacttaaagcacaaaggtagcagttgggatgtgaagcactgaacgaaggagaaggaggattaatattgtcatcttttaaagaggggagtcaagaaatactaggtaaaactgagagtataagaaagaaagttgtaagtaaattgtttacagctacaaagttgctaatggaggacataaaactggtgatacaatattaggaaaaggtggagaggagagatagagggagtgtacaaacaagatgaaaatgactaataatgacactataagtaataatgataataccgattcaggcccatcccagttaggggcggctccaaaatcaccattgttcttttctcaccttgtgtctctgcgcactccccggcacacccacttccagcagctggtctttgtttgcagactttattttaacagctcagtggttcccgggcatcctccagctcttatacaaaagccccctcctcaaaagccactcgcctccctctttccacttcccacctctgtttcagggtcgaggcatccagatatctgtcttctggggcccctacgcagcaagactaaaagggggacccagtcctgggcagcagttcaccaggggagtatgcagaggggcatctggacacttcttgctgtaagggacggggtgacgggagggggtcttcccttccccttcttcctgctttgttcactctgtgacaccctaggccaggggagctgtctcaacgccatctcatgagccatgagaaccaggaggaccaggagggagaagaggagcaggagggcagacagagctggggcctcggacctgcccaatacttgtgaggagctgcatccaggatcccatcctcctgggtcattgttggcctggctcccacctttgtctggagcctctgctgggggttgaggctggatactgcccctcaggcttgactaggacacagtgtgtactccatgggtgagcctgcaggctggtcaattccggtgtccaactgagcgacctggaagaggagccctccctcccacctcagctctgagccaagctctccagatgcagaggacagggactctcagcaaagcatctccctccaagtggttgtggggcatcctccttgggcagggaaagaggagtcgaaatgatttcctgagaaatcgtcattttcattttatttttgagaaactgtcttgctctgtcacccagtctggagtgctttggggctatcacagcttgctgtagcctagagcccctgggctcaagtgatccttctgcctcagccttccaggtagctgggactacaggcacacggcaccatgcaggactaatttgttaatttttcatttcagagagacagcatctcctgtgttgcccaagctgtcttgagctcctagcatcatgtgattctcccgcctctgcctcccacagcactgaattacaggcctcagccgtggcactgcacccttctgaggaatcttcagtgaaaagccacggtcaagttcaaaccccatagcagggcacacaggccctctgatgctctggaccccaccttcctcaccgctccctgccaccacagtcaccttaggtccaggcacccactgacgccctgcttcggtgcctcctggagcccatctactcctcccactcccatccccagcctcaggccttcactcagctgctccctcgccctggaatgtcccccccactgtccccaccatgtgcaagtcacctgtcctcagagacccacccaaagctgcctggtccatgcggcggcccccaaccctccccaggctccctgagcactctgctttccagagggagctctacctgtatgtggctctttgggcctctgtctcccctttagactctgaacattcaatggggacactgttgtgttcccagctgcaccccctacgactgacctggatgccctccgccctccctggcacagcctggctgaaatcccaggtgcaggaggcattacttgaactaaaagcaaccagcctctggatgacatggcccagcttcagtttcactttcagttgagaaattgaatttaatttttctttctatcttgatgggcatctctttttggtgaagaacaaataagaccatgactcatatttcacagaaattacccccctgatttcatggacttttggcagctctatcaagttttttagaggggaaaaatcttaggctgggaggggaggtgacttgcccagagtcacacagctcttggagggcagaggggaggccaacatctgcccttgtgactctgatattgaagcaaaaatgggtgattttaataatccaacagtgtccaggtttgattctgcttctacaaacacagagacctaagctctcactcctgtagttatactcacaattccacagtgtggcttttgaatctcatgattgcaaagctggcatcatgccacaggtaccattctgcaatgcgaccttctcactcccctgtctcagccatgtttcccattagggacacagcacagcctgtttcttctctatcagctcagaggtctgaacagagggacagaggtgagggccagagacgtgaagtcctatgatctgcctgctcagcctcctgacacgggaccctggcaagtcattcccctcccagggcctcagtttccccacagggcctggcacaagtaggtgctcagactcagggtgagtgagacaacctctgagttccttgtgtctcaaaagaaatctgttgttcccattgggcttcagcagcagcaccctggggccagcctgggtgtggcccggccacaaggacatgccgggctccaggtcacctcccctcctccaccttctttgattccttcaaatttcccaaagagatgggcacccccaacacctacctttcttctggggtcagctggccgtgtctgagggtgtcagaaccagagctgagcccggggagctttgtgaacccatctaagctgttttccccacctctctctacagtttacccgcccagcaggagggagggagcaatcagactcaagcctgggtgcaaatcccggctctgccactgctttcctgtctgatctgaaccagctacctaacctctctgagcttatctacaaaagctgaatgatccttcccttatagagctattgcaagaataaggacatgggggtagatcacactatccccaacttaccaagggatcttcctctgacagagactgagcaagatccaactgttctgagctgtgtggatcccacgtccagctgtgcatctgtgtaataaccagacacgtcctccggcctcccagatataccctggaattcgaaagggaaagtgaaagtcacaacttcccagcagctcatgaccaagcacagtaaacacgctgctccccagcaccacctgcagtccaggcccagcctccttgctgctgcacttagaggagcagccgcagaccagacatccgggtccctctcatccaacccacctgcctcacatcctcaggattcaaggtctgctgtgtcagctgcccatgtctcaggcagtcagaaccagagttgagcctggggagttttttgaacccatctgagccgcttgccccccaacccccgccccgatctctgcagtttaagggcacagcaggtgggggagagaagtcagactcaagcctcagtgcaattccaggctctgcccctgttttactgtctgatctgaactagttacctaacctttctgagctcaagaaagacctgccactgactgaccgtggggctctccagattactccccgtccttccgttcccccacattcctcagatgcctgccttactcccacacatgccatcagcatcagcacagtcccccacacatgctgggtggatgcttattgcatatttattgtaatgcttctgaggttatgttttctgttatgtttttgatatagagtcttgctctgtagcccaggctggagagcagtggcacaatcatagctacttcaagtggcacaatcaagccatcctcccatctcagcttccgagtagctgggattacaggtgcctgccactacacccagctaattttttgtaattttagtagagatggggtttcaccatcttggccaggctggtcttgaactcctgacctcaagtgatccacctgccttggcctcccaaagtgctgggattacaggtgtgagccacggcgcccagcccattgtatccttcttgtgactttgtgtcttcatagcttagctcctactaataaatgagaacatacaatatttggttttccattcctgagttacttcactcagaataatggtgtccaacttcatccagattgttacggatgccattattcccttcctttttacagctgagtaatattccatggcatatacatatataggggtgtgtgtgtgtgtgtgtgtgtgtgtatatacacacacattttcttcatccacttgttggctgatgagcatttaggttggttccatattttttcggttgcaaattatgcagctataaacatgcatgtgcgagtatcttttttatataataacttttctcctctgggtagatacccggtagtgggattactggatcaaatggtattctacttttagttttttaaggagttgccatactgttttccatagtggttgtactagtttacattcccaccaccagtgtaaaagttttcccttgtcaccatattcacaccattttagctaggctggtcttgaactcctgacctcaagtgatccacctgctttggcctcccaaagtgctgggattacaggtgtgagccactgcacccttctattcttctttgatttttaaattatggccattcttgcaggagtaaggtggcaacttattgcagttttaatttgcatttctctgataattagtgacgttgagcacattttcatatttttttggccatttcattttgtatatcttcttttgagaattgtctattcatgtcctttgcccactttttgatgggattattttttttttcttgctgatttgtttgagttccttgtagaaactggatattagtcctttgtcaaatgcacagtttgcaaatattttctcccactttgagggttgtctgttttctctgctgattatttattttgctgtgcagaagctttttactttaattaggtcccatctctttatttttgttttcgttgcatttatttttgggttcttggtcctgaattctttgcctaagccaatgtctggaggagtttttccgatgttatcttctagaatttttatggtttcaggttttagatttaagtctttgatccatcttgagttgatttttgtatgaggatactgtttcattcttctacatgtggcttgccaattatcctggcaccatttgttgaatagggtgtcctttccgcactatacgtttttctttgctttgtcaaagactagttagctgaaagtatttggctttatttctgggttctctattctgttcccttgatctatgtgcctatttttataccggtaccattctgccattatgtaccttttttttttttttttttttttttttttgagatggagtctctctctgtcacccaagctggagtgcagtggtgcgatcttggctcgctgcaagctccacctcctgggttcatgctattctcctgcctcagcctcccgagtagctgggactacaggcgcccaccaccacacctggctaatttttttttttttttttttttgtattttagtagagatggggtttcactgtgttagccaggatggtctcgatctcctgacctcgtgatctgcctgccttagcctcccaaggtgctgggattacagatgtgagccactgcacccagcccttgtaccttttaagtgaaccatttagcccattttcattcaatgttagtattgagatataaagtgctgttctattcatcaggcaagttgttgcctaaataccttatttttttcattgtgttattgttttataggccctaaggcttataaaacaatatgctgtaaggaggttctattttggtgtatttcgaggttttgtttcaagacttagaactccgtttagcatttcttgtagtactggcttggtagtggcgaattctttcagcatttgtttgtctgaaaaagactttatctctccttcatttatgaagcttggttttgctggatacaaaattcttgactaacaattattttgtttaaggaggctaacaacaggactccagtcccttctggcttgtatggtttctgctgataaattagctgttaatctcatagattttcctttacaggttaccttatgcttttgtctcacagctcttaagattatttccttcttcttgactttagataccctgatgacatgtgcctaggtgaggatcattttgtgatgaatttcccagatgttctttgaacttcttgtatctggatatctagatctctagcaaggccaaggaagttttcctcaattattccctcaaataagttttccaaacttttagatttctcttcatcctcagcaacaccaattattcttaaatttggccatttaacataatctcaaatttcttggaggctttgctcattttttaaaattcttttttctttgtctttgtctgattgggttaatttgaaagctgtgtcttcaagctctgaagttctttcttctacttgttctagtctattgttgaaactttccagtgccttttgtatttctttcagtgtgtctttcatttccagaagctgtgattgttttttctttgtgatatctatttctctggagaattttcatccatattctgtattttttaaaatttctttaagttggttttcaccttcctctgctatctccttgaatagcttaataatcaaccttctaaattctttatatggcaattcagagattttttgttggcttgtatctattgctggggagctagcaatagctttggggggtgttatagaaatatgttttgtcatattaccagaattacttttccggttccttctcatttgggtagactatttcagtggaaagatctgaaactcaactccttctgttcaggttcttttgtcccacgggttattccttgatgtggtactctccttctcctaggaatagggcttcctgagagccagactgcagtgattgttattgctcttctgggtatagccacccactggggctataccagcctttgggttggtgctggggaatgtctgcaaagagtcctgtgatgtgatcatcttctggtctcctagccatggataccagcacctactctggtgtaggtgacaggcgagtgaagtagactccgtgagagtcattggttgtagttctctttagtgtgctgttttctccaatgctggttatgctagcagtgaagctgtcatgtggagagactgaggacctctggtcagtcaggatgttgcgggcagtggtattagctcttgtcttctccttcctgggaatagggttattctgtcatgagttgctgtaatggcctgagttggttggtctccagccaggaagtggcactttcaagagagcaccagctgcggtagtagaagggagatacaagcttgccctaggttgaccagggtaagtattctagtttctcaggtgattggcagggccataaagctcccacgagtttatgtcttttgtgttcagctaccaggataagtagagaaataccatcaggtggagggcagggttagctgggtctgagctcagactttccttaagcagggcttgctgcggccactgtgagggatgcagattgtcctaaggccaatggggtttgttacagaggggattatggctgcctctgctgtgccatatagttcgccagggaagtgggggatagctggcagcgagaggcctcacccagatcacatgcagttggcaaggctggccttgctcccgcagtgccccactaacaatgccaagtttagattcaggcagcctgtgcgcagaactcagaccttgtcccaggccataagcttctccactgagaaagcaagcatggctttcaggccttgcctctccccatctgcccacagtgtcagtggtggctcctgggctcatatttgcagaagttcctgttctccccctggattctgctcaagaaaattcaagcccagtagaaattattagaaaatccatctggaagcttctttcaccctgtgacccctcccaaattctgctggctgctttccccaaaggcctctgtgagataccgccagggatggtgccctgggcttgagctggacactgggaatgcctacaggattcttcccacttctgcttctacttttacattttgcatggttctctgaatccatttcagctatgggtaaggttaaatccctctcctgtaatctggattttcagattccccaggggcgatgtgtgtttggaggcagattttccctccctcacactttgggaactcccagttttttgcctgtctcatagaattggcaaggagcatgccacttctttcaaaggatctgtgaattctttcagttttcctggtacattcctgtggtggttcttggcacacattattacatgatgtgggtctccacatgctgtccggtccttccaagtgggagctgcatgttagccctgtctcctatctgccatcttcctcagacttctaacattaacttttaaaaagcttggtgggaagagaccagggccaaagttctccttcttggagatgaaagccaagaagcacttcctttgggacaagtcagaaaaatcctgaccaaatcaatgtgtgttcctggcgattctggcccaggcctatttcctccccatctgaggaattgcacaaacacagcagaacccttctgctggcccaggacatggagaggctggagtgaagttgatcagagctgggatggatcctggcttctgtccctgcacagctgtgggcctctaggattatgccttggagactggcatctggcgtctggcatctgtccaatgggaatagtaattcaatcatataggaggatggtgaaggccttagagtgaactccaggtcaaaggtgggggaccaagtaccatgatcctgccgaaaagtccagatagacctggaccaggggcagaaccaggggtcaggatgggcataagtgggcctaattggaaggtaagtaggaaggctgggacaccagggccaggactagggtgagaggagggaggcaccaaggacaccaaacgtaaggaggtcattgacttgcagaggacacatgagtgggagagggatatttcttccctccctgatttgatcccatcagtgattggcatagtgggccgtgagtgacggtttcccccacaccaagcctgagaactgtgagaactgtggagtttttgcgtgccctttgggaccctcttgtgttctacatagagtagcccctgaccctgggaaagcagtgtggcttagtgaccacttccggagtcagaatgggtggctgccaatttttgtaatttcaggggttctgaggaaacccataagttgccaaccaaagaggaaaacacttcgtctaccatcttgtccaaattcaggtcttttcagcattagcaatttatatagatggttctgaaagtgtcttgagtcttctagaggctccataaaattgcacatggccttggcaagcacagaggtgaagccatcactccttaggcatcgattaggctggtgacatctgaaagtgagacctggaaggttggaggtgcaggtggtaggtcaggaggcagtaaggtggctggagaatccatgtggactctccaaaactaatagccaggtctcctcctccagtcaactggtgcggtgcttggaaccagtgaccatcagtcagaaggtcaaagggcatgaggcattggaagagagcagatgccaggcaaagtgatcttgtgtaggtctgtttttggttttgtttgaattctgagtactcagagttaccaaaactgcaatgtctgagggcacccttatctttgacactaactgcaaatttaaggggattcctaaatccgtccttagattttataattcactagaggaattcacgtaactcactgaaaactgttattgcatgactgtggtttatcacagggaaaaaacacaggttaaaatcagcctaaggaagacacacagggcagagtctaggagggtttcaggtgtgaagcttcgttgtcctcaggaggctgcgttctcctgtgtcaatgtgggacaaaacacatggggtgttgccaaccagggaagctcacccagttaaggaaaaattcctgtgaatcacattaaatcaggaagaaagcctttattcaggattgttgttacaggggagggagactgagcccagctcccaatacagtaaagacagagggggagtcacagccaacaccagagtgaggggcagcagatggaacaggactgacaggaggcaccagagtcgggggttcatgctaaactggcctaacaggattttccctaaaggcaggtcagacactcacccatcaaggggcaggtgaggagagtgatcagatagcaagtgtgctcagacagtaagaagggaggaccctccctaaactgactcggggggattcttgctgagccagggttgtgcaggcccagcaagcacgggatgggcatggaaggccaaggttggtgcctagaggagaagaggctcagaagagcccaactggagtctggtcaaacagaaagtctttctcaacccatgccttagtgtccagagtgtttgctggggcttgaccacaggctgcactcatggctgacctggagtttccagcccctccctgaggtctcacacctttagtccccagatcctctggtggtgagaagagatacccaatagccccaaacccccatcatccatcacatttgctatactgtcctgtagccaaaccaccagggaaacaaagacattcctaccaggcagggcattccaggggcctggagatcacttcgcaggggtaggggacaatgggaagacctctcctgggat

SEQ ID NO: 545 - DNA, 33447 bp, Homo sapiens
cctgcggtttcaccaatgatcacagaatgatggtgctaatgctcaaagtggccccgcgcaaggtggagaggggaggccaggaaggcagtggggctgcagggttcgtaccttcaggtggcacttgttggctgtgtggatgtcctcatcattggggttgagtttgaaggtgccctgggcccactcctcaaccacctatagcacgtagcagcaataccaggggtcaggtgagcaggcatcagcagccgagagcccctgccctgatcccaccttattcctgatgactgactgtccctgtccaggagctgagtcctggaagtgcaccctgggagggggcatctcgagcccagcacacctttacccataagccatgtgggccacagggatcattaaaggagagaagaggtcaaggcacacagttaaacagcacttgagtatataattagttcaacgtaaaaccatccatctcggccttggcgaggagccctgccttctccatgccccggctgtaggctctgctgccttgaatatccacctcccacaggtgctggtcgtaggctggatgtgttgaacttctccatgatggggtccactgcacccactctggccaggagagcagaacaattagtctctcctccaccatccagaacagtgcctcttgcagagtctccttgggaaacttaccaagtctgatggtagcaggggcatgggaccatcctaactgggaagacaaaaaggctgagaccttcccagagtcaccttgggagtgagcatgggaacatggctgaacaccaagacagagccaggctggactgcagtagtgcaacctcggctcactgcaacctccgcctcccgggttcgtgagattctcctgcctcagcctcccgagtagctggtattacagacacgcaccaccacacctggctaatttttggatcattagtacagacagggtttgaccatgttggccaggctggtcttgaactcctgacctcaggtgatcctcccatctcggcctctgaaagtgctgggattatgggcatgagccactgcgtctggccttgaagttggggtctttcccaccacatggcaccaccccaaggagatggtggcagggcccgaggcaccccgggaccagagcagagcttctggaacctttcctgccactgaccaaggtgccaggtgccatcctaattgatgacacaactctctggggtaggcaccaatacaatcccactatgaagagggggaaactgaggcacagggaggcatgcagcctgcccttacccggggagggagagccagggctgcagcccagcagtttaaagtcagaacccatgctcttcacccctgttccaccacggcctctgagcttggctctggtgtcctgaacttttgctgcagggacaggcaaggaggcactgacggtctccaccaagcttaagtgccctgcaactctctccctcacagcttggagtcagactaagagactaagatcccaattcctactgctcccttggctctgaagagcactctgacaccccccattgtcactggccttctaggaggtcactgggtgacccttactccccaggagccaagggtagagagatggtacgtaggcatctacattttgttcttatttttgagacacggagtctcacttggtcgcccaggctggagtgcagtggtgcgatctcggctcactgcaacctccgtgtcccaggttcaagccgattctcctgcctcagcctcccaagtagctagaattacaggtatgtgccatcacacctggttgagttttgtatttttagtagagacgggatttcaccatgttggccagactggtcttgaactcctggcctcaagtgatccacacacctcagcctccaaagtgctgggattacaggcatgagccaccgagcccagcccattttgttatttaaaaaaaattttaattcttttttagagacagggtctcactctgttacccaggctggagtgcagtggtgccatcacagtttactgtggcctcaaactcctgggctcaaccaatcctcctgtctcagcttccccagtagttcggactacaagcatgtgccaccacacctatacatttttgaaaaattttgtagggctgggtgcggtggctcacacctgtaatcccagaactttgggaggccgagacaggtggatcacgaggtcaggagatcgagaccatcctggctaacatggtgaaatcctgtctctactaaaaatacaaaaattagctgggcatggtggtgctcgcctgtagtcccagctactcaggaggcttggcaggagaatcgcttgaacccgggaggcagaggttgcagtgagccaagatcgtgccactgcactccagcctgggtgacagaaggagactctgtctaggaaaaacaaaaattttgcagaaaatatgttgagacaggatctatgttgcccaggctggtcttgaactcctgggctcaagcaatccttctgcttccgaaagtgctgggattataggcataagccaaggcgctggccacatctatgttttgaaagcgggcagaggccagggcatgggacagatcggggaagggtacagggcacctgggaagtagtcctagtgcccaggactgggggggagggtggggtggaggtgggcacgtcacttgactgacatcctttttgtggaagggactctacaatggccaatagggacatatgtcctcctctgtccccctgcaatgccccagacctctgttaaccacctggcctggggcctattataaaaactcagggttgggaggcccagatgggtggatcccttgaggtcaggagtttgagaccagcccggccaacatggggaaaccctgtctttactgaaaatacaaaaattagccaggcgcagtggcgggcagctatagtcccagctacttgaaagtctgaagcaggagattcacctgaaccctggaggtggaggttgcagtgaacagagatggcaccattgcactccagcctgggtgacagagcaagacatcttctgaaaaataatacagtacctatgtgatagccttgttttgagcattcaatcaggtaacatttgcaaattgcatgcataacatggtgcctggtgctcaggaaggaattgggaaatgccagcagttactaagggagggcaggcaggggacaggacatgtttcagctccactcctggttcttgtgtgcacccagagacctctaccgtgctctggccctgagctgtgaactgacccctccatgcccaacagccccagctgccaaaggactctgccctgcagagggagcctccgcccccaccccgtcttttgagctggtcctgccccttaccccacaagctgccccaccaagcctagatctccagcaaagcactaggtggggcctggatctttctgatcactggggccagccagtcagaattggagccagcctgcccctcagctgggagcctggcagtacctcccccagcggggtcctgggccaccctgcctgtattattagtaataaaaactgctaaatatgcaaggctgcagccaaaccaattagtgccaacctacaggaaggcctggggcaggctgaggtcacctggagtgctgggctggtccaacggcagaccactctgctctaggaccaagcgcctatccttactggcaggcataataggatgccactgggagatcagagtgaggtgcctccccttgggcactgaggagaagggaggcccagtgtggtagcagaaggtgctgctccgagccaggacacttctgggccagaatggtctcttcagggccaggggatggggcactgagttgggctgggttgaatgagcaacagtcaaggtcgaatgtacacgggaaatatcaattttggttttggggtttgtttttgtttgtttgtgttggtttgttttgagacagagtctggctgttgcccaggctggagtgcagtggcaagatcttcactcactacaacctccacctcccaggttcaagcaattctcctgcctcaacctcccgagtagctgggattacaagcgcttgccaccacgccaggataatttttctatttttagtagagatgtggtttcaccatgttggccaggctggtctcaaacttctgacctcgtgatccacccatctcagcctcccaaaggtgccggaattacaggcatgagccactgcacccagcccgcctggcccattttgtttttcttttcttttctttttttttgagatgaagttttgctcttgtcacccaggctggagtgccatggcatgatcttggctcactgtaacctccacctcccgggttcaagtggttctcctgcctcagcctacatagtagctaggattacaggcacccaccaccacccccagccaatttttgtatttttagtagagatggggttttaccatgttggccaggctggtctggagctcctgacctcaggtgatccgcctgccttggcctcccaaagtgctgagattacaggtgtgagccacccctcccggccccttgcctggcccaatttttaatatattacaggattgtggcaaccttgtgttgagctagtgtagtattggtgctatttttccaacagcacgtgctcacttggtgtctttgttcaacatttcggtaattcttattgcatttcaataattcttatcgcctcccaaattgctaggattacaggcgtgagccacggctcctggctgtttttttgtttttgttttgttttcttttgttttttttgagatgagatggagtctcactctgtctccaggctggaatgcagtggcacgatctcggctcacgcaaactctgcctcccgggttgaagcgattcttctgcctcagcctcccgagcagctgggactacaggggtgagccaccacgtccggcctggctgtttctttgtcctcctcctcctcttcctcctccgtttctttttcctcctcctgtttctttttcctcctccatttctttttcctcctcctcctcctccatttcattttcctcctgctcctcctcttccatttcttttccctcctcctcctgctccatttcttttccctcctcctcctccacctcctcctcctccaactccttctgctccgtttctttttcctcctccttttttttcccctcctccgcttcctcctcctcctcgtaggcacgagacaccatgactggcctggttgtttccttttcctcctcctgctcctcctccacctcccaaattgctgagattacaggcatgagccactgcacctagctgtttcttcttcttttttctcctcttcctcttcctcctcctccattttattttatttttagatatggagtctcactctgttgcccagactggagtgcagtggcctcactgcaaccttcacttgcctggattcaagcaattctgcctcagcctaacaagtatctggaattacaggcagcagccaccatgcccagataatttttgtatttttagtagagacgggatttcaccatgttggccaggctggtctccaactcctgacctcgtgatccgcccacctcggcttcccaaagtgctgggataacaggcctgacccactgcgcccagcccgcctggcccgtttcttttgttttctttttttttttcttaaaacagagttttgctcttgttgcccaggctggagtgcaaaggtgcgatcttccctcaccgcaacctccacctcccgggttcaagcgattctcatgccttagccttccgagtaactgggattacaggcacttgccaccacgcctgcctaatttttgtacttttagtagagacaaggtttctccatgttggccaggctggtcttgaactcctgacctcaagtgatccgccctcctcggcctcccaaagttctgggattacaggcgtgggtcactgcgctgggcctacagctcatttcttaccacataaagttttgcgcctctccacaaaactgccatcagggatgtccccagaaaccattcatcccaggcgccacgcagagaagagctgcttgttctccttttccctttacctcttccatctcacctcatcttgttcattcattcatcccttttccattctcacttttaagcgttaacctttcaaaaccctgttttcccctataagtaatgtcttgtaactcccgcaatcaccatatccttctccaacccaccaaactgccatcctgagtttatggtaagtccataaactaagaagaaatgggaaacattcattgcaaacctggcagcccctcatccacccaacgtgacagcacagatgttcttgtctttgaagacccccttttttttttttttaagacaggtctcactctgtcaccctggctcaagtgcagtggtgtaatcatagctcactgcagcccccaactcctgtgctcaggcgatctgcctgcctcagccacccaagcagctggaactacaggaacacaccaccacacctagctaatttgcttactttttgtagagaaggggtcttgctatgcttagcagactggtctcgaactcctggcctcaaatgatcctcccaccttggcctcccaaagtgctgggattacaggcatgagtcaccatgcccagtctaaagacttttaaatgctgccatattcaagatgtgttgaaactcacctgtattcgatgagcctgctttttgcaagtgagtaatataaaacagactgaaataccttaagcttctcaggctttgtaccttcctaaagtaaatccatgaggtccagtttttccttcctccttggctatgaaatagacaagaaaaaggcaagctagccatttacatctcactatagcagactctcctgtttgctttttgactgtatttgggaagcaggggcctgactgctttcctacttactaagcacaactcacttttcctaggaaatcctcaacgcaacctgcatggattaaaccagctcctcgctttgtttccaatattcttacaatcaaagtgtccagaatgggcaaggcaacctgaaaaaatgaggacgggtacattatcctatgagccaaactgccgcttacactggttagtcatgaaatcggcaaaattccagatgagctctccaaccacgtattttctgagtttttgatccagacccagatggtactgctctagcagacttttctggtagtcttcactgaacatcagaggtggatcctgggattcaaggcaaagagaatttaagagtcagaactggcagaattgtaaatgttagataaaaaataaagatccacttgatggtgaccaaaatatctgtcctcgcagggggctatagtgactgcaggactcactgatgctagggtaaagacagccagggaatgatgtaacccagagttaaaaaggaggtttaaaaaaacaacatattaattagtaactgctttatttataaatgtaatctgatattcactttttcttacttttccgtctctatctgctggtacagtcttaaggctgaactacgttagaagtaaaaatatgactttgggccaggtgcactggctcatgcctgtcatcccagcactttgggaaactgaagtgggaggactgcttgagcctaggagttcaagaccagcctgggaaacatagcaagaccccatctctacaaaaagtacaaaaattagccaagcatggtggaacacaactgtgctcccagctacttgggaggctgaggtgggaggactgcttgagccctggaggtcgaagctgcagcgagctgtgtttccaccacggcactccagcctgggtgacagagtgagaccctatcttaaataaataaataaatgtatgtatgtaaaattaaattaaaccaggctgggcatggcagctcaggtctgcaatcccagcactttgggaggtcgaggcaggaggatcacttgagcccagaagttcaagaccaccctagacaaccagtgagacccagtctctacaaaaagtctaaatattagccacgtgtggtggcacatgcctgcggttccagctacttgcggggctgaggagggaggatcgtttgagcccaggaggttgagcagtgagctgtgataacgccactgcactccagcctgggcaacacagtgaggctgtctcaaaaaaaaatttttttttaattaaactaaataaagttatcctagtcatatgtcaagacctcaatagccacatggtcccaaaacctctggataaaacctaattcccaaaacctgtggatattaccttatacaacacaagagtgactaataccttaagtggaaaagtatgttaaagattttttttttttttttgagacagagtctcactctgttgcccaggctggagtgcaatggcgtggtctgagctcactgcaacctccgcctcccaggttccagtgattcttgtgcctcagtctcctgagactacaggtgttcgccaccatgcccagctaattttttttgtacttttagtagggatgaggtttcaccgtgttgttcaggctagcctcgaattcctggcctcaagtgatctgcctgccttggcctcccaaagtgctgggatcacaggtgtgagctaccctgcccggccttttttgcatttttttttttttttttttgagagtgagtcttgctctatcacccaggccggagtgtgtggcacaatctcggctcactgcaatctccacctcccaggttgaagcgattctcctgcctcagcctcctgagtagctaggatacaggcatgcgccaccatgcccagttaatttttgtatttttagtagagatggtgttttactgtgttggccaggctggtctccaactcctgacctcaagtgatccaccctccttagcctcccaaagtgctgggattacaggcatgagccaccgcacccggcctaaagtatgttaaagattttgagaggaggagatgatcctggattatctagatgtgccctgaatgtgaccacagtgtccttgtaagacagacacacagaggagaggacacacagcagaggagaaaccagtatgaccatggagacagagactggagtgaggcagccacaagccaatgaatgctggcagccacaggaagtgggaagagactgtgaaaattgtcaaaatagagctgcggccacacacagtggctcacacctgtagtcccagcactttgggaggccgaggtgggtggatcacctgaggtcaggagttcgagaccagcctgactaacatggtgaaaccccatctctacaaaaatacaaaagttatctgggcatgatggcgggtgcctgtaatcccagctactggggaggctgaggcgggagaattgcttgaacccaggaggcggaggttgcagtgagccgagattccgccactgcactccagcctgtgcaacagagcaagactccatctcaaaacaaaacaaaacaaaacaacaaaaaacaactctgaaaaatagagccagggaaaggccatgaagagaggactctcgtgcacaagtgccccattctcggctgggtgtggtggctcatgcctgtaatcccagcactttgggaggctgaggtgagaggattgaggtaagaggattgcttcagtccaggaggctgaggctacagtgagccttgacagtgcaactgcactccagcccaggtgatagagcaagaccctacctcaaaaacacaactcacaacattacacaaaggccatcacaaccttacacaaaaaatacttctgcaaagacatctgcccaggagtggcctgtccagcctcagactagtgtcacccttatcactgatcctagtagccaaggatgataattccaaaacagttatataccaaagctaagctatgaggaagcaaacacataagaatgatataatgggccgggcgcagtggctcatgcctgtaatcccagaactttgggaggctgaggcgggtggatcacctaaggtcaggagtttgagaccagtctggagaacatggtgaaaccccgtctctaccaataacacaaaaatcagccaggcatggtagtcccagctactcgggaggctgaagcaggagaacctcttgaactgggaggtggaggttgcagtgagccaagactgcaccattgcaccccactccagcctgaaagacaagagcaaaactctatctcaaaaaaaaaaaaaaaaaagggtctgggagccaagatggccgaataggaacagctccagtctacagctcccagcatgagtgacgcagaagacagtgatttctgcatttccaactgaggtaccgggttcatctcactggggagtgccagacagtgggtgcaggacagtgggtgcaggacagtgggtgcagcgcactgtgcgtgagctgaagcagggcgaggcatcgcctcacctgggaagtgcaagcggtcagggaattccctttcttagtcaaagaaaggggtgacaggcggcacctggaaaatcgggtcactcccacccaatactgtgcttttccaacgggcttaacaaacggcacaccaggagattatatcccgcacatggctcggagggtcctacgcccacggagcctcgctcattgctagcacagcagtctgagatcaaactgcaaggcggcagcgaggctgggggagaggcacccaccattgctgaggcttgagtaggtaaacaaagcagccgggaagctcgaactgggtgaggcccaccacagctcaaggaggcctacctgcctctgtaggctccacctcttggggcagggcacagacaaacaaaaggcagcagtaacctctgcagacttaaatgtccctgtctgacagctctgaagagagtagtggttcttccagcacgcagcttcagatctgaggatgggcaaactgcctcaagtgggtctgtgacccccgagtagcctaactgagaggcacccccagtaggggcagactgacacttcacacagccgggtactcctctgagacaaaacttccagcagaatgatcaggcagcagcatttgcggttcaccaatatccgctgttctgcagcgactgctgctgatacccaggcaaacagggtctggagtggacctccagcaaactccaacagacctgcagctgagggtcctgactgttagaaggaaaactaacaaacagaaaggacatccacgccaaaaacccatctgtacgtcaccatcatcaaagaccaaaggtagataaaaccacaaagatggggaaaaaacagagcagaaaaactggaaactctaaaaatcagagtgcctctcctcctccaaaggaatgcagctcctcaccagcaatggaacaaagctggacagagaatgactttgacgagttgagagaagaaggcttcagaagatcaaactactcggagctaaaggaggaagttcgaaccaatggcaaagaagttaaaaaccttgaaaaaaaattagacgaatggctaactagaataaccaatgcagagaagtccttaaaggacctgatggagccgaaaaccacggcacaagaactacgtgacgaatgcacaagcctcagtagccgatgcgatctactggaagaaaaggtatcagtgatggaagatgaaatgaatgaaatgaagtgagaagtttagagaaaaaagaataaaaagaaaggaacaaagcctccaagaaatatgggactatgtgaaaagaccaaatctatgtctgattggtgtacctgaaagtgacagggagaatggaaccaagttggaaaacactctgcaggatattatccaggagaacttccccaatgtagcaaggcaggccaacattcaaattcaggaaatacagagaacgccacaaagatactcctcaagaagagcaactccaatacacataattgtcagattcaccaaagttgaaatgaaggaaaaaatgttaagggcagccagagagaaaggtcgggttacccacaaagggaagcccgtcagactaacagctgatctctcagcagaaaccgtacaagccagaagagagtgggggccaatattcaacattcttaaaggaaagaattttcaacccagaatttcatatccagccaaactaagcttcataagtgaaggagaaataaaatactttacagacaagcaaatgctgaaagattttgtcaccaccaggcctgccctaaaagagctcctgaaggaagcactaaacatggaaaggaacaactggtaccagccactgcaaaagcatgccaaattgtaaagaccatcgaggctaggaagaaagtgcatcaactagcgagcaaaataaccagctaacatcataatgacaggatcaaattcacacataacaatgttaaccttaaatgtaaatgcactaaatgctccgattaaaagacacagactggcaaattggatagagtcaggacccatcagtgtgctgtattcaggaaacccatctcacgtgcagagacacacacaggctcaaaataaagggatggaggaagatctaccaagcaaatggaaaacaaaaaaaggcaggggttgcaatcctagtctctgataaaacagactttaaacgaacaaagatcaaaagagacaaagaaggccattacataatggtaaagggatcaattcaacaagaagagctaactatcctaaatatatatacacccaatacaggagtacccagattcataaagcaagtccttagtgacctacaaagagacttagattcccacacaataataatgggagactttaacaccccactgtcaacactagacagatcaacgagacagaaagttaacaaggatatccaggaattgaactcagctctgcaccaagcggacctaatagacatctacagaattctccaccccaaatcaacagactatacattcttttcagcaccacaccacacctactccaaaattgaccacatagttggaagtaaagcactcctcagcaaatgtaaaagaacagaagttataacaaactgtctctcagaccacagtgaatcgaactagaactcaggattaagaaactcactcaaaaccactcaactacatggaaactgaacaacctgctcttgaatgactactgggtacataacaaaatgaaggcagaaataaagatgttctttgaaaccaacgagaacaaggacacaacataccagaatctctgggacacgttcaaagcagtgtgtagagggaaatttatagcactaaatgcccacaagagaaagcaggaaagatctaaaattgacaccctaacatcacaattaaaagaactagagaagcaagagcaaacagattcaaaagctagcagaaggcaagaaataactaagatcagagcagaactgaaggaaatagagacacaaaaaacccttcaaaaaaaaatcaatgaatccaggagctggttttttgaaaagatcaacaaaattgatagaccactagcaagactaataaagaagaaaacagggaagaatcaaatagacgcaataaaaaatgatacaggggatatcaccaccgatcccacagaaatacaaactaccatcagagaatactataaatgcctctacgcaaaaaaaaactagaaaatctagaagaaatggataaatccctaggcacatacaccctcccaagactaaactaagaagaagttgaatctctgaatagaccaataacaagctttgaaattgaggcaataattaatagcttaccaaccaaaaaaagtccaggaccagatggattcacagccgaattctaccagaggtacaaggaggagcttgtaccattccttctgaaactattccaatcaacagaaaaagaaggaatcctccctaactcattttatgaggccagcatcatcctgataccaaagcctggcagagacacaacaaaaaaagagaattttagaccaatatccttgatgaacattgatgcaaaaatcctcaataaaatactggctaaccgaatccagcagcacatcaaaaagcttatccagcatgatcaagtgggcttcatccctgggatgcaaggctggttcaacgtacgaaaatcaataaacgtaatccagcatataaacagaaccaaagacaaaaaccacatgattatctcaacagatgcagaaaaggcctttgacaaaattcaacaacacttcatgctaaaaactctcaataaattaggtattgatgggacatatctcaaaataataagagcaatctatgacaaacccacagccaatatcacagtgaatggacaaaaactggaagcattccctttgaaaactggcacaagacagggatgccctctctcaccactcctattcaacatagtgttggaagttctcgccagggcaatcaggcaggagaaggaaataaagggcattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcacgagtgaactcccattcacaattgcttcaaagagaataaaatacctaggaatccaacttacaaaggatgtgaaggacctcttcaaggagaactacaaaccactgctcaatgaaataaaagaggatacaaacaaatggaggaacattccatgctcatggataggaagaatcaatatcgtgaaaatggccatactgcccaaggtaatttatagattcaatgccatccccatcaagccaccaatgactttcttcacagaattggaaaaaactactttaaagttcatatggaaccaaaaaagaacccacattgccaagtcaatcctaaccaaaaagaacaaagctagaggcatcacgctacctgacttcaaactatactacaaggctacagtaatcaaaacagcatggtactggtaccaaaacagagatatagaccaatggaacagaccagagccctcagaaataatgccgcatacctacaactatctgatctttgacaaacctgacaaaaacaagcaatggggaaaggattccctatttaataaatggtgctggaacaactggctagccatatgtagaaagctgaaactggatcccttccttacaccttatataaaaattaattcaagatggattaaagacttacatattagacctaaaccataaaaaccctagaagaaaacctaggcaataccactcaggacataggcatgggcaaggacttcatgtctaaaacaccaaaaccaatggcaacaaaagccaaaattgacatatgggatctaattaaactaaagagcttctgcacagcgaaagaaactaccatcacagtgaacgggcaacctacagaatgggagaaaatttttgcaaccgactcatctgacaaagggctaatatccagaatctacaatgaactcaaacaaatttacaagaaaaaaacaaacaatcccatcaaaaagtgggcaaaggatatgaacagacacttctcagaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccattccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatagaatactatgcagccataaaaaatgatgagttcatgtcccttgtagggacatggatgaagctggaaaccatcattctcagcaaactatcacaaggacaaaaaaccaaacaccaccatgttctcactcataggtgggaaatgaacaacaagaacacatggacacaggaaggggaacatcacacaccagggactgttgtgggatgcggggagcggggagggatagcattaggagatatatctaatgctaaatgatgagttaatgggtgcagcacaccaacatggcacatgtgtacatatgtaacaaacctgcacgttgtgcatatgtaccctaaaacttaaagtataataataacattaaaaaagaaaaaaaaaaagaatgatataacggggtccggcatgctggctcatgcctgtactcccagcactttgggaggccaaggcaggcagaccacctgaggtcaggagttcaagaccagcctggccaacatggtgaaaccctggctttactaataataccaaaacaatttagccaagcatggtggtgggcgcctgtaatcccagctggtggaaggctgaggcaggagaatcacttgaactcaggaggtggaggaggttgcagtgagccaagaccacaccattgcactccagcctaggcaacagagtgagactccatctcaaaaaaaaaaaaaaaaaaaaaaaaaaaagaatgatataatggactctgggtactcaaggggaagagtagaaggggagggggatgagggataaaagactacacactaggtacagtgtacactgcttgggtgatgagtgtaccaagatctcagaaaacaccactaaaggccaagtgcagtggctcatgcctataatcccagcactttgggaggctgaggcaagtggatcaattaaggtcaggagttcaagaccagcctggccaacaggatgaaaccccgtctctactaaaaagataaaagttggctgggtatggcggctcatgcctgtaatcccagcactttgggaggccaaggcgggtgaatcacctgaggtcaggagttcaagaccagcctggtcaatatagtgaaaccccatctctactaaaaatacaaaaattaggcgggtgtggtgacgcatgcctgtaatcccagctactcaggaggctgaggcaggagaatcgcttgaacctggaaggtggaggctgcagtgaggtgagatcacaccactgcactccagcctgggtgacagagcgagactctgtctcgggaaaaaaaaaattagctgtgcatggtgctacatgcctgtaatcccagctacttgggaggctgaggcataagaatcacttgaaccagggaggtggaggttgcagtgagctgagatcgcgccactgcactccagcctgggcgaaagagcgagactccatctcacagtaaataaataactaaaaataaaaagagaaataagtaaaaataacaaccaaacgacaaaacagtgcagtttattcaaagagacagagactcttagaactgagaaaagggccctgttgggctctagagacccacaccctgctctcggggtcaccgtcccctacccagaggctactgagacagtccaagcaaagaacaggtggctctatgcacctgggacacccgtgcccaggcagcctgcttacatgtggggaaactgagtctcagaggggctaaggtattgccgaggtccacttgcccggtttccagggcccatgcccccatgccctgccctgctcatctcccaatctccaagcagggcttggcacccgcagctgaacaggcctggtgtacacatggttgtcaggttccttggaggccgagggcagccagagacagaggccaacaatgagcagcaccaggaccacggccagcagacccagcaccactaacttcatcttcatgactctactgcatccacggggcaaggagcagggtcagacccagcctcagacactccctggcacctccccaacagagcacagtctaaagtcgggcctcagaaacacaagttcagtgtctccttctcgcctcccagaacgtgtgcatgctgtccagtcctgggagtgggcgcctccaaggaggagcagaggcagggaaggagcaggagctgccagagaacccataagcttacctagtcccagaggggacaagaggccagccagggggtgcccagcagccctgggggacagtgcaaggcatctacacagggtgcaggacaggcaggcctctcacagaggtccagcctagcaaggaggatggggaggctgacgtcacagcagcaaggaggcacacagtgactccgcacagtaactcagcctgtcaccaggtgactaaacttcatgcagccctgggagggccccgggtgggaggtgttgtgagccggggaatagggttcccacttcccaggctcagttccttccaaagggtgctgtctgcccacgagcccctccagtgagccccaggctgggtctctctctggctctccctgtccctgttcagaacatctgaactcacagccagtgtcccagagatggctctggaggcggtggagtagtggtgcccctggcactagaccagaacccagcctaaggggcctcaccacacgctgctgtcaatgctaaaggtgtgttccgggaacatggcctggggccctgagtgcagactggttctgctgcccatccagaaacattagcaccccaggcccaaggaaccacccgaacagcccagaaaggcagggcccagagagggcctgagctggcccaagctcacacagcccagcagtgcaggcttggccacttggtaactgccccaagttactgcatgtttctgaccagcccaccaagaagtctgagccaggaacagctgcggacccagcccaggggactttggacagtgctgcccattcccctgtggccctcatctgccaaggatatgggccagagtctccctgagtcatggctccctcccctgctcctgggcctgctgtgtctacggtgccggagagcccctgcagcctccacctgaggtctattccgtgcccataacacctaccccacaatcatccttccaggctgccccagctgacagaaggggacatgaaggctgacccaatattgctgcctgcctgggtcacatagacctgtcctgtcatccactgctctcaaatgggctctggacagaacccaccagacacacaactgtgagatcctcaatagccctagggtggaggtgctatgaccaagcccttaccctggctattcctccccctgaagatcagggtgactgggaagatgacagggcaggaaccaaggccccatgacctgtccctgaaggctagacagccaacaggaacatcaggggatttggccctcctaagtggctgcattccatggcagtcagccatgaggggtctaaagtggagagccacagggctctgtcccctgccccggcctgctcagcagtttcctctctgcctgagagcatataagacaggcaggattcacagcagcaggtgggcaggaagaaagtctgagtgcgcaaaggatggctcagacccccgcagctgaccccaaaaagaaaaccctgggctggggaaagtagggagacagagctgcctttgatggggcacagccgaagcctggcagcagctgaggattccagagaggggagacaggaggggaggcactttatcaaaggacatgttaatagaggtagggcctacagaacgaaggaggcttctcctcgcatgctgagtgtgtcacattctgtcccagtcagccctctaccccctgaatgcagagagggcacctagggggaagtgggtctggggaagccatgtcacccaaggaaagactgcaggggctggcctagaagtcttctgcagaccccacagctcttgtcctgggcacataaggtagtgagttccctgtccccagaaatgtgccagcctcactcacccagagacacagactctggtgtcagtatcacccacttccaacacacgtgcaagcacgtgcgcacacacacaactgagcctaatctaggctgagcagagcagcttcccaggatgcagcagagagaggagtatgaggaagagatagacatggcagccagtctgaagtttcctggttaatccttcaacccagcttgatggctttgtcaccacaaccccagagccacaagggtgaaaccagagcacagccccaaccccattcacaggcaggaaactgaagcttagacaaaagggatttaccgaggtcagctggccccaggaggtctgcagacctgtaggtaagcccaggacccacccatcccttaccctgccagcccccagcctggagtcactatccctgggtacgagaacgcacagatctctgtggcttctccaggcctgtctacatccctggactggacgcttactacccagacctggagttggaatccatcttccacgctgtctacccatgcggtgcagtgttgagaattagaaaaaacaccccttcagtaagatttaataaccactacctgctggaaacctgttgaaagaactatatatatatccccatatatatagctgagaggtggcaggcaccccctggagttgggcaatgaccccttgcacaaatggccctgccccaccccaatccacagccacaaacagaacccaggagtgaggcaagcatggcccaaggacacagggtcccccaaccccatcacagctctggctctactccagagctgaccccccgcccccattcagggctgccagatcctcctgggtctgtttcttcatgctgcactctcccctccttttttttttttgagacagagtctcactctgttgcccaggctggagtgtagtgacacgatctcggctcactgcaacatctacctcccgggttcaggtgattctcccacctcagcctcccgagtagctcagattacaggcacgcaccaccacgcccagctaatttttctatttttagtagagaggaggtttcaccatgttggccaggatggtctcgatctcttgacctcgtgatccgcccgccttggcctctcaaagtgctgggattacacgcatgaccactgcgtctggcccactcttccctctcaattccaagaagccacggctctctcaagggcttcttcgaataagtcaggtgactctgccccagccctccctcacccaccggcatacctctctcaaacccacttagccaagaaacagaggcgccccctagcccagacgcagttggatagagaacccagggctctccccttctgtgggatccctctgcaggatgtgcccacgtgagtttcccccttcaccccgaagtgcaactcactcccactgcacaggtgcataaaccgaggctcggagaggaagaggaactcctctagagcacagcaagcatacggcagagctgagaatggaactcaggcctccagacactcctgggagtcccctggcctgagcttccccacttatgatgtccagcatctcagagagagtgagtggctcctccgggtcacacagcgctgggccacagccagctgccctcactcactggctcaccagactctggatctggtcgtccagcagcacactaaaaccaagctaagattccccgctgtgacccagctcctctcctccccgcctccccaggcagcatgggggcgggcagtgcggtgcgggggaggcattaaaggcacaagaactgctgcaggtgggacaatggctggctgctggtcccatccctggggctgtgtgatctgggaccgctgcaggtctgagtccggtggggtctcaaaccctgaatgagagacctgaactctgaaagcctcggtggggctgaatgaggctgggtttcagtgggaggcagattagaccaaaggttccctgggagatggggccacagagctgggctgcagccagatgcccacgccaggaggggctggagatgtaagcatctgaggccccacaaggtctgaggagcctagatcacctctacaaccccagggcaggggatgcctctcctaacaggccctctccccagcttgcagggctacaggtggggctctaggagctgtcactccaaggaccctggtcacctggactgaagggagtcacatgatccaggagggtccttcctcaacccccaatttcaagggtctgagcagacaggctgacagaggaccccagacagtgggagcagggggatgaggcccatccatccatcacgccctcacctgctctgccccattcaatgagatggggtgggtgcccccacagcactggcaggcccaagcctctcagccctcagatcgaggtccacacatggtctgcagcctgccagtattgtcactcttagcaaggtgcatacttaccttccttctttcattccatcattcattctctcatcaaatcctggcccctccagattcttctctcaaggagccctgacctggctgggcatgagacagtatggtcaccccagggggaagagccctacggaaggggcagacaccagaatagggcccttgggaatccagccggaggtgggattggatttggggaggacctgacaggcagaaggaaccacctgagcctgaaggccaggaaatggagccttttccaggaagtgagggctgcaggggacctcttgaccaccctaggcccgtcctgagccccgaggtgtcaaagctggaaaaggaggtggccgagctaagaccttcaaggccaggccagtctggactttgagagccctgggaggctggtcaatgtgtcaccgggcccagtaaaccattaaccctggctcactcattaagaccctggtgggtgtccattagctccttggccggtttcaggagccgggcagagggtaggggtcatgggaagaagggagtgctgattggggtgctaggtagaggctggctgagctggctctctgtgtccttattccttgaggagcgttccagggccaagctggcctccagccaggggcagctgcaaacacagcccggcgggggtgccgccccaccatcctagtgactttcatcttcttatcactcctgtgtactggcaccagcagcccacagtgcctcgggggcctcagcctgacaggaggctcaaggggccagtccagtgcctggctcagcacccagccacactgcccctctgagaaatgggcccaatgtggcctccaaagccttgtctgtttcaacgggctgggatctgccccacctctgtatctgggaaaacaaggccctggtggggcaagaagggagctcctggcataggaacctgcaggctgagaggggaagggacctgcccaaagccactcggcaagacagtgacccatgacaccaggaaggctgtgcaaaccacttcctgcaactggcgtctcattgcagccccaccccactgtcaggtccaggaagctgaccacaggaatcacccggaaatcctcgtgccctgagtgggccatgggggcatgacatcctgaactgcagtcatgaggctcacaatgagcgagcaatgcggatgggtccagatgcaagctgtgcctggcccatactccagaaccgctggaacaacatctcagggacccctgggagccagaaacccaatattatctaggacattttgtgtctcctggtgtcctgcaccaaggagacacttggtaaactggctaaatagaactgacttcaaatccaagcatcatagcattggagtcaatattaggatcacggaatctcaagtgtttgccctctgatcttccagcatcccagaaaggtcagcttacataccttccccaatggggagctcactacctccaaagatagtgggactgtgtttggttggcgagttcttcccaacattaagtgccaatttgcctctttgtaacacctgctgcaggtgggcctggcctcagatcctgcccactgtcaaaggccacagagcagagaaacaggggccaccccagatcctgtacctggccacaaattctctgagccacaaagaccacactgaaggaatgggaggaagacttcagctcaatggaagggctggtgccactcagcttgacggagggaggtcagcacaggccaactgtgggcatgggcagagctcctgtgcccccagagcctggccaacacccccagtgccatttgtagcatttgttattccagcacccacctgtgatgtgaggacacagactgaagcatggccaagtgcgtgggcccttcagaattgtcagcttgtgaatgcctgggagcacccagcagcagggctggcctggcacttgatggaacaagtccaactcccaaactcagaggcaggatggcagaggcatgggccctagagtccctgggttcaaactcaaccccagccactgatagtgtgggtatcacagcagcctttcccttcctggcctcagtctcctacctagagagcagggataactagaacagttactaggtggattccctgagacggccacgcacagactgtagggagcatctgctactttcaagacctcacagggtctcgccaggctctgacaccaggcctgtaggagcttctcacctttcctgatgagcagctcagagcaggggcccaaagggtacccctcctggccgccctgtcctccctgaccaggcaccctccacaggtagtatttatcacatcacctggtaattatctgcagtgtctgaaagctccaaggaggggttgggggtgcaggaagactgtccatgcctcagccccgacactatcccacgtcctggtctccaggaaagccaacccgaacccgctcatgtctcaaggcctccctggtgacatgcccaagcacacctgttcacacacagccccgtgacttcactgatgccaaaactgcgcagcactttccacgcacgccatgctctcatctggacttttggggacctccccctgcctcatagcagcaccttcccgacctcccttgcttcttggatactgggctcaggaatgttctcactgacgagtctgcgccctgctggcttatgtttcagacacaccagatggacgtgcccaagcctgagctaagcagctgcctccccagacctcctaccaccagggcagccagagtctagccctgggcagctgcccctgcatcctcactgggcctgtccagctgctcccacctctataccccactcccagcctcacctgatccccagtccccacaggccacccctctcacctggagactcccaatcacaggtcccagcccctctgctgtttccctactgcagccctggcaatcggcatgcaaatctgagcacacccctcccccactggaaaaaaaacactccagaggtcccccttgtcctaccttgctggcacccgtcctttcctcctttttttttttggagtggggcagctggatatgaaccgtcctttccccttgctccttcccggtctttgggactttgcactgactccattatcatggagacactcttcagacaccaatcacaatgccacctcctcctgaagccctccggcactgcatctcactctgcaggccggctgcgactgctgccccctccacagtatccacagtgcacaacaatcttcactgaatggatggatgccagctgtcaggtggctagctgtttttactaaaatgcatcttctaggactttacactgaatctacctagccacctgacagctggcatctctaatcttgtaatcccagcactaagggaggacgaggtgggtggatcacttgagaccaggagtttaagaccagcctgggcaacatagtaagaccctgtctttaattttttaattatatatatttttttacaagaccaaagaggacaaggtttggggagcttcatgtggaggccgacaggaaggtgaataagaactcatccaaggccaggcgcagtggctcatgcctataatcccagcacttccagagggcgaggtgggtgaatggcttgaacccaggagttcaccaccggcctgggcaatatagagagaccccatctctacaaaaaaaaaaaaaaaaattagctgggtatggtggcatatgcctgtggtcccagctacttgggaggctgagggggacgatcacttgagcatgggaggcagaggctgcagtgagctgagatagtgccactgtactccagcctgggcaacaacaaaaaaacccaactcatccatgtgtccaactccattaggacagaaacttctgtacttgggagtcttccagtctttgccttatattatctcttcatctgactgtttatttgtagcctttatttattttatctttttttttgtgatccgcccgcctcggcttcccaaagtgctgggattacaggcgtgagccaccatataccacgttctcacttcaagtgggagccaagcactgggtacacatggacatcaagatggaacaatagacactggggacaaccgcaggggctgagagggagaggggcaagcgctgaaaacctacatattgggtcctatctgggtgctggggatcattcataccccaaaccttagcactgcacaatatacccacataacaaacctgcacatgtaccccttgaatctaaagtgaaagttttttttaaatctcatgggattctttggaggaattaaaagaggttgagtccatccatgccccattcaaaatccaggagtggcttacaaatgctctggttttagagcttcaatatgagttttgtgatacaacacaaacaggcagaagggaactgtattcaatatacttgaaacgaaccattgcatataaaataaaacgataccatttgtggccaggcacggtggctcacatctgtaatctcagcagcactttgggaggctgaggagtccggcggatcatttgaggtcgggagtttacattcccaccaacagtgtttgagggctcccctttccccacgtcctcaccagtgttcattattgcctgtctttttgacaaaggcctattttaactggggtgagatctcattgtggttttgatttgtgtttctctgatgattagtgacactgacacaccactgtgccctcggctggccttagttcacttatacatctaacattcacacgactaaaatagtccccatgaagccaatagtgccattggtatcacgtagaaggatacaagacacgaaacaccgtgtgccagcagatgtatcctgcctgtgtctttagcaggaatcctcacggctgtccacacttcaggccaggagctattctctggatcctgctccccaagtgacacctcacgtgcaaagcagcaaggtcacatgggtgggcacagggctaccaagcttagaagcctgtgtcccaaaaagacactgagatttcttttaacagtcccatggtcaaagttttcaagggtcccagcaacggacatgcctagttacaaacaccactgcgctcagggaaacccaaagtatggtttacctcttgattttttctccaaagccagccacgaaaaagttgaccacagacttcaaaacatttctaacaatagcaaagtccaattgatggcagacttcaaaaattgcaaatactcttctctaactcgagatgcccccattgttttacaattcattcacagctctcccaattcagataatgatgaccaactctgggccatttttatttgtagtctggtaacccaacacagatgacattccaccttttccaggtttccaagggaactgactcagaaagttaacccaagttcatattcatttctagagaaagataaaaaaagttttctaactttattcatgcatacgcaatacaaggatccgtggaatttctgagagaccttcaacctcactgccaaattttcaagagctgtgacaaaccttaatgtcaaagaaagactgctttcatagcagcagaactgccatcacatctctcagctggatctgccacgggcttttttttatgacgtatcaactgcttccccatgtctctgagttgttgaaagtatcacagcggcaaacacatttttctttctcacttttttttttgctgttgagatggagtctcaatcggattatcccccaggctgaagagcagtggcgcaatcttggcccactgcaacctccgcctcctgagttcaagcgattctcctgcatcagcctccagagtagctgggactagaggcacatgccagcacgcctggctaatttttgtatttttagtagagacagggtttcaccatgttggccaggctggtctcaaactcctgacctcaggtgatccacccgccttggcctcccaaagtgctgtgatcacaggcgtgagccaccatgcccagcaggcaaacacatttctagttcatgcatacatatgccaggtgggatgaacctgccccggggcccctgatggtgctcatgggtagagcagggtgatccccaggtcccacgatggcatgggacctgatgctggcatcaggtggtctggcctgttgttaggccccctgctggtgcaagcacatgccagaagtggaaggcagggcaggtctatacccaggtccctgggtgaagtacttgggtacttgtggggtgggggttctctgggaggggtcagcctgtccttaggccctgtgggagcctgcatggacacaggttgtggttggtgggctggggtgatccccaggcccctgaatgtcatccttggggaccaggggcaggtgggctgggtctgttggcagtcctccctatggtatgtgtctgtgcccatggcaagaggtgggcagagcaatttccaggctcccaggtggcttgcttgggtggcagtggtggtgactggttgtgagtgggttgagtctgcattcaacagtcaactcagaaaccccagacaccattttccatgccaactggcctgtccaccactcagaaaggccctggacactgtgccatgtggctggccccgcattgggccaggcttccatgggaggcaggaggtctgggccctgccctggggagggagaagaatgggacacaggcagtggtcattgagcggaagagacagaatgagcacaggatgctgtgaggcggtaagtataaggaatcatggagctgaaggtgttcatctgacatataccagaaactaacataaggtaggaaaatacacaaaaccaactaatccaacaaaacttgggcaaagaactgatagacatttctgaaaagaaggcaggaaatgaacaggtaaaaaaaaaaagcttgcccacatcactaatcatcacaaaaatttaaatcaaatcacactaagacagcgtccccatccacataaaatgaatgttgccaaaagcaaaaacagaatttttaaaacgcaatcacaagtgtaaatttacagagagggaaactcttagacactactggtgggaatgtaaatgggcgtacacactatgagcaatagttggcagttcctcctcaaactaaaaatacaattactatgtcatctagcaatctcatcactgggaaatacaaagtacatggatgtattatgctccctgattacaaatgacatagaagagctatagtggtccaaacaatacggtattgacattaacacaaaaatacagaacaagacacaacgagggaaccaaataccaaacccaaattcatatatgatggacacatttttaacaaatatacccaggggatgggagaccccgggctgccttcggttggggctgcagaagtgtcctggggggacctgcagccacctctcacctgggctctggatggtttctactccatgaggatttccagagtttcccctcagccaccctcagagtcaggggggcttccatggggctgcaaccatctgtcccagtctttcctgtctctatgacacaccgtgtgacctgtgtacactgcgagatgtaggtgcgtgcattgaaaccgtacagttaagatgacctacaactgatgctactctaagtcttccagagatttttcagatatccccagagtaaaccaaactagtgatatcccatggttttgcaaaccagaaccaacaactgcacagaaacagctccttatgcgccatcagacactctccagacctgcccctcactcacaaatgtaacaaagcagcatgaacccaggcagtcttcactcctcagggccacataacaacctctatcggtcaggaagcctttgatctgggccaggctgccgacccacaggggttaattgtgcctctcatgctgagtgttgtttctcctcactggactaacccccacccttccaccaagaagggcccccagggaaactgctgtttgacatccaggagcccatgtggaatgttccagcaacctggatggccttggccacctctaataccagcctttccctctgtggggctcccttcctggctcttgctcatgcaagtcaatctaaagtggctgagatgtcctgctccctcaccctcctgggtcaccctgatggcataggcaggtgtctgcattcaagaacgagttacccacaggccaacttccctggtgtgggggacaatgcctggggcctccaaacagccagccccaggtaaacaatccagctctgacacagctcaaagactgtgtggcgtacctggagagactctctggtcctgtgccctcttctggctcactggattcttaggattattgagagactgggcttaaagctctcagcctagggcccacaatgccacagggaatcaaatcagcatgaccagggatcgaagacctctccttggctgggaatggggaatcagggttgcagagacaaggggcacagagagatgcctgtgccatcagagaagggactggggatctggtccactctgggctcctcaacctgagcgtgaggccttgctgtgccatgagctcacctgccccttgggagtccactgtgactgcagtccagtggggtcaatgtccacactgatgccggaaagaagtcctgggagatgcggagggcatcctgtagcggcaggcagtctgggtggtccacgggtgtgagcttcagcaggtcctgggaagggatgaggtggtgaattgggggccgtgtttttggggttcgatgagaagctcctgggggaatgctcagtcctcaccaaaagaattcaaagggcaggtactcagggacccacactcgtgcctgcaaaatctgaactgaaaattagaatcggagcagcagggttgattctaaaaggggctgggctcgcttttctccctgctgcagtcattactcgtttcccctggcagaggcagccgggtggaggctcatctcttcaagcagctgggagagacaccccactacccaccctgcagctgctccaaggatactggagacaaaaagacaggggctggggaagcaagatgttcctgcctcgaccaagacagcaattggccaaatgccctgaccctgctggcatggttaccgcaggccaggcaggcatattcagggctcaggatccctctgcctgacttttcaaatgggctgttctcagtgactctggccccctcccaccctgggctcactcttgagaaactcctaagccttctctggcccttcaggggccttaacgcttatgtgtaggaccaggatgctctgagtgacctacttggtcaatgggctgctacagcagagctgttggggaaggcagagagaaaaaggacaatgacagacaaagaaccactcaacacctcagagaccagctttgtcccccacccaaccgccttgctccccacatgaacacctgcttgcaggaagccaaagtgggtccacagcagcccacctctgttctcactcccagggcagacaaagcagcaagaacaggtgacacacagccccggtgaccctgtcccctccctacccgtgcctactctcccatcaaacctggcttcgagggctgcccgccagtcctgtccaggccttatctggctcagagcagatgatcccctgcacctcccaccctgaatcacacagctacacccagcacatgctacagaggcccagcacactctggatcacatccagaaactccacaataggggaggagacatgctgtttcccaggaagggcagctccccagacttggtcattctcagactcctccagtcaaaggccgggcacagccagctgggatcgccatgcttcactctgacccacacgactggccttgcctcctctatgggaagagacccctcagcacaacctcaaaccgagacataacaggacaggacaggctggatgctagagaggccagccagatctccacacaaaggctctgctcttaagcaggaggtagcctgagggtcaaaggtttcctgaagcaactcaggtgagacctcacatacaagagccccaaagaggctgcaaaagcaccagctcagccagccaagaacccaggtgtcacacccttctcagaccactgaggatcgctgggattcagcaggaaaaggtggacatgacagctgatggaccaatacttcccaacacccttccagcaagcagctgtgccccgcccctccccacatgagtcactcaacttcagtcctgcacatggatgcctttgaccatggggtcatggctttggtctcctgccataggggcagtgagaggaacaatggtggtctgggaaggaggatcctagactgggtgtcccacaagaccaggctgtgacagatcccagagccaatactcatgcgccagccagtccccaaacccaacagctacccaaagcccaggatataaatagcctgtgcactgctaagcagatacttcagggaatgatctgctggctgtgaagaagatgcggcctcagtagggttccacgagccttctgccagcaaaatcttctttgcttggatgcccattagaaacactaagggagctcttcaaaggaacaggccagacatggtggctcacatctgtcaactcagcattgtgggaggctgaggcaggaggacagcttgaggctaggacttttaagaccagcctgggtggaacagtgagaccccacctctacaaaaaacacaaaaattagcatggcatggtggtgcatgcccatagtcccagctacttgagaggcagagaagggaggattccttgagcctgggagatcaagggtgcagtgcccatgatcatgccactgcactatggcctgggcaacactgcaaagtcccgctttcaaaaaagaaacaaacaaaacaaaacaaaaccaaagatgcctgtctcctgccccatcaaataaatccaaatctctgcagggtgacacagggtattaacattcttaaattttgcctttgctgaagtaaacatatagtaatggctgaaaaccactgcgttatgtaaatacact

SEQ ID NO: 546 - DNA, 33475 bp, Homo sapiens
acgtaagactgaaaacacttataaactgaactgaaaactacataccctgataataaaaactgtacctccttctcaaatggacatcaatattgaccaaaaaaagtgcacacatattaggtaatttaaaaagcaacagtatattttatgaagtagtaataatgcaaacactctgatcataattctaacaaaaccagatattaacaaaactaaaaacaaaaatggcattctacctcaaaattatacattttccaaaaaaagatacaaaattatatatttaataacctgaacagaggaaaatctgtagctttgaacatttatatcaatagtaaattcataattcaaaaagaacaaactaaactaaaacagagactagaaataataaagacaaaataaatcagctgggtggagaattttaaaaatcacatcataaatcaaaatcctggaatttttttaagtaaatgaacaaggttaatccagaaaaaaaagagaaagcacaaattcaaagtaagaagcgacaagggagacgacacatttcaacaatataaaaacacgtattacaaagattatttattgcagtgtcatttataattggaaaatacaatcagaaataacctgaatgtccacaaatgggaaagtgattgaataaacaagctgtagatccacacaatggagtactatgcagctctaaaaattaataaagagatctctatatcattataaaatatagatatccagtatatactgttaagtcggaaaaacaaaatacaaaagaatatatgcagtgttctactttttgtataggaaagaagatatacatttatctgtccattttgtgtacagagaaccaaaagaactatatacatgagaaactaatcaggataatcgcctaggaagcagaggataagggatggagaagatgagtggagaagtggtagaaaagatgggaggtatgatcaacacttttctgtgtatagctttctgtatggttctgacttttggaaccatgttaatgcttaatatactcaaagaaatatggagatccacaaagatgagaaagcaaaaaaattctaagatggaaatcaaacaaaacaaatgtctctattggtatttcaaatgactcagggaaaatttaggaagaaaggaagacctaaccaccaaagtaacttttgaacacagtatttttactacgtattctcaggatgtaaacaaaagagaaccgtaagtaaacactgagttccagtaagtgggtttgctttttatagtgttaaggattagcaattctaaattactttttgtatattctaagattgagcaaataagtaaatatactgtgaacaacagaaaccagacttcctactgttaaaggtagttacaaatacggaaagtgcagaaggaggctagaatgaaaccggtaatgatggctggcacaggaatatgtcttcatagtttttttttgcttttgcttttgtttttttaagatggagtctcgctctgtcacccaggctggagtgcagtggcaggatctcagctcacggcaacctctgcctcctgggttcaagcaattctcttgcctcagtctcccaagtagctggggttagaggcgcataccacagtgcccagctaatttttgtatttttagtagagacagggtttcaccatgttggccaggcttgtctcaaaatcttgacctcaactactccacctgcctcagcatctgaaagtgctgggatcacaggcatgagccaccacatccatcgtattcatagtttttatacagagatagatacagggatacatgcatgcatgcatgcgtgtgtgtgcacatggcctggcatgtgtgcatgtgtgtatgtgtatgcatgccctggtgtgtgtgcatgtgtgtatgcttaccctggctctgtacacttggggggctctgatggttaatttcagtaatttcaggtgttgacttgactgggccacagtgtgtccaggtatttggttaaacattttcttgttttctgtaagggtgttctggataagatttacattttaactggtagagtaaatcagtttgccctccgtaatgcaggtgggcctcatcaaatcagttgaaagcatgagtagaacaaaaagactgactctcagtaagaggcattcctccagcaggactgccttcagacttcatttacaacatcagctcttccacaacatcagctcttcctgcctgatggccttcaaactagaacatcggctctctctgggtctccagcctgcttgctgactctgcagattagacttaccagcctccatgatcatgtaagcaaatccctttaaataaataaataaataaatagacatctctcagtaacatgagtgcccagatcttgatttctaaataacattcacactaaaaagaattagggctgcttgaaaatatgacagatttcaaggctggataaggtaagtacaagatgactctgaaacacttattgccagaatataagaaaaggctcaggccggacgcagtggctcacacctgcaatcccagcactttgtggggctgaggcgggtagatcacttggggtcaggagtttgagaccagcctggccaacatggtgaaaccccgtctctactaaaaatagtacgagtatacatcaccagtaaaggaacaaaacaatagtatgggtgtcctgacaagagattctgaagacacatcacttctgtagtattccagccagaaacgcataacctgaatctaatcatgaggaaatagcagacaaactcaaatggcaaaaatatttctaaaaaataactgactggaattctttaaaaaatgtcatttatcagctgggcacagtggcttttgtctgtaatcccagtactttggaaggctgaggtgggaggattgcttgaggccaggagttcaaggccagcctgggcaacatagtgagatctcatctctttaaaaaaaaaaaaaaaaagtcatattatgaaacacaaaggaagactgaggaagtgttctgtattaaggaacctaaagagacatgaaaaaccaaaagtaacacatataatcctgaactggaacctaaaccaggggaaacagtttctctttcacttaaaaggaaattaggaaatactgcaaaatttaaataaagtctatagagtactgcatcaatgttaacttcctgatactgacgattatattgtggttatatattttttaaaaatccttatttagggagacatacttaggaataaagggacataagtatttaggggctaaggggcataatgtctacaaattactcccaaatggttcagaaacaaatactgtctcatgaaaatatgaaaccaaatatggtaaaaagttaatattaggagaatgtggagtgaaacctatacagtaattctttgaattatctttgcaatttttctataagtctgaaattatttcaaaataaaataaatttaggtaaaattacagtcatctgtgacaagcttttctacgttatttctcaacatatgtccaaacccacatacgtattataaaaaccaaaggcaaacacttaagaaaaccctcaagttattcttttcctgtaccctctacatgcaatggcacatagcctgctgattctaccctcttctcaacagcactattgcctcaattaccatattaccttggaaacatttcctgactccactcacccgcctttacgcacttgcaaaattaattctttcactccatttgaaaatcccgaatggtactccacagccaattcttttacaagacttaagtcttttccagatcatcctcctgcctctctctccacttcatgtttttctcattagcaagaaaccaagtgcaactctctgaacttgcaatactgtttcacggtttgagccctggcctatgatgtcatcttcgctgaaataacattactacaatcctttgtccatgaaattcctactcatgctttaaccctatcttagattcaccttctctgtgaaaccttccctgacacaacactcaaggtgaggatgagtacccattctctccctcctcagtgctaccatttaccttccactctattatgattatcattcatcattatccatctccccttctaacaagagctcactgacagaaggaaccatgtcatttttacttgttgaattacttaatatgaactcaaatagcgtttattacaatgagtaattatatgtagccaggtgtggtggctcacacctgtaatcccagcactttgggaagctaagacaggaggattgcttgaccccaagagttcaagaccagcctgggcaacatagtgagacctcatctcttaaaaaaaaaaaaaaaaaaaaaaaaaaagctgggcatggtagcacatgtctacagccctagctacttgcgaggctgaggtgggaggaccacttgagcccaggagtttgaggttacaatgagctacaatcgtgccactgcactctaacccgggcaacacagagagatcctgtatctaaaaagtaatttttttaaattatatgtacatatacatacacatgacctgagcatatagcaaagggtagatgttaagaaagcctcaatctgtatgttgacaagtaaaatctaagaaaatgaaaaaataaatttcagtctgaaaaatatttaaataggggagatgacccgtgctcttacttgtaatttaatatgtaagaacaagtcctagacttaattattttacactcatgtttgaaaaaaaatctgatgtagttttttttttttttttttaatttttatttgctatcgtttgatgatccagaacactttgtggttcacaggctttacaatcatgagttgggaccaaaataaatgtatgtaaatagaataatataaaaccatattttaccaagtagttttacttggtaatatttaattacaaggatcatctttttggtcaaagcgttttaaaagcagtaattactgatttaaaatcaagtctataaaaatatctaattaggtcttaatcgtattttcttgatctaaaaccaaactgattatataatcttctatcagaaaaatgtttaaaagaaaacattgcaaatgttgcacttgccctcctttctaagggacaaatgaaattattttctaataatgtacattattacagggacaaatgaaattattttctaatcctaaaacagagatccttaaatcagtaaagacatgataatctatatgaaagcttctgtgaaaaaaaaaataccatgacacacaaatatccataaccatacttacagaaattagcactgcttttcctgtcttcttgtgttttaataccccattctcctggtttttccgatgaccttctgatgttcactttgtgttagtctttttgggggacttggcgtaatttgatccttgtttacctggcccttcccacatttccatcgtagcctacatttccaggcataaaatttagcatctattaaaaacatgtgctttacaaagtcaggcactgagccagtttttatttaccattgtgtgtgtgtcccttccctacaagtcccaagcatactgtcagtgaacataagacaaatggctaagtttggagataattttaagggctaatttttaaaaagatttattttcttttgaaataaggaaagtgatttttttccatggtcccttctgtcagtaagctcattttccaaacttgtaatatgacacatatgccaaatatagaagcataaagggtaacttcaaaatctgccctcaatgtttgagtacagagacttgccccacccctgctcatcagagactccatgggagtcagtatctttatctcttgccagaataacagagatccagtcatggcatacaaatttggaaatgaaactgtaagtattaattgtaagtggacctttgagcaatacagggattatgggcacctgccctccacatagtcaaaaatccacatgtaacttcagactccccaaaaactcagctactaagagcctactgctgaccagagccttaccaataacataaaagcaattaacatatattttgtatatgtactatatacaatattcttacaataaagctagagaaaataaaatcttattaagaaaatcaaaagaagagaacatatatttactattcattaactggaagtggatcatcaaaaatgtcatcatccttgttgtctttacattgagtcagttgagaaagtggaggaagaggataggttggccttgctgtctcaggggtgacagatatagaagaaaagccacataaagtgaacccatctggttcaaacctattgttcaaggatcaactgtacaatcatactagtaagtccacagaaaactgttggcataataaaattaacgccttctcatggccttagaaatcctgtcatgatcaaatttcttcaaaattcttagattccataaaaatatatattaaataaaagttacagcttatacatttagaaaaacaaaatttgacaaatactttgacaattatctaataatgttcttattaccattcctagagattaacctaatatgaagcatcagcccctttgaagtagtcccctcagtcatgccagtttctgtaagaaactagaaacttattgctcaataaattactatgtgtagggaaaaaggtcagtgttattttataattctttctgtgctttggagtcataatataataaaccaaattgagtatatggccctaaaataaataatgaactagagcacctaatttcttcttcctcagaggaaaggctttgttgtcacaaagttaattgaattcttatctttgagtctattttttctctatgttctttattaactgacctcttttctccttcttttcttcctctgccttgccctcgttttcttatccctaactgcttttattattagaaactaaaagtctgtcagtctcttaaattaaatacattaactacttacatgccaaatgtttacaccagttttatcataagaaattcaagagtgtctcatttattaatcacgactaatgtttgatttctctgctgtagcagtaaattatttattatctatatttgtgccaactatgtatcttagtatctgacaaaagtaaacacttgaagtgagattaagactattaattcaacaaaagtctacagtatcaatggattatataggatgctataagctctgtactgttcctgcaaccaccttttaaaaaaatgaatagagaatttttttttaaatctttgagagaataatcctgaattctgttatttcatattgtctacagaaatttaattactgccacaaaatgttttcttccttttgcaaaccagctcatagttcatataatgactctcctggatgagtcatctgcaggaagtacaaggttttttttttgaatctgctaaggtaaagactttgaagtataaagttaaaagctgcacagctggaagcattctgggaaagaactttaaaagtgactgaaaccactggtattcacttatattttaacccagctacacattagaatcatgtggggagcttttaaaaaatataaatgtgagagccccagttcaaatcaactgaatgacaatctctgggtttagacctaggcacaggaattatttcagagccccccaggtaaacaacatatgcagctaggattcaaaaccactggccaagtctttatcattattaagatagattaaaacaataaggcatcatttagcactactaacgctttattcttaaagaaatgccatttaactacatgcaaaccttaaattatctactattccaatgtttaagtccaatactcaacaaagagtagatgctccacaatcagtgactggtgatactgatatattaacaaccaatttacaatcattaccttactttagaaggacaatcaaactattctggtgcagaacatattattttgacatttttcaatagttccagcttcacatcttctgaaacaactgatgatccagtcaaatacctaacagcttgcagattacaaggtgatgagacacatggccttgagatgaacgattggtgcatttcagacagaagaacaaattgatcaaggtcatggtatacagacagtagaaacgcagaatcctatagaatagaattctatagaacatcaaatggtgtaacagagacacacaggagtagttggaagaggagagaaaagctaagattcttcacagattaagaagctctctgaataacagacgaagaaacttagatgatgatctacaggcaacagagagtcactggaggttttctaaaaggagtgacttggtgttctacttcctggaagatggagtagatacaatttttcctattcctctcactaagtacaaataaaagtgctacacattacatataaaacaagcctaagaagtctgtgaacggtagagaaaggaacacagactgactaggggcctcaggacctaagattaagtttcccttgagttttctttttgcctaattacatctcagacttgcagctgtaaaaccggcaacctggaaataacaataggagaagacaaaaataaagccccaacaaaagccgccagtcaaaagaccaggaaggagcagtccagcaagaaaaaaaactttagacaaaaaaagtgctactctagcccaaaatacacaaaacactggcctcaccctcacccatgccagaaggtcaagtggagggcctagactttcattcttgaaagtctgtaaggaggcatataacacccctcaggagtgtgaagtgagagaaagccaagtagggatccaacacattcatctagtaatgatctcccacctccaacatcccccatccctgttgtgtgagtggagcccagtggagcccacaaggggcgctgttagaatgatctgacaatgattttaaagcagccatgatgaaaatgcttccacaaggaattatgaacatgtttaaaacaaaaaaaaagaaaccctcactaagaaaacagacaatcttggcaaacaaacagaaaatataagtgaaccaaatggaaactttagaaccaaaaaatacaataattaaataaaagtgcagtaaatgggataaaaagcagaatgagggcacaaacaaaggaaatcaataaaatagaatatagtagaagttgcatgataatatcaagaacacaggtggaagaacaaatgaacagatcctcaaggaccagtgagactatatgaaagatcaaacatttgtttcactggagtcccagaagcagaggagaaagggaggggaggactgaaaaagtacttgaagaaattaagggctaaaaacttccccaatttggcaaagaacccaaacataaagaaggtgaatgaagcggaaagaggagggacacacacaaaaaaaatctgtgccaagttacaccctaattaaacttttgaaaactaaggacaaagaaagcattcagaaaataaatggaatcttatctacaagagaaaacaaaaataattcaaatgaaagcagattgctcatcaaaagccaccaaatgaagtggctcatgatgggggctcaagcaggaagattgctcgggccagttcaacaccagtcttggcaatatagcaagactctcatctttaaaaaaaaaatttagggccgggcacagtggctcacgcatgtaatcccagcactttgggaggccaaggcaggcagatcacgaggtcaggagatcgagaccatcctggctaacacggtgaaaccctgtctctactaaaaatacaaaaaattagtcaggcatggtggcgggtacctgtagtcccagctactggagaggctgaggcaggagaatggcatgaacccaggaggcggagcctgcagtgagctgagatcatgccattgcactccagcctgggtgaaagagcgagacattgtctcataaaaaaaaaaaaaaaaaaattaagaacaggcaggaaggcctagagggagcaattgagcaagaggaagaaataagaggcatatatgtaagaaaagaagtcaaattatctgttttcattataatatgattgtatacctagaaaacactaaagccttcatcaaaaggctcctagaactgataaatgggctcagtagagtctcaggatacaaaatcaatgtacaaaaatcagtagcacttctatatgccaataacattccaggtgagagccacatcaaaaatactatcccatttacaatagccacacacacacaaataaaatacctaggaatacatctaaccaaggaggtaaaagatccctacaaaaagaactacaaaacactacttaaacaagttatagagaactaatggaaaaacattacatgttcatgaattggaagaatcaacatcattaaaatggccatactgcccaaagcaatctacagatttaatgcaattcctatcaaacaaccaatgtcatttttcacagaattagaaaaaactattctaaaattcatctggaaccaaaaaacgacccaagtacccaaagcaattctaagcaaaaagaacaaagccagaggtattacattactcaacttcaaacaatactataaggctacagtaaccaacacagcatggtactggtacaaaaacagacacatggacaaatggaacagaaaagtgaaccccaaaataaagacaaacctcagccatctgctcttcaacaatacaagcaatgggaaaggactccctattcaaataaatggtgctgggataattggctagccacgtgcagaagaatgaaaccggacagtaccttttaccacatacaaaaattaactcaagatgaattaaagacttaaatgtaagacctaaaagcatagaaatcctaaaagaaaacctaggaaataccattctagacatcagccttggcaaacaattcatgactaagtcctaaaaagcaagtgcaacaaaaacaaaaattgacaagtggtacctaattaaactaaagagcttctgcacagcaaaagaaactatcaacacagtaaacagacaacctacaaaatggaagaaaacattcacaaattatgtatctgacaaaggtctaatatccagaatctataaggaacttaatcaattcaacaagcaaaaaacaaccctattaaaaagtgggcaatagacatgaacagacatacaagcagccaacaaacttgaaaaaaatgctcaatatcactagtcatcagagaaatgcaaacatacctgtcagaatggctattattaaaaagtcaaaaaaaatgacagatgctggcaaggctgcagagaaagggaaacatttatatactgttagtgggaatgtaaactggttcagccagtggggaaagcagtttggagatttctcaaataacttaaaacaggactaccattcgacccagcaatcccattactgggtatatatccaaaagaaaataaattgttctaccaaaaagacacatgcacttttatgttcattgcaacactattcacaatagcaaagacatggaatcaatctaggcacccatcaatggtggactggataaagaaaatgtggtacaaatgtaccatggaatactatgtagccataaaaaagaaggaaatcaagtcctttgcagcaatatggatgcagctagaggacatcatcgtaagtgaattaacaaagaaacagaaaaccaaataccgcatgttctcacttgtaagtgggagctaaactacgggtacacatggacataaagataacaagagacactggggctactagaggggagagggtgggtgggggctaagggctgaaaaacaacctattgggtactttactcactacctgggtgacaggaccattcataccctaacttcagcatcatgcactacacccatgtaacaaactacatatgtaccccatgaatctaaaataaaagtttaaattattaaaaatatatatatatgtgtgtgtatatatatatatatatacacacacacacacacacacaaatgaggtggtgtacacttgtatcctagctacttgggaggctccagcaggagcctcactaagcccaggaccttggggctgcagtgagctatgatcttgccactacattacagcctgggtgacagtacaagattctgtctctaaatctctaaaaaactgaatgaattaattaatttttaaataaaacaaaaccagctggatgtagtggctcacacctgtaatcccagcactttgtgaggccaaggcaggtgaattgcttgagatcaggagttcaaaaccagcctggccaacatggtgaaaccccgtctcttactaaaaatacaaaaaattagccaggcatgatggcccacgcctgtagtcctagctactcgggaggctgagacaggagaatcacttgaacccaagaggtggaggctgcagtgagccgagatcacaccactgcactacagcctgggagatacagtgagactctgtctcaaaaaaaacaaaccaacaaaaaaaaaaaacatggaggccagaagggagtggtacaatatttttcaagtgatgaagcaagactatcaacccagaatcctctactcagtaaaaatatattataggctagagggagaaatcaaaacattctcaaatgaagaaaaactaagcaaaactttttccaacatacatacctcaaaagaatggctaaaagaaattttctaaatagaaagataatggtaaaagaggaaaccacagaaaagcgggaacaaacaaaaaaaggtagttaagcaaaaatatgggaaaatacaataggcttcctttgtcttgagttgtctaaattatgtttgacacctgaagcaaggatatagctgtctgacatgattctaaatgtgtgtacaggaaacactgtaagatgattatattacaaatggggtaaagagccataaaggaggtaagacttctacacttcactcaaactggttaaatgatgacaacagtagactgtaataaattatgtatatacaattaatagctagagcaaccaccaaaaaagatacacaaagagatacactcaaaaacgaaacacatgaatcaaaatagaattctaacatcgcttgctgggtatggtggctcatgcctgtaatccagcattttgggaggttaaggcaggagtattgcttccgtccaggagtttgagaccagcctgggcaacacagcatgttggcaacatagcaagaccctgtctctacaaaatatttttaaaaattagccagatgagctgggcacgttggctcacgcctgtaatcccagcactttaggaggctgaggcggacggatcatgaggttaggagttccgagaccagcctggccaatatggtgaaaccctgtctctattgaaaatacaaaaattagccaggtgtggtggcacatgcctgtagtcccagctactcaggaggctaaggcagaagaatcacttgaacccgggagagggaggttgcagtgagccgagattgtgccacagcactttagcctgggcgacagagtgagactctgtctcaaaaaaaaaaaaaaaaaaaaaaaaaaagtagccagatatggtggcacacacctatggtcctagctacttagggggagctgaggtgggaggatcactcaagcccagaggctgcagtgagctgtgatggcaccagtgcactccagcctgggcaacagagtgagaccctgtctcaaaaaaataaaatatgctcaaataacccataaaaagggaggaaaaagaaaacagacaaaagagaaacagggatgaacagaaaataaaatggcagacgtaagccctaacatagcaacaactacagtaaatatattactctaaatatattcattaaaaaacatgttaatagagtagattaaaaaacatcacccaactaattgctccctacaagaaactcacttcaaatatactaaaaaggcaacctcaaagtaaaaggatggaaaaaataaatcatgtaaacattaaccaggctgggcacagtggctcacgcctataatcgcaacactttgggtggccaaggcgggcggaccacaaggtcaggagttcgagaccagcctggtcaatgtgtcgaaaccccgtctctactaaaaacacaaaaattagctgggtgtggtggcgtgcgcctgtaatcccagatactcaggaggctgaggcaggagaattgcttgaacacaagaggcagaggttgcagtgagccaagatcatgccactgcactgcggcctgggtgatagagtgagactccatctcaaaaaaaaaaaaaaaaaaaaaaaattaaccaaagaaaagtgagaatggctataccagagatagagatgtacattttataatgataaaagggccaattcatcaagaagacatagcaatcctaaatgtgtacgcaccaaataacaaagctgaaaaatatgtgaagcaaaaactaaagaactaaaaagacaaatgcacagttataactgcagatatctcttcagtatctctcgctctctttctctctctctcaagtgtttatcacacaagtgtctatcgaacaactacacagaaaatcaacaaggatacagaagaactcaacactacatcaaccaaccagatctaatcaacatttataaaacagtctaccacaaaacaggagaatataaatttctccccaaatgcacatggatcacagactaagatagatcaaaccaagatagacctgagcaataaagcaaatctcaacaaatttaaaataacaaaatcatacagaatctcttctccgaccaatatggactcaaactagaaatcaataacagaaagataaaagaacaatcttcaaccacttagtaaccaagtaacatttctaaaaaatctcatgagaaggtggcagagtgaaagtaggttaatggtaaaaacttgttggaaagatctactcagcagtctgaccaaatccaactttgaggagtttatgaaataggaattattctcccattatatatattttttatttttttctctgctttgtccatgttgaggatggtctcccactttcagattccacttgggcacatattcttttattacctacccaggtaatatttataactacaatagtggtgaaggctgggcacatatttttaaagtattaattttactgatttttctaattgacaaataattgtacatattcacgtagtacatagtaatgttttgatatataatgcatgctgatcagatcagggtagttttttttttttaattccaactttgtttacattatataagaccattttatctaataaaagcctaagtctagatgctgtatgagggataagcatattaaaaaataaataaatgaagcataagttcttataacatttacaaaaatctagaaaactcagctttagaagatggaagctgcccaaatattttgtttgtttttgtttttgtttttgttttaagagacagggtctttcttgctctgtcacccaggcaggaatgcagtggcaccttcttagttaactgcagcctagaactctttgtctcacacaatccctcccacatcagctcctaagtagctaggactacaggcatgtaccaccacacctggctaatttgttaaattttttttttttctttttttgtagagacaagatctcgttatgttgcctaggcaggtcttgaagtcctaggctcaagggatcctcctgccttggtctcccaaagggctagggttataggcatgaaccaccgtgcctgattaaaggatgttatttctgacaatattatttaggatggtaaataattagcaatgacttaaatgtacagcagatacaggaataaacagaaatttacactacctaagagccaaacaggaagtctcaaggaaaataaaaaaatacattgaactgaatgaaaaatgaaactacaatatatccaaatatatggaacatagctaaggcaatgctgaagggaaatttatagcactaaatgcatacattagaaaagagaaaaaatctcaaaccaataatttaagctcccatctcaagagcaaaataaacccaaagcaagcagaagggggaaaaaaggcaaagaaaaacagagacgacacagattaccagtatctggaatgcaacagagatctcatggcagactctgcagacagcaaaatagagtactatgaacacctctacacatttttagactaaatgggccacttcctcaaactatcacaacccatctaatataaaatagataatttgaatagttctttagttatcaagtaaaataaattcacagtttataaaactcaaaaagaaaaaagaaaaaaagaaatctccaagcccaggtggagaagtcaacaaaatactttaaaaggaattaacaccaattctacaccagatacagaagaggaggaaacactttccatttcattttaagttagtattaccctgatgccaaaactaggcaaagacatgaatataaacctaagaatcctaaactaaatattagcaaatagtattcagcaatatacagcaagattatacaaagtaatcaaggggggtttattgcagggatggcaagttgattgaatattagaaaatcatgtcaacaagctaaaggaggtaacaatcacataatcatgaactcttgcaaaaaaaaaagcaataggcaaaattcagtacctaagaaacctcttagaaaaatatgaataaaggagacttcatcaacttgatgaagagtttgcattaaaaacttaaagctaatattatactcaattgtgaaagactgaatactttttcctaagataaagaatatggcagccaggcacagtggctcagacttataatctcagcactttgggaggccaaggtaggaaaattgctttagcccaggagttcaagaccaacctggtcaacgtagggaaaccctgtctgtacaaaaaaaaaaaaagaacaaaaaaattagctgggtgtggtggtgcccacctgtggtcctagctactcaggaggctgaggtggaaggatcacttgagcccaggaggtcaaggctgcactgagccatgatcgcatcactgcactccagcctgggtgacagagtgagatcccgtctttaagaaaaaaaaaaaaaaaaaaagcatggcaagtatgtctactttcaccaatcttttcagtacagttttggaagttctaatcagtgcaataacaaggaaaggaaataaaaggcatacagattaaaaaaaaaaaaaaaaagaagactacccctatttgcaaataattgcctatgtaggaaatcccaagaaatctagcaaaaattcctagaactagtgagttctgtatggctgcaggatataagacaaacatataaaaccctattgtatttctacatactagcaacgaacatatgaacaatgaaatttaaaaaacaataccatttataatcactccaaaaaattaaatacttagttataaatctaacaaaacatgtataatacttgtatgctggaaactacaaaatactgatgagagaaatcaaagagctataaaacattgagagacataacatgttcatggatttgcagactcactatagaaacgtgtcaattctctctgaatttatatgagttaaatgcaattcctagcataattctatcaaaattctttgtaaatacagaaaaaaattatcctaaaagttacgtacagaggcaaaaaaagaatacctaaaacaattttggaaaataatgcagtagaaggaatcagttaacccaataaatgaataaaacagaagagagaactcagaaatagaaacacacaaatatgcccaactgctttttgacaaaggtacaaaaacaactcgatggagaaagactgcctttcctacaaatggtggtagagcaactgaatatccacaggcaaaaaaaaaaaaaaagaaccttgacctaagtctcacaccttacacaaaatcgatcatggacttaaatgaaaagtgaaaaactgtaaaacttttagaataaaagtcttctaaaattttcaggatctagagctgaaatttcatcaaaattaaaaatatttgctctgtgaacaacatgttaaaacaatgaaaagacaagctacagagtggaataaattacttaacaaaccacatattcaataaagaactagtttctagaatacatagagaaggcttgaaacccaacagttaaaaaaaaaatccaaatagaaaatgggcagaagggcagaagtcacaaacagacaactcatcaaagaggatataccgatgacaagcacatgaaaagatgttcaacatcatcagccaccaggaaaatgcaaattaaaaccacggtgagacatcactacaaacttatcacaatggctaaaataaaaacagtgaagaaccaaattgcaaaaacactggatcactcattgtattattctcctagagcaatcataacaaaatactacagactgggtagtttaaacagcaaaatgtcttttcttacagttccggaggttagaagtccacgattaaggtgtcagcaggtttggtttcttctgaggcctcttactttggcttgcaggtactgccttttctctgtgccctttcatggtctttcctttgtgtgcacatatccctggtgtctgtgtgtccaaatttcttcttttaaggacaccagtcagatggattaggggccactctaaagacccaatttcaactaaaatcactttttaaaagacctgtttccaaatacaatcacactctgaggtactaggggttagagcttcacacaacctatgaaatttgtggggatataattccacctttaacattcatatagttagtggcaatttaaaatattaacagtacagacactatgggagacagtttggtaatctctttaaaaacctaaacattcaactaccatacatcttggcaactgcacacttaggcattcattccagagaaatgaagactcatgttcacacaaaaacctatacatgaacatttacagcagctttactcctaagagtcaaaagctagaaacagcctagatatccttcaatgggtgaataaactgtggtacatccataccacagaatactactcagtaattaaaaaggaactatggaaacagagtaacctgtgtatgaatctccagtgaattatgctgaattaaaaaaaccaatcccaaaaatatatatacaataagatcccatttatatagcactcttgaaatgacaaaactatagaaattggagaataatggctgccaggtattaaggaggaagcagtgggtgagaaggaactgggtgtggccacagaaagaaactctttatatcttgctacacatgggtgggaaacttacccgaaacctcttttgtactttctaatatttgaatgctgtgttctaaaataaagtacaagaataacaatggtcacataggggtggatgaagatttattagttaccatatgtggaatgattaaggagggccaggttctgtctaatccagacctgtccttgctccaacaccagtgcttccaatcaccagtctatgctcaatgtttaaatgtcacccaaagcaacaactgcagtgtccagcatgatcctgcacaagagatgcactatagactgaatgtttgtgtcctcccccacaaaatcatacgttaaaattctaacatctaatgtgaaggtattaggagatgaagcctttggtaggtgattagttcatcagggcagagacctaatcaatgagattagtatccttataaaagaaatctggagagttcccttgccctttttcccatatgaagacacagcaagaagatggtcaactacaaaccaagaagctggccctcaccagatacaaaatctgccgtgcttggatcctagatttcccagcctccaaaactgtaagaaataaatttttgttgctcataagccacccagaatatggtattctgttatagcaccctgaatggactaagaccagatgtaaattataaaattctctgtcctatcaacattcttatttccacagtatctgatgtcagcaaagtattacagagaagagcaataatttgcttaaatgattcacactaaggtatgagtaactgataggcttaaatattctctcaaggttcaaaagcagtttagctcaaatgacattttaacagaaactgttatgttcagaacagaattaaactgtagtccaagtgctatcacctgcttaattcagaggccctaatgcatccactcactctatttctaatcttggagttcttaggtattttgaaagtaaatgggatataaatcctaaattataaagtagtagtggcttacgcctcaccataactcaagaagcattatctggttagctgcctgtcctactaggagaaatctgtggtattgagctttcatctggctgtgagtaaaggtaattcaagatctagtaaaaactataaaaatcgctgtttgtcttctgagctgcctgtaagctctcttttctcttgtcttaagttctctatagtatccttcctatctgctgcctcaggagtccaccatcttccaccttcctctatcaaaacagaaaaagatttaaacaaggactgaactgtctttttaaatgcttgtcttgcacttcgaggcagctaagaggtatttttaccttttggtttgacttggttaaattgaggaagtaggggctttgctttttattttgctgggtccactagaaaaattgttttagtacagataccacacctgggagaatctggcccaaaaagttaataggtgacttgacctctcttttgtccctgccaccttttaaacttaattattcagaacccaagactcaagctgcaaagatccagatgttattttcatagtgtctcctttcctctcctggtttgatacccctttctttctttcagtgtggtgaccatttttgcatatcttcctcccttccaacccccaggaatctgttctccatcccaaagttcatacagcctccatcctgtgagaagtaaatgaattataaaagtctggggagaagagaggcataaaatacataggtggctaggctgacctcacagacttccaaacataaaactcaaacatgggaaaagagcaaaggaccaccaccactactacccccatccagctgacaaaaagtaaggttcaacacttttgttttttagtgtttgtgtcttaaaataaatcaccagtacttcttaaaactatcatttaaaacaaacaaacaaaaaaaaaacacctctgagaaactgtcagaggagactaaggagaaatgacaactaaatgcaatcttgttttctagatggttcctgaaacagaaaagaactttaatggaaaccctggtgatatccaaagcaagtctccagttaacagtaacatactgatgctggtttcttagttttgacaaatgaaccacagtaggatactgttagtggaaactgaaactgggtgaggtgtatattgggacgttgtactatttggcaactgttctgcaaatccaaaattattctaaaacaaaaagtatatttaaaaatagaaaagatgaaagcttttaatgtaattttccaagaagtaaaaaaagtaaggtacagaacactatgtgatacagaagcagcaatataggaataggtactgaagtatcgtttgtataaaaaggatgggaaatcatatgcatatatataaaatatttctgaaagaatacataagaatctgatgacactgactttgtggaggagagaactcagcagctgagtaggaatgaaaggaagaatttgtaatgtgtcctcttacaccttttaaattttgaggccaggcacagtggctcacacctgtaaccccagcactttagaaggctgaagcaagcggatctgcttgagctcaggagtttgagaccagcctgggcaacatggcataaaccctgagtctataaaaaatacaaaaattaaccaggtgtggtggcatgcacctatagtcccagctactcaggaggctgaggcaggaggatcacctgagcccagaaggttgaggctgcagagaaccctgactgtaccactgcacttcagcctgggtggcagagtgagaccttgtctcgaaaaaaaaataaaataataaaaaataaaatttgaaacatattaatgtattatctattcaaaaaataattaacttttaaaataaaaaggatgaccaggaactgaactaagacaaagactatggaaataatgtagaggattaatgagaaaaaaaatttaggagctaaaaaagaaaacctaatctactccatctatccattaaggctttctacaaccccttcctcactttttccaccaacctcctttctccttaacgcactacagactttttattctagctgaaccaatctgactgctaattccaaagagtcaccagccatttttcctcaaatccacatctctccctgcaaaacctaactttaaacttaaaagccacccacctatgtgctatttagcattctgaatattctgtctacaccagggacagcaaatacaggcactaacgccatcactactcctactcataacaataaacactgctcaatgatcacagtatcctttcccactaatccagaagctgcgtccaactaacttctcaatgcagtcttccaggcagtcttcactatcaatcaaagctagcccatgaaataaaacctacttgccatatctagtccccactatattaatctgtttgcctcgatatatttgccatgaattttaggtatatttacatgcatatctcactttaatacactttattgtgctttgcagatattgtatttttcatagattgaaggttggtgataatcctaagtggagcaagtttgtcagctcatttttccaacagcatgtgttcattttgtgtttctgtgtcacattttggtaattctcacaacatttcaagctttttcattattattatatctgttatggtgatctgtgatcagtgatctttgatgttactactgtaattgtttgggggcaccatgaatcaaacccatataagatggcgaacttaatcaatacatattgtgtgtattctgactgctccgctgactggggcttctcctgtctctctccttctcctcaggcctctctatcccaggagacacaataatactgaaattaggccaatcaataatcctacaatggcctctaaatattaaagtgaaaggaggagtcacatttctcactttaaatgaaaagctagaaatgattaagcttactcaggaaggtatgtctaaagacaacagaggtcaaaagctaggtctcttgtgacagttagtcaagctgtaaatgcaaaggaaaagttattgaaggaaagtaaaagtgccactccagaaaacatacgaatgataagaaagtgaaacagccacattgttaatatggagaaaggtccagtggtctggatagaagaccaaaccagccataacattcccttaagccaaagcctaattcagagcaagacactagttctagtccattctatgaaggctgagaggtgaggaagctccagaaggcaagtttgaagctagtaggagttggttcatgaggtttaacgaaagaagccatctccataacataaatgtgcaagatgaagcagcaagtgctgatgtagaagctgcagtatgttatcaaaaaaatctagctaagataattgatgaaggtggctacattaaacaacagattttcaatgtagatgaaacagccttctattagacaaagatgtcatctaggactttcatagcaagagagaagtaaatggcttcaaaatttcaaaggacaggctaactctcttgttaggggctaatgcagctggtgaccttaagtgaaagccgatgctcgtttaccattctgaactgactgaaatctactcagtctgttctctataaatggaataacaaagcctggataacagcatatgtgcttacagcatggtttactgaatcttttaagcctactattaagacctgctgctcagacaaaaaaaaaaaaagattcctttcaaaatattgctgctcattggcaatgcacctggtcatccaagaactctgatggagatgtacaaggagattaatgtttccatacctgctgacacaaaagtcattctgtagcccacagatcaaggagtaagtttgactttcaagtcttattattttagaaatacatttcaaaggctatagctgccatagatagtgatttctctgatggatttgggcaaagtaaattgagaacattctagaaaagattcatcaatctagactccattaagaacatttgtgattcatgggaggaggtcaaaatatactgacatgaataggagtttggaagaagttgatcccaacttccatagataactttaaggggttcaaaatttcagtgtaggaagtaactgcagatgtggtagaaataacaacagaactagaattagaagtggagcctgaagatgtgactgaattgctgcaatctcaagataaaactttaacagatggggccgggcacggtgtcttacgcctgtaatcccagcactttgggaggccaaggcaggcagatcacgaggtcaggagatcgagaccaacctggctaacacggtgaaaccccatctctactcaaaatacaaaaaatgagccgggcatggtggcaggagcctgtagtcccagctactcgggaagctgagacaggagaatcacttgaacccgggaggcagaggttgcagtgagctgagatcctgccactgaactccagcctaggcgacagagcgagactccacctcaaaaaaaaaaaaaaaaaaactgacagatgagcagtcacttcttacagaggagcaaagcaagtagtttcttgagatggaatctactcctagtgaacgtgccataaacattgttcaaatgacaacaaaggatttagaatgttacataaacttagttgataaagcagtggcagggtttgagaggactgactcaaattgtgaaagttctactatggctcaaacgctaccacccagcatctcatgccacagagaaatctttcatgagaagaagagtccatcaatgtggcatacttcactggtgggttgttgtttttttttcaattttatttaaaatcaggacacatctcattctatgtcatagaatgagggagtctatcttgaacctattctggttcagggggctgcccttatgaaaaaaaaagaaaaaggcaagaaagtaattaccatagctaccccaaacttcaagcaacaaccatcctgatcagtagctataaacactaaggtaagaccttccaccagcaaaaagattacaactcacttaggctcagaggatccgtagcactgttaagcaataaagtatttttaaatgaagatatacgtagatcattttttagacataattctatcacacattttgtaaactacagtgtgaacataacttttatatgcactgagaaacagaaaatcgtgtgacttgctttattgagatatttgctttactgtggtggtctgaaactgaactggcaatatcttagaggtatgcctacatttgtatataccccattttgttctgcaaaggattaaagacacaataaatgaactataacaagttaacaaactaaagataaaggcaaagaatagagaaaagaaccaaaaatggtgccaagaaaaaggctaaaaattgtataatataaaaacctatttacggtatggagtgggccacaaatctagttctggctttctagtagccataacaaaaaggaaaacccaggcaatctaagagatacacagagaagtactcagaaggggagctaccttggtagttaaaccaaacagtaatttcgtatagcaaaaagaaccccatagaatgatcaaaatataggagacacataaccaccagtcttcaaagggttagatgtttctcatattgtccctcaggagagacctatgacaccttaccaaagcccaatgtggcaaaattgattttacaaagacaagacacaagctttaagagctctttattcttttactcagtttcttccttcattgcctccctaatcagattataaactccttgaaaacagaaccatgttttctaattcttatatatagctccaaagtattttgtattctgcagaaaagatgcaacgtcagtgagaatttacacagtgcaattcaagacttttctgataaaaattatctaacctaaactcagtaattcccacttctactacaaaaacatgctaactgaagccccaatagatagaattcctaaactttctaaactattactgaatcacaattcatgacctctcaaaagcattttgtttcatacatccctagcacaaagcatgcaaggataccaaatcaatatcactgaacctgatcaaataaaatgaaactcataagcaaaagctctggcaatacccactaaaggaaagacaatattactatctttcaagaatataatcaataggtctttacaaaccaattgacaaaggcaggttcattttctaaatgattctgcaaatctactagaaggcaattaaattataacgcagattacttctttccaagaatgtgcagtttctgcatatgccaagctgctgaagaactgtacttctcagctctcacacacacatgcacacgcacgtgcatgcatgcacacacacacacaccactatcaaaccagctctgaccactaacttacaatttacttctgtgctttacctggtcaaactgaaaatgaaattaggagtaggtaataaattatttagataaggtgattatgggaaaatgaagtatcatcttaaattactactcttaagcactggcattgggacacattaacaatcctctatttgtattttattaatggaagtcattaataaataagtagtctcatccaacactggcttagttcattcatacacttagtatttcagtttatagtaggttccccccttggtattccctgtacataggggcatgccctatcatcccaggagtgaatacttgtaatgagccaaagaatattcccaggactgggggagtccaccaagtagaccttggaaaatccaattcctgcacctttgtttctttatctattagaaagggaaatggaaatcatctctatctgataggattattggaaagattaaatgagataaggttgtaaagtgcctagtgttagttctctagctttttgtttgtttgtttttgagacagagtctcactctgtcgcccaggctggagtgcagtggcgcgatctcggctcactgcaacctccacctcccgggttcaagcaattctctgcctcagcctcctgagtagctgggattacaggtgcccccacgacacccgactaatttttgtatttttagtagagacggggtttcaccatcttggccaggctggtcttgaactcctgacctcgtgatccacctgcctcagcctctcaaagtgctgggattacaggtgtgagccaccgcacccagccttagttctctagcttttttataggtaaggaaaacagaaggatctaagcacttaggcgactcatccacagccaatggctaataaacataggacagaacaaaacttctgacttagggcttaatgttctttccacctcaccaagcagccttaaattaatagaactcaacatctcaggtttgtcactgttgggtattcactacatgcaaagaaaaaaaaaattgactattttgaacatctattacatgctagaaactaatgtctttcttcataactgccctataagtgttatctcatgttactaagaaattaacttgtccacagtcacaaggctaacaagtgacaacacaagattcatccagatctgtttagtcaatgattttacctaccatccttcttaaagagtgtatttagataccattgtctaccagaatcaaatcccaaatggcctgtgaatttttatagatacttgtgatttattagtggaaactgtccctagctccaccatcctatctacttaaaaatttgttcctattaggttaaaacataattataataactgtagtaacaaatttacatttgtatagcatgttacagttcattacatttttttcatttttgttagatgcaactactgagccttttcatatattagctcacatatcatttaatatttcaagactcttatgaggtaggagttattgtcatttgacaaataagaaaacgggccaggtgcaatggctcatgttaagaaggccaacgtaggcagattgcttgagctcaggagtttgagaccagccttggcaacattgagaaacttcatctctacaaaaaatgcaaaaattagctgggcatggtggcacatgcctgtactctcagccacctgggaggctgaggtgggtgaatgacttgagcccaggcagttgaggttgcagtgaggtgtgatcacaccactgcacttcagcctgggccacagagtgagaccctgtctcaaaagaaaaaaaaaaattagaaaggtcatctcagatctctctctgcccccacagttgtcagatgatttctagtaaacgtttaaagggcagatattttaaactgttccagagcacagaaaaaagtgaaaagtttcctaatcattcttaatcctgacttcatcttgacaccgaagccaggcatggatagcaaacttaaatgaaaacataatattagatttatcctttgtaattacagatggaaaagtttaacatatttaagtgaaaaacaaaggaatatgtgtagtataatcccatttgtaaaagaaaaaacattatgaaaagaaacatgtctgtatgtatggtaaaatatggaaatgtgtatttatagataaatacacacataaatgcaaagatacaggtttggaaatataaacctcaaactgtcaacagcagtttctccaagatggaagtggtcttaggagtgaagaaggggaaaaagacaaaaagtgaagggagattttcagcttttactctctctatatatatacacatacatactattcaaattctgaaacagtgggttctaggatcggctatgctattaagaagctgttactaggttgaatcactctgactctgtttccccattggaaatgtggaaagcagacctaccttattatgacagaagaaaaggaatttatttgaaaatgcgtaataaaatctgatgaatatgtggcagtgttgccacaacaccttatggtttgttattgtttggtttgattttttttatttttccctcactttgtcactaatcaaccagacattcacaaacacaatttaatttctgtatgcctcattgagtgcaggaagtagagtcagaagacctgagtttacactcagaccttgcctcttattaactgtaaggttaaaaaaacaagcaaatgattaaacaactttgcactttagtttcctggcagtaaaataggaataaacctaccttacagcatcatttaaaacattaaatgagaaaattatatacaaatggccaataaaaacatgataagatgaaatacaaatgaaaatcacaatgcgatatcacttcacagccactaggatggctatcatcaaaaagacaaacattaacaagtgttggcaaggatgtggagaaaatggaaccctcattgctacattgctataaccctacattgctagaaggaatgtaacccttctagcaatgtagaagggttaccctagaaaatggaaccctacattgctagaaggaatgtaaaacagtgcagcagctatggaaaacagtcaagcagttcctcagaaagtaaacagaattaccatataacccagcaattacacatctaggtatacatccaagaaaattgaaagcatatataccatacaaaaacttgtaaatgagtatccacaacattatttattatggccaaaaagtagaaacaacccaaatgcccatcagttgaagattggataaacaaaatgtggcatagccatataacaaaataatattctgccataaaaggaatgaaatattgatacatggtataatatgaataaaccctgaaagcattatgttaagtgaaagacactaaaggccacatattatgattctattcacatgcaatgtccaaaataggcaaatccatagagacataaagtaaattagtggttgtcaaatatggggaagggggaatagtaacaaaagctaccaggtacaaggttctttttagggtaataacgttcttggattagtgccgacatttgcataattttgtgaatatattaaaactactgaattgcatactttaaaaaagtgaattctatggcatatgaattatatctcaaagaaaactattataaaaatttaagtctctgcttttttttcttttgagacaaagtctggctgtcacccaggatggaatgcagtggtccaatcatggctcacttctctgcttgctactttttattagtaaatattctactttcctcaagaggttgctcatgttgcttgtaacagctttaaaagatctttgaagttagctactatacagatgaatggtatttttagtaaagtaaaactactataacagagaaactttctaaaaatcggattagtttggtacaatttcattttttcaaaagaaatgtcattaataccaagttcatttttagagagtggaaaagcttcaacaagtccttataaaaatacattttttaaaaaggtcaaaatgcaatactttgttttcttaattattggacatttcattttcagatatatcattagtagattacctgtttaaaatgtcattaaatgcctagcaatgaattaaaacccaagtagatgcaactttgtgacctctacttacaactttctacattctgcattctgttgtcagattcctagtccatcactagctcctaatctcttacatcaattattccattcaattcttattcacaggggctaaaatgtttggtaaatgcaatcaattcatttttctaatgctggggaaaaactagagtgggcccaatttttaaggttaaatttagtccagaatgtttgaataaatattcaacaaaacgatttcctggaatttggaacataaaaacagcctatagagttgtgaaatgctttctaggtccttggggaattttttcacgtatttagtcatggggcaaagtattacgtataaaagcttcctggtcctagaacaaagacgtattttactgctcaaagctaaaggaattagtattgttaaactaaaatagcataccaatgaaaccagctaggtattggcataacttaaccaaggtatgtaaccaaagataaattgtaccttattatgcattcttccttgggaggaaaaattctcacattaataagatttagccagccaaaacagaaaaagtatatagatatatgtgtgtctgtgtatgtaggtatgtataaggattaggattttgagtggcaatttaaatttgacggtttgccaagctatgctgggatacatagtgggcatgcttgacacaagcaaaacgtgaagtaagagacgacctgtcaaacagctgctatctagttactccctcggcagcactcccaacttctcccgcgatgtctgtgtgtaagagaaagatgtcaaagcaccaagaaaaccacgggggctgtcagagcaacagccaagtccaaaccgtgcatcccagggtgaaatcccacccgtaccctcaagagctggtcagactgcggctcttttctaatatgagtctacctaaaatagaaaaataaacacaaccacagaccctggccaaccctctctctcctcccctttgtgactctcccaaacgctggagggatgttaacctctggcaggcccgtggaagccaagccccgcgacctgaggaggcgtccaggagcctcggcgcagccctggggcctcgagcccgtgtcctccacccacccgacagggccggtcaccggtcacacaaaggagccagtcgcgggcgctggacgcgggactcgcccgagagcagggagccacatctggttcctgcacgctggcaaaagagacccgctggaaaataaggactaacgcccaaacctgttgcacaattcgggtccctttcacccagaaatgaacaagggcgctcaggaacggaaaagcgcgcggcccggtctctgcgggccgcggccgcacccggcagacggcgcggaggcaaaggcggcccgcagggctcccacctccggcgctttgtctgtggcggcaaggcggtgggggcggtcggggcgttgggagcagaggcggtggcggggcgggggcgcccctccttcactgcgtagcccctccgccccgcggcccgcgcaggggaagaaagccgggcccgctaccgccgccgccgccgactgcaccggcccaagccggccacccggccgcggggcctgcgcgcttctcccgcccgggccgagcggcggccacactcacctggctggcgctgacgctagcggccggcggctccggggcgttggggaagacaggggaacgctagcgaggtgcgggcggaggcggagggcgcggcgggaggaaggcgggctgggggcggagcgggcccgggcggcggcggcagcagcggcgacggctgcggctccagtcactcgcggcaaatcgcgtcccggcccctccgtgcgtcaggcggggagcgggggtgcgggtggcccggcgacctctcggcacccgcggcccgagccgcgtccgcgcgaccccgcgcgcgcccgggtgacggcggtacagcaacccgcccggcgcgggaaggaggaaggaggcggggcggggcggggcgtccaaccgggcctggggctgagggctgggcgcgagtgggactctggcgctccggacggaccctgccgtccccacccctagccgaggcccaggctccccaggcgggaggcagtcttggagagtggaagggtacctagatctggagtcagaagtctgggcttaagagagggtccgttacttgacaccctggcaggtcatttatttcctctggcctcatgctggagttcgaaggttcgagtacaaagtctccaagagctgctcccaagtactcactgccaagcggtggtgtggctgaaggatgaaggcagatgaaagggaaagggttgcggtgaggaagggctggattcagggcatttgttttgctttgaggatctttccactggacagtccaaaattaatccacaatggggctccctgataatggctacttccccatttttaccaacctagttatttttctccaagtatactgacttaagagtccttgttttcattttattgcgcaaatcatttgtatgtcatttcctgaattcagttcaaaagagtcatcagcaaattcacaccagatcagagcagctgtgtggtcccaatttcaagacttccatattattcactcagc

SEQ ID NO: 547 - DNA, 34068 bp, Homo sapiens
atgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactctt

SEQ ID NO: 548 - DNA, 34187 bp, Homo sapiens
gctcaaagattaacaggtaaaccaaacattaaattgaggataaaatgacgaaacataggctttaaggcaatgtggaaaaccgtgtaacattttaaagggaagctcctttttcttttgagatagggtctcactccgttgcacaggctaaagtgcagtggtgtgatctcagctcgctgcagcctctacctcccaggctcaagcaatgctcctgctcagcttcccaagtggctgtgatgactggaacgtgccgcatgtccggctaatttcttttctattttttgtagaaatggagtttccccatgttgcccaggctgacctcaaactcctggattcaagagatctcctgcctcagcctcccaaagtgctgggattataggtgtgagccatcatgcctggccagggtagctcttttcaacacttaccgttcagtatctgaaagagcatcagcttcaggttgaatttccagctccaggtgtaaccagtcttggtaagttaactgagaaagagagcaagcaattcaatacaatgaggacagaacacacaatccaccgacaggtttataaaccagtttgtcatttcatctcatacgcagtcctccatgtccctgtgttataatgaaattgcagctgagagttccacaggaaagaaaccttagttttatcaagaatgatttcttacaggatttccctagcacaaagatgttagtactgtaatccttctttctaagtataaaacggctattttagtctgggcaacatagtaagacctcatctcatttaaaaattacctgggcacggtggctcatgcctgtaatcccagcactttgggaggctgaggccagcagattgcttgagcctaggagtttgacaccagcctaggcaacatggtgacaccccgtctctacaaaagatttaaaaatcagccaggtgtggtggcacatgtgtgtggtcccagcctcttgggaggctgaggcaggaggatctcttgagcccaggaggtcaaggctgcagtgagtaacagagtgagaactatctataaaaaggaaaaaaaaaaaaaagaaaaaagaaactaacaaaacaacaacattctacagctattcacagtagcataccttcatttatttttggaaacaggttctgttgcccaggctggagtgtgtgcagtggtgcaatcgtagctcgctgcagactctgcctcctgaactccagaattctccccctcagcctctcagatggctgggactgcaggtgcacatcaccatgaccagctaagttttttaaaaacatttttaggaggccgagcacggtggctcatgcctgtaatcccagcactttgggaggccgaggcaggcagatcacgaggtcagcagattgagaccatcctagctaacacggtgaaaccctgtttctactaaaaatacgaaaaaaaaaaaaaaaaagggttgggcgtggtggctcacacctgtaatcccagcactttgggaggccgaggcgggaggatgatgaggtcaggagattgagaccatcctggctaacacagtgaaaccccatctctactaaaaatacaaaaagttagctgggcgcggtggcgtgcacctgtggtcccagctacttgggaggccgagtcaggagaatcccttgaacccagaaggctgaggttgcagtgacccaagattgtgccactgcactccagcctgggcaacagaggaagattccatctccaaaaaaaaaaataataatttaaaaataataaaataatttcacaaaaggcttggcacagtggctcacacttgcaatctcaacatattggcaggccaaagcagaaggatcactttttcctatttttagtagagatggggcttcatcgtgttacccaggatggtctcaatctcctgacatctcagcctcccaaagtgctgggattataggcatgagccactgtgcccagccaccttgaaattcttttctaaagaccaaaacaaccaggcaaacatcctcagaaataaatcagtaccaaggcacactggtgagagcaatgccagctccagtaaccaggcacacatgggtgagcccagagaccctgagtgaccaccacacagcctggcagacatgtttaaaacaagttcccaggggccgagcgcagtggctcacacctgtaatcccagcactttgggaggccaaggcgggcagatcacgaggtcaggaggtcgagaccagcctaacatggtgaaaccccatctctactaaaaatacaaaacttagccaggcgtggtggtgcgcgcctgtagtcccagctacttgggaggctgaggcaggagaatcacttgaaccagagaggcagaggctgcagtgagccaagattgcgccactgtgccccagagtaagactccaccagaaaaaaaaaacaaaacaacaacaacaacaaaaaacaagttctcgggcgcaatggctcacgcctgtaattccagcattttgggaggccaaggcgtgtgggtaatttgaggccaggagtttaagaccagcctggacaacatggtgaaaccccgtctgtactaaagataccaaaattagtcgggcgtggtggcaggcgcctgtagtcccagctactggagaggctgaggcatgagaattgcttgaacccaggaggcagaggctgcagtgagccaagactgcaccactgagcacagcgagacgttgtctcaaaaaatatatcagtaaaaataaaaaaagaagttcgtgttgggagaaactgagaaagtatagcagggtttctctgtatttattaatatatttttttgagacagggtcttgctgtgtcatcctggctggaatagagtggcgtgatcttggctcactgcaacctccacctcctgggctcaagtgatttctcttgcctcagcctcccaagtagctggaaccaaaggtgcacacaactgtgcccagctaatttttgcattctttgtagagatggggtttcactatgttgcccgggctggtcttgaactcctgagttcaggtgatcaacccgccttggcctcccacagtgctgggatcacaggtgtgagcaccgtgcccagtatctgtataatttcttaagagctgcacatgaggccacaacgattttagtcaagattccaatcaaaccatctaagtgctgctgttcttgcctctgaggagacagtcggcacacgcaccctagactcgagacgaggagacagtcggcacacacacaccctagactcgggacgtggcatgatgcaggggaaggaacggtcacctacgtgctgctgttcttgcccgaggagcacacacaaaccctagactcaggacgtggcatgatgcaggagaaggaacggtcacctacgtgaacatcttcctctttcaacacctctcggaaggttctgtgtgtccagagagagagggcagctctctgccagtctgcagaaggaaggtgcaagggtctccaggaaaggctggctacgtcctcctcagaaagaggctgtcgggcctctgagaacaatctgaacatgaggaactgaaactgaaacagagagtgacccggccgtttcttcattgcgcaagtttcactgtgagtggctgagcaaatgctcaggtggaaacagaccatcaacagcccacacacacaaccccacattcagaggacctcagtccagcccctgggagggcgcaatacacgaccccacgttcaggggacctcagtccagcccctgggagggcacaacacacaaccccacgtttaggggacctcagtccagcccttgggagggcacaacacacaaccccacgttcaggggacctcagtccagcccctgggagggcacaacacacaaccccacgttcaggggacctcagtccagcccctggaagggtgcagagcccctcagcgatcatggctgtgcacagtgctccagggaagagcctatgtgcagaccttcctgccatctgactgcttccttgagctaaatgtctggaagcagaattgcaggaacaaaactgcctcccaggggtagggctggtttggtcccgggcagtgaaacagcccatctctaggcctctgccaggaatggcgttcccaccaaaaatgcacaccaactggacaagccagacacactattggtgctgcgtgaccgtgtccatctctgcccccgaggagatgagagcctcccatgtttataaccagcctgctccaaggactgtcgtccctgctcagcatgctgggtgggaaccacgctgccctctcctaagctcaaactccatgttttctttaaaaacttggcaccagggacaaagttcctcagaggaaataactggaaatacgtgcaccctggatcctcaggggctgctcccagattctgacttaatttatctggaaaggggccaggaatctatagtttcaaaagcttctcagttgattctaatgtgaagcctgaagttgaaaaccattatttatttatttttttttttttttgaggtggagtctcgctctgttgcccaggctggagtgcagtggtgcagtctcggctcactgcaacctttgcctccctggttcaagcgattctcctgcctcagcctcccaagtagctgggattacaggcgtgcgccaccacgcctggctaatttttgtatttttagtagagaccaggtttcaccatgttggccaggctggtctcgatctcttgacctcatgatctgcccgcctcggcctcccaaagtgttgggattacaggcatgagccaccacgcccagcctgaaaaccactattttatacacgagacgttcattaaaatcctataaaaggacaacactggtttgcagtgccatttcacctttacttttgacattcagggtttccaatgctcatctttaaattcctttgtctgggccgggcaccagcggctcacgcctgtaatcccagcactttgggaggccaaggcgggtggatcacttgaggtcaggagttcgaaaacagcctggccaacatggtgaaaccctatctctactaaaaaacatacaaaacaattagccgggtatggtggcacgtgcctgtaatcccagcaacttgggaagctaaggcaggagaactgcctgaacccgggaggtggaggttgcagtgggccgagatcgcaccactgcactccagcctgggcgacagagcaagactccatctcaaaaaaaaaaaaaaattcctttgtctgaacaatgtaaggaacatttactagatgagaggaataagaattcttctttccagggaaagatacttattatgaatactgatcttttaattcatctatcctataaatgccaacatctatttcattacaattacagacttgtagttgtcttcatacaacttcactttacactcagagaacacaaggaaaggcagcactcagcagtcaggctgcctaagcagacagcagaggtggccatgacagccagcctgactcaggagctgccccatgacagccagcctgacccaggagctgcccctgagatgggcacaaagcggcagcagacctcggccttccggtccgaaagctgcgtaaacctgaaacgtatggcagaatggaaaaataggaaaagagtgaacctacctttttaataaggcctggagataagcagctgcacaaagtatctcgtgactgggaagaaaacttgcagagagagtaagaaattgctgctgtacaaaatctgaaaacagaaattataacatataaatgtaatccatacaaaataagggatgaaggaaaaagttactttgaatttcataaaactgaatttagtgcattccgaactggatggcctgagcattggtccttcgttttttggttcgtttgttgtgagacagtcttgctctgccgcccaggctggagtgcagtggcaccacctgggctcactgcaatctctgcctcccgggttcaagcgagtctcctgcctcagcctcccaggtagctgggattacaggcatctcccaccatgcccagctgattctgttgtagttgttgttagtgctttttttttgagagggagtcttgctctgttgccaagccggagtagagtggtgcgatttcggctcactgcaccctccacctcccaggttcaagcaattctcctgcctcagtctcccgagtagctgggactacaggtgccagcctccatgcccagctaattttttgtatttttagtagagatggggtttcaccgtgttagcgaggatggtctcgatctcctgacttcgtgctccgcccacctcagcctcccaaaatgctgggcttacaggcatgagtcactgcaaccagtcgagtttttaattttttttagtagagacggggtttccccatgttggacaggctggtctcgaactgctgacctcaagtgatctgcccacctcagccactcaaagtgctgggattacagcgttagccaccgtgcctggcccagccctcggtttattttttgttttatacagggccttactctgatgcccaggctggagtgcagtcgcacaatcacagctcaggggatcacttaaacccagaagttcaagaccagcttgggcaacacagtgagaccccatctctcactagctgggtgtgtgggtgtgcacctgtggtctcagctactgggaggctgaggtgggaagatcacttcagcctgggggacacagtgagacctgtgtcatttactcaacatacatacctacagcaatacccatgtgaaaaattctcacttgtaaccaaggaagctcagaatgagattccatgaggcaatggagatgtcaaagcactgtcatggtgttcttacagttctaatacttctgttttactaatacatatttgagctgggcgtggaggctcacacctgtaatcctaactgaagtgggcagatcacttgaggtcaggagttcaagaccagcctggccaacatggcaaaaccccatctctactaaaaatacataaattagctgggcatggtggtgcacacctgtagtctcagctactcaggaagctgaggcacaagaactgcttgaacccgggaggcggaggttacagtgagccaagatcacgctactgcactccagcctggacgatagagtgagactctgtctcaaaacaaaaaccaaaaaccaaaaaacaaaaaaaaaaacaaaacacacaccaaatatatatttcattctccctttcttatgcaaaaagtagcatctgagaccgagttcagtattttgctttcttcacctggatatatatcctgaggcatctctgtgtttctaagagaggatggccctgtctcccccaagccacctggatgcctccctcctcaccagctcccaacttctccattggctgtgtgcctctcatgccaacacccagtactcagtgtttggggcctggggtgagtggggactgtctggtgtggccaagcgcctaggagggactctgtatccccggagtaccgagtgcctgctccccgaggcccatgtctgaggtgtgggatccgcacagctgccatctgactccctctccttgctccacgtacatttcttgcgcctcttctaagttctctgttattcagaccctgtcataatgtcagatctcccctttcccgcacagggtctccggcaccgcaacagggctctgtcccgacctgggctacctctgcccaagagaccagaagctacaagccaagccccagccagcaactcccaccagagtctcccagccctctgtcctggcttccgcctctgagtggcagctgaagggattctgtcctggcttctgcctgtgcgtggcagctgcagggagcccttgaggcactgagcagaccattcttaaccacagggtccttcctcacctcagcacatggccccatctgctgagccctagagaaacagcccgaggtgtacacactgggaagctactcaccatggggtgccgaagaacctgaccagagggagctggtccaaccaagggccagacaagggaccaagacaaaacaaagcagctctcaccaggacatcaaagaatgcttaacgatatagacagttactatctactattaatttcagcagtttagtataatatgatctcatttttatgaacaaagaaacaaacgcacgcatattataaacaaatgacagataaaattctggaaggatatataccaaaatgctaaaaagtggttatctttgggtggtatgtctgcatgtctgtctcttctaattttatcaaacgagcatgtgtcacttttcgagagagaggagagaagacgcgactgtggaagaagagctcacttcaggcagaagaacaaggaatccctcgtcctacaggtcaggaggctgtcaaagagcgcagggacaggaaggccagcaccaggtgcaggaggacccacatccacctctgggagcgcagacctggactcacccaggtgcacggccagggcagccaaccccagcacatgtggggcactcaggctcgggccctgcaacgagaatgagggtggcagagcagactgccctcttccaagctggaattttccagggcactgaagacgaattgagaagtagcagcctggccctcagagtgggcccccaagggtggcccccatgaaggagagcctcacctggtgacggagcagctggcagagccgggtgagcactgcagggagcacacgtccacacatggtcctcacgaagagggcagcccagggaccctgcctgcagagacagccgtgaaaccatcagtactagccattcagtcctgcacatccctccaacagctaatccaaccaccagcggccgaagaaagagccaagctgttccccaaaacagtggtctttctggaagacaacccatcttctgcagtgcttcccaacttctgctgcgtcctatttgatgaaactcagcatcgccgcatgctcctgcggagacgagctcatgagtccctggtctgcagacttggcccagcaagaggtggcacccagaggagccccaccactcagggagctgcccgcgccttcacctctccgggggagcgacactggaggcagccatcaggttctgacagaaagacgtcagcaggaggtccacagcctgcagagacacagttctcatgagcgtggtgtcctggggacgggagcagcaggaaggaagccggccagcgctcccgccacagacatcgcaattctgctttgcaaaaagacctccaaaacaggcttgtttggagggcatgttacaatgcaaactggtgcccagggcccccattccccaatcttgggaatagcagccctcaagtaatcgccaatcacaaaattctacagcagcaggcgggactggcaaaccttgtgtgtaaggggccagaaaaatattttaggttttggggccagaaacagcctctgtcgcatattctaaagaggcagtcgagcccaacctggtcaacatgatgaaaccctgtctttactaaaaatacaaaaattagctgggcgtagtggtgtgcacctgtaatcccagctacccaggaagctgaggcaagagaactgcttgaacccaggaggtggaggctgcagtgagccaagatcgtccactccagcctgggcaacagagaagactcagtcaaaaaaaaaaaaaaaaaaagaggccaagtgccgtggcttatgcctataatcccaacactttgggaggctgaggcagacagatcacttgacctcaggacttctagaccagtcgaggcaacacagagaaaccccaactgtacaaaaaatgcagaaattagccgggtgtggtgatgcacgcctgtagtcccagctactcgggaggctgagacaagaggatcacttgagcccaggatgtcaaagctgtagtgagccatgattgcaccactgcactccagcctgggcaacaaagcaagaccctgtctccaaaattaaataaataaataaaatgtaaaaggagctcttcatacacaaacagactgtggcagctgaccctggtacaccgctgcctggccctggaacatctgatacgacactaactgagcaagtcaaacagaaattgagagaaggctccatgcgtctaatgcctctgcctaatggaaaatggtgaagaccccctgctttgttctgagcccctacacctaccatgtgttcccgtggctccagtctcggcgtgttgatgctgagctgaatctttgatatctcaacgctgctgtcatcctcattgtggcccaggacagccctcagtctttcagaaatcactgccacctgtgccgatataactgcgaaggaagaaactagttagggatgacaagaaccccgaaaggagggatacagctgcggcctagagagctccgcctcccgtcaagtacgattccacggatcctgctgactgcacacatcccccagccaggtgctgaacaccagtgtttgttcgccccgcaggatttgcagccttgtggtgcagcatgtgtcatggcaaatggggccagacgccatccactaccttttcctgattggctgagagggggacatgttcattcaccaacatgaacctccccatctgaaatcccatgccagccctccagacaccacatctgcctaagcgcatgccagaggttccatgttggcccagggaaatgggccacacatagcccaactacatcatttaaaggtgaaaaccgctttgcttttagaaacaggactcacctgacatgtatcaacctcttgcttaagcactggaacttttcctccatgtcccccatgtaccacattctgcacaagccatcattgaatcaccggaaggctgcactcaggaactggcgcacttggtctgagtgaagaccgccaaggcgctgcagccccagctagcgctaaccaagctgtgttaacattgcctccatgcggagcttgcagtgagctgagatcacgccactgcactccagcctgggtgacagagcaagactccgtctcaaaaaaatatatatatatcacctccatgtaggccaggcacggtggctcacactgaaatcccagcactttgggaggccaacacaggtggatcacctgaggtcaggatttcaaaaccagcctggccaacatggtgaaaccccatctctactaaaaaatacaaaaaattagccagacatggaggcagtcacctgtaatcctagcaacttgggaggctgaggcgggagaattgcttgaacccaggaggcggaggttgcagtgagccgagatggcgccactgcactccagcctgggggacagagtgagactctgtctcaaaaaaaaaaaagaaaaaagaaactgcatgttctcaatccacagatgaacatttcttactctggattttacagaaaaccatcacatggaagcaggatcacagggcagagaccctgtgtgtctgatgtgacatcgactccggcaggcaggatgagcgggaaaacaggcatcctagtcacgcgttttcttctctatcatcattcgtcctactcagatgcaactagccgaatattcaccttctgccaagggtctgtgacagcttcagtaggactagccttccaccttgtctcaaaaaaggttccacacccgccagcccggggtcaatctttaaactactggactactaggaagacacaccagcctgatgtcactatggggaaaatggcccagccacagagctccaaccacaggctgcacacatgagacacagcatgagctcccatccatcctcaccatcacgctggctggggtctgtcatggaggctctcagctctcccagtgcagctgtgagctgtcccaggggctcctcagcagagttgggttctgccctcactcccagggctgcatctgtgagaagaaggaagaaaccagatggaaagacactcaacaggactcttcactgcaaaaatagaaacttcacacagtcaaatacagagctgtgaacttccaagctgctgtgtgtggcagacggagggactgggagtctctgaggaggtaaatgaggtgtcttccctgatgctggatgccacatcgaaaattacaattataaacgagtttcataaaaaattacatttataaacaagtttaagaaaaaaagcggttctgtgtgcaccatcaataccactccaccaccgtgagaagcatacacacggaagaaaacaaggaggatcgagggctggcgagggtggggacaggatcacggataggtgaccatttagtcccctggttcctcaaacttttttttttttttttttgagatggactcttgctctgtcaccacgctggagtgcagtggtgcgatctcggctcactgtaacctccgcctcccgggttcaaatcatcctgcctcagcctcccgagtagctgggactacaggcacgcaccaccacatccagctaattttttgtatttttagtagagacgggatttcaccacgttggccaagatggtctcgatctcctgacctcatgatttgcccgccttggcctctcaaagtgctgggattacgggcatgagccactgcgcccagccaccactttcaatataaaaaggaagatacgctgcatatgtttttaaagtaaaaaaccttcaagttctggggttgctggagaagacacaagcatgaaaatgcactgctatgcacagccacagccaaaatgaaaccagaaatcacaggctctagaaatcataggctctaggagtctgtgcataagcctcatcagacaaatgattagaaaccattctggaagccaccaaaagctacgaacaagtggaccccaggggaaggaggatcctgggggaaggaggacacctctcaagagaagcaaacgcctcacaccgcagggtacacagccctgaggcccctgtggcatccccagcacaactgagaggtcatgctctcagggtgggtcggccgggcatgggggctcccacctgtaatcccagcactgtgggaggccgaggcgggtggatcacgaggtcaggagattgagaccattctggctaacacggtgaaaccctgtctctactaaaaacacaaaaaattagccgggtgtggtggcgggcgcctgtagtcccagccactcgggaggctgaggcaggagaatggcatgaacctgggaggcggagcttacagcgagctgagattgcgccactgcactccagcctgggcaacagagcgagactctgtctcaaaaaaaaaaaaaaaaaaaaaaaaatctcaacgagcctccctggccctgcaggtggaaggggatctagaagagcacacaaggggctgggtacggttgctcatgcctgtaatcccagcactttgaaaggccgaggcaggcggatcagttgaggtcaggagttcgagaccagcttgtccaacatggcgaaaccccatctctactaaaaatacaaaaactagcaaggcgtagtagtgcgtgcctataatcccagctattacagaggctgaggcaggagaactgcttgaacccagggggcagaggtttcagcgagccaaaatcgcgccactgcagtccacagccacagagcgagactctgtctcaaaaaaaaaaagcccacagggaagcagcagcctcagatctatgtcttcagctcatagcggctcccacagggagatgctggcttctactggagataaagccacacacttcaagaaaaaccagcctcatgatggcatctcccactgctgcctgagtgcagcctttcacggattcccaatgagggcgtaggtctgaccgacagctgcaccactgctccccacaggccaaaagagcctgacttctactcctacctgcactgtgcaacagaaaagtgctgcatgacactccctacgacaggctcgagccagcgctgtgggccccaaggtggccgctgagagagcacccgagtctgaagcctgtacaaacacctcagtgcggcccacaggaagatgacgagtgacaaagtggggctgtgcactgcacacactcctttccggaaggtgctaagtgattcttcaggacccccaggtaagagtctgtgccacagctggcactgggcgtcagcatggtgggcggaccctgtacccaaagcaccggcttgagctggcacagccacccccgagctcactcgggtggtgtagcacaacagacactcaaggttaggaaaatggaaaagcacaagtcccagagtggacaagcggcccaggaacttaccttctggcttctcttcagcagcagagcaggcctggcagtaggtggagtacagagatggggggattttatctgctctggatcacaggaaaacaatacaattaagtcagctatggcttaaattaattcaagattacaatccccaaatctattataaaataaaaacatattaaatttaaataaattataaatactgtgtacagtatgagcctgtttttacaaaaaaatattaaaaaatatatatagatttaaaaagcactgtttcaaaatatatcatattaatcatatattaatatctaaggagctagaccacaaaataccaccagtgattatccctgggcagtgaaattataaattatttctatttctctcatacaatttttggtaatttccaaattcaaaacacgaatctttgtttttcttttttttttttttttttttttttttgagacagagtctcccactatcacccacactggagtgcagtggtgcgatctcggctcactgcaacctccgcctcccaggttcaagcaattctcctgcctcaccctcccgagtaggtgggattacaggcgcctgccaccaggcccagctaattttttgtatttttagtagagacggagtttcaccatgttcaccaggctggcctcgaactcgtgaccttgtgattcacctgcctcagcctcccaaagtgctgggattacaggcgtgagccaccacgcccagcaaaacatgaatctttgttaattttaatgattaatactaagaaaaacgtttagttcgtgtcattaaaaatatgcaaaattgggccaggcgcggtggatcccgcctgtaatcccagcactttgggaggccgaggcaggcagatcaggaggtcaggagattgagaccatcctggctaacacagtgaaaccctgtgtctactaaaaatacaaaaacaaaattagccgggcgtggtggcgggcgcctgcagtctcagctacttggtaggctgaggtgggagaatggcatgaacccagaaggtggagcttgcagtgagccgagattgcgccactgcactgcagactggctgacaaaccgagactccgactcaaaaaataaattaaagaaaaaaaaataaaacgcattagttcatgctaaaaatccttagcaaattagtaagagggaactttcttaacatgataaagggtaagccaggtacagtggctcatatttgtaatcccagcactttgggaagttgaagcaggaggattatttgaggccaagagagagagaagcctgggcaacacagcgaaaatccgtgtcctcaaagcatttacaaaatggctgggtgtggtggagcgcgcctctagacccagctacttgggaggcagagggggaaggattgttgaaacccaggaggtcaaggctggccaggtgtggtggatcgcgcctctagaccctgctacttgggaggcggagggggaaggattgttgaagcccaggagatcaaggctggctgggtgtggtggagcacgcctctagacccagctacttgggaggcggagagggaaggactgttgaagcccaggaggtcaaggctgtagtaagccatgactgcaccgctgcattccagcctgggtgacagagtgggaccctgtctcaaaacaaatgaaagtaaggatcccagagaataaacttattttaagatttaaaaaattatttttgcagagcatggtggctcacgcttgtaatcccagcactttgggaggccgaggtgggtggatcacaagatcaggagtttgagaccagtctggccaacatagtgaaaccctgtctctactaaaaatacaaaaaaagaaaaaaaaaaggctctttgtgtttatcttcttacaggtcccagaactttataaattttgctggaatataggacttatactttcctatttcttccaaagttggttgataccaaccaactttcttactagaaacctgcaatgtaagtgatccaaggataccttattattctaaacaataacttccaggtctactctcaagttctgcagcatgaggctttcccagagctctttcattttccttcagttctcctctctgcacaatcattatgtactgaaacattttctttcactgaagaatgatgcagccgggtgcggtagctcacgcctataatcccagcactttgggaggccgaggtgggcagatcgcttgagcccaggagttcaagaccagcctgactaacatggtgaaaccccgtctctactaaaaatacaaaaattagccgggcgtggtggtgcgcgcctgtaatcccagctactcaggaggctgaggcaggagaattccttgaacccaggaggtggagggtgcagtgagccaagatcgcaccactgcactccagcctgggcaacagagtgagacttcatctcaaaaaaaaaaaaaaaaaaaggccaggagcggtggctcacatctgtaatcccagcactctgtgaggatgaggtgggtagatcatcttctgagctcaggagtttgagaaccgcctggccaatatggcaaaaccctgtctgtactaaaaatacaaaaattagcagggcgtggtggtgcatacctataatcccagctactcaggaggctgaggcaggacaattgctccaacccaggaggcagagcttgcagtgagccaagattgtgcaattgcactccagcctgggcaacagagcgagactccatctaaaaaaaaaaaaaaaaaaaaacttagccaggcacaggcttgtaatcccagctactcaggaggctgaagcaagagaatcgcttgaacctaagatgtggaggttgcagtgagccaagatctcgcctctgcactccaagcctgggtgacagagtgagactccaactaaaaaaaaaaaaaaaaaaaaaaaaaaaaaagtaaccaaccaattttggagccaatattttaccaataaaacacaatagtggtctaacaaatttctctacagaagatccacaattcttcgcattgtcagaagaaacctggaagtagtcatccccttctaaccgttgctgcatacctcttcagagactctataaacgccacacgggagtcagggactttggggagctgtgggaagagaagagacctgtgagagactgacaaggaaagtccttgctttctacacaactggtcacaaactcatggagacgcatactgaccactcgaggtgtgagcagggcggggaggaagtgggacacgtagtaaggcctcctgaatatgctgcaacacagagaagcagacagtgcatcagtcagagcagcgagaaggcaattcccacagacggtgaccggtgtttcagagagtggactgcgagggctcactccaaagccacgatgcattatgaagtcttcttgtgcacagttccgggacaaggcatgtgtagggcaggccgtgctagcccagccctgagtccgtgggaatcaggaccacattcggcctgctccctgggcttgaacgtggagcctggatcaatctgaggccacgaggaccatgtaaggtccatttggggcaatttccttggagctaaatttcaaaaccctgggagctgcaatcagctcatccacatgtgtaaccaccagaattcaagatgttttgagatcataccaaattcaataaagctgtgctattcagctctctgttactgactccatattggtcacaaagaaggcattgataaaaaaaaaaacatcatggccccactgccttccctcccagtgcaagctccccaatcagcagttcctgttggctgcttcagcacgggaggggcatcacctgcttttacagaggaaaaaatgtttcacagcaaatgcacagctcttgacctcaccccgtatcccttaacggcaggatcctcgattcacagccctgactcctgtctctctctgaatagacagtggccaacctgccccatgtggctctgggcagaaatgggacacactccaaagagccccagacgctggcaggcatcagagcggagtctgcacaccctgcaggcatcagagcagagtctgcacatactgcaggcatcagagcgcggtctgcacacactgcagctgctagaggccttttcggcagcccagcctacctggcctccatgacggtgactgggatgttccccgtatgctcaaacaccatgatggccttttcaacatcctgaagagcttggctgtggggctggttcccatacagggaggaaaggaaaaagaacagaggactttaaagaaaagactgagcagtgaaggccacactcaacctgtgcttccttgttgaaaggctctgtacacattaaaggtaaaggcccacatgctgtgcgcacagcaggggccctggagcactccaaaatgtcccaaaataccagcacgacaggggaggatgacactgccacctccacacacacaaggttcagaccccgtgatgtgcggccctcctcgagagctcagctctgctgagagcctgccgtgagcctctttcctgcctccaggaaagagttgaaagtaaagatttctaggtgggaaggagtagagacttaatttttgagattaaaagaaattacgagggctgggtgccatgactcatgtctataaacgcagtgctttgagaggctaagcggggcagactgcttaagcccaaggagttcaagcccggcctgggcaacatgatgacatctcatctctaaaaaaatacaaaaacattagccaggtgtagaggcatgagccagtggtcccagctactcaggacgtggaggtggaaggattgcctgtgcccaggaaatcatggctccagtaagccatcatcatgctaccctactgcagcctgggcaacaggggaagtccctgcatcaaaaaaaaaaaaaaacattctgaggccaggcgcggcagctcacatctgtaatcccagcattttggggggccaaggcggaaggatcacttgagcccaggagtttaagaccagtctcggccacacagggagaccctatgtctgcaaaaaattttagaaaccagccaggcatggtggcgcacacttgtactcccagttactcaggaggtcaaggtgagaagatcgtttcaacctaggagtttgaggctgcactgaactgtgatcacggtactatacttcagcctggtcaacagaacaacatcccacctcaaaaaaaaaaaaaaagtaatttataaacagcaataaattataaatggaaaattatattaaatattttcacctaacactttaatgtcacctataagtgttcttcagtaactcgtaactttaaaataaaaaggtcttaaaaagtaaagaatggagggccaggcgcagtggctcacgcctgtaatcccagcactttgagagaccgaggcagacggatcacgaggtcaggagaccgagaccatcctggctaacacggtgaaaccccatctctactaaaaacacacaaaattagcctgacgtggtggcgggtgcctgtagtcccagctactcgggaggctgaggcaggagaatggcatgaacccggaaggcggagcttgcagtgagctgagactgcgccactgcactccagcctgggcaatagaacgagactccattccaaaaaaaaaaaaaaaaaaaaaaacaatacgctgggcacagtggctcatgcctgtaatcccaggactttgggaggccaaggcgggcagatcacgaggtcaggagattgagaccatcctggataacatggtgaaaccccatctctactaaaaaaatacaaaaaaattagctgggtgtggtggcaggtgcctgtagtctgagctactggagaggctgaggcaggagaatggtgtgaacccgggaggcggagcttgcagtaagctgagatcgcaccactgcactccagccagggcgacagagcgagactccgtctcaaaaaaaaaaaaaaaagtaaaaagtaaagaatgttttcattaggccggccatggtggctcacgcctgtaatcccagcactttgagaggccgagacgggcggatcacgaggtcaggagatcgagaccatactggctaacgtggtgaaacctcatctctactaaaaatatacaaaaaattagccaggcgtggtggcaggcatctgtaggcccactataggctactcgggaggctgaggcaggagaatggcgtgaacccaggaggcagagcttgcagtgagccgagactgcgccactgcactccagcctgggcgacagagcgagactccatctcaaaaaaaaaaaagaatgttttcattagtgacccacacatatcacatgaccatctgacatttggctgctataaaaacagttaacacttggccaggagcagtggctcacacctataatcccagcactttgggaggccaaggcgggcagatcacgaggtcaagagatcgagatcatcctggctaacacggtgaaacctcgtctctactaaaaaaaattaaaaaattagccaggcgtggtggcgggcgcctgtaatcccagcactttgagaggccaaggcgggcggatcacaaggtcaggagattgagaccattctggctaacatggcgaaaccctgactctattaaaaatacaaaaaaattagccaggcgtggtggcggctcctgtagtcccagctactctggaggctgaggcaggagaatggcgtgaacccaggaggcagaggttgcagtgagccgagattgcgccactgcactcaagcctggtgacagaccaagactgcatctccaaaaaaaaaaaaaaagttaacacttttctgtgattcagagaaaaacatgacgaaccacctctccattcaaccccacaggaaccaagatctcccaaaaggacaaatgtcctgcagcctgaggcacttcactctgccacacagtaaccctttccctgccaatgctggggacacacaaggtgggacacagcaacacagaggcccgcagagcctcgcccccagctgcgcccgaggcaagaccagacatgagactgggaaggctgaaaaactcaactcaagagtcaaaagaaactggacctttgcatggtgggcgtgactggctgagaccctgcagggctcaagcaacattacctcagtaatgtccccagctgatgacaaatcctcgtagagtcccatgttttctatagaaaccttcagggaagacacagaatgagaacaagaaaacaaagcagtttctgctgggacaggtgtgaggagtgggcatggagggacagcttgccttgaggtcggccagccgtgtcttggccaatgagatgtagtctgtgaggagggagcggtacttgccgggaaccaggggtgggtggagaatgtgcacctgaggatagatagcagagcgcagcaccgttagtctgggaactgcctgggactccagggaggccacaattcacttccaacatccacagtgctgagtagagaaacacagccctttacagtcagacttatgagtatgcaaagcaaaccattagtaaaattaaaacacaagccgggcgcagcggcttacacctgtaatcccagcactttgggaggctgaggcgggcagatcacgaggtcaggagatggagaccatcctggctaacatggtgaaaccctgtctctactaaaaatacaaaaaaattagccgggcgcggtggtgggcaccagtagtcccagctactcgggagactgaggcaggagaatggcgggaacccaggaggcggaccttgcagtgagccgagatcgcgccactgcactccagcctgggtgacacagtgagacttcatttccaaaaaaaaaaacaacaaaaaaaaaacacaatagaaggctgcttccccaggtgaaaaatcaagaaaccctaatgtagctggtcctgcaagtccagggcggctcactgggggaaccagggatgtgcaatcctagcagcggcagcaggaaccggccccggccgcctgcagctccatgcctttgacttcctggtcaaaggggacagaggggacacagcgtgtttttttcttttgagagggagttttgctcttattgcccaggctggagtgcaatggtgcagtctcggctcactgcaacctccgcctcccgggttcaagcaactctcctgcctcagcctcctgagtagctaggactacgcgcgcgctaccacgcccggctaattttgtattttcagtagacagggggtttctccacattggtcaggctggtctcgaactcctgacctcaagtgatctgccctcctcagcctccaaaagtgctgggttacaggtgtgagccaccacgcccggccaattttcttaaaagatgagggtcaggctgggcacagtggctcacacctgtaatcccagaactttgggaggccaaggcggaaggatcacttgagctcagttcaaggccagcctgggcaacacagcaagaccccatctgtactaaaaaaaagaaaaaaagaaaaaacagccaggtttgctggcatgcgcctgtagtcccaactactcaggacgctgaggtgggagaactgcttgacctgggaggtctaggctacagtgagctatgatggcaacactgcactctagcctaggcaacagagtgagactgtctcaaaaaaaaaaacccaaaaaaacaaaaaaacaaaaaaaaaacccacatgaaattaaaaaaaaaaaaaaaaaagcaaacatgagatcctaaaaccctcactgcagtacaactcgctcttcctgcgtaactgggtgctgagaacgtctctccacgtcaccactcagacctgctcactgttttgagggagactgaacagtgacataatatatctacccacctccttggcctaggtgagaaaagggtttcttagcagttgccttgactggcacacacgcactcactgtgtgtccacgtggacacctccagttgcaatgtttgtgttgtttcaccataaacggcttggggaaggggaaggggaaggggaagggcctggctgagaggctcagagcagatctgcaggaggctcttggggaggccaaggcagtcctcagatgcagcaggtgagcgaagcaccagaaatcatggatgtggcagccagcttctcacctgcaggtaccggggagactcaaaaggcacgagttctgacaagaacgtaaacaggaagaccagggccttcttgctgcagccatggtagcctcgtgtgctcccaaaggaggcctgtgtggagagaagagcgtgaagcccaggacagccaggcgcggctgcaccacctaggcagtgtcctgtgtggagagaagagcgtgaagcccaggacagccaggcgcagctgcaccacctaggcagtgtcctgtgtggagagaagagtgtgaagcccacctaggcagtgtccgggcggctgctgtagtcggcctcctaaacagaaaggaaaaaagagaaacaccaaaaagtcatgtggttcatacatttacagatgtcacgactgcgctttgactgaagagatatctaaaagttattcgaagaaaaacagttaaaaatcattagctataacaaacactaactatgggatccttttgggatccttaggggtacaatttgctaaatgccctaagaagtgtttgtgcacagcaaacaaattgattttgtgggatgaagccacttctgaacacactttaacttctaacctcatccaccagtggacagatcactgcaagagaggtgggtaaggaacacaggccaaggagggccacccctcagacaatgaagctgcaagaccctagcagagcaagcgaggaacatgagcaaaccctcccaggaacgaagggggctgcagcaaagtcctgggggctgcagtgagtcagggaaggaaggagattttaaatgggcatggccctgaacgcatcatagtgaacctgcagacagaatgtgggcctctgtgaacactgaaccgcttacctgcaaaaccagacgagctcctgccaccctagccccacttgagaccacaggacatcctggtgaaacctcagcaagttaccatctatcaggaaacctgaactccaacgtgaactgaaggctcaccttggtctttctgaaagcgtgcaaaattgtgttttgtttttttttttttggagacagagtcttgctctgtcacccaggctggagtgcagtggtgccatcttggctcactgcaacgtccgcccacccaggtttgaacaattctcctgcctccctagtagctgagattacaggcatttgctaccactcccagctatttttttttttttttttttgagagagagagtctcactctgtcatccaggctggagtgcaacggtgcaatcagggctcactgcaacctctgcctcccgggttcaagtgattctcccacctctgcctcccaagtagctgggactacaagcacgtgccaccaagcccggttttttttttccttttttctgagacaaagcctcactctgtcacccaggctggagcgcagtggcgtaatctcggcttaccgtaacctccgcctcccaggttcaaacgattctcctgcctcagcctcctgagtagctgggattacaggtgtgcaccaccatgcctggctaattttgtgtttttagtagagacagggtttcatcgtgttggccaggctactcttgaactcctgacctcaggtgataccttggcctcccaaagtgctgggattacagacatgagccaccacgtctgacctagctaatttttgtctttttagtagagatgaggttttgccatgttggccaggctggtctcaaactcctgacctcaagtgatccacctgcctcggccttccaaagtgctgggattacaggcatgaactatcacacctgaccatgtgtagattcttttgaatgttatcatcatgcagacagacccaaaaagccattagataaaaagcggaaaatgctgataacgcttgtcaaatgtctctgagagggacagagtcacggaaaaacaaagctcagagacatgaactgtctgtgccaaataccaggaaagcagctcaatacttgtcagttaaaaatttaaataaaacctgagaccactcaagggttcccttctcaaaacatcagcacccagtttcaacctgaaattctcccgccaagcacaccatgtcttatcaccctccattcagccatccacaacacaactgctcctgtctcttggcaacgttcactcaattaacagtgagccagatgatcactggccgcagcaggaacagtccagacccgtcgccaaaggcatttctgtaaagcatctaagtgacacgcgcaagccagacctggggtcacagcagccattgttagagttgctgagataaaaggcagttctgtttgctatttttgaaaaaattacacttaatggctgggtgcagtggctcaatccggtaattccaacactttgggaggttgaggcaggaagatcacttcagcccaggaggtcaagaccagccaggacggccgggcgcggtggctagcgcctgtgatcccaacactttgggaggctgaggcgggcagatcacgagttcaggagatcgagaccatcctggctaacccggtgaaaccctgtctctactaaaaatacaaaaaattagccgtgtgtggtggcaggcgcctgtagtcccagctactcaggaggctgtggcaggagaatggcgtgaacccgggaggtggttaccgtgagccaaggtcgcaccactgcactccagcctgggcaacaagagcgaactccatcttaaaaaaacaaaaagaccagccagggcaacatagtgagacactatgtccacaaaaaattttttaataattagccaggtgtggtgacatacacctgcggactcagctgctcgggaagttgaggtgggaggatcatttgagcctggaaggttgagactgcagtgagccatgatcacaccaccacatcccagcctgggagacagaacagagaccttgcctcaaaaaaacaaacaaaaaaaccccacaaattacatttaactacataatgtgatatgctgagaattatattaattaccccaaagggctcaaattcacgatcatttggtctacttatattaacatttcctaaaagtaaaaaaaaaaaattttttttttgagacggggtcttgctccattgcccaggctggagtgcagtggtctgatcttggctcactgcaacctgcgcgttccgggttcaaggaattctcctgcctcggccttctgagtagctgggattacaggcacctgccaccataccagctaaattttgtatttttggtagagatagggttttgccacgttgcccagggtggtcttgaactactgggctcaagcaatcggcccacctcgtcctcccacagtgctggtatttgccctcaaaagtaaaaattaaaacagatgttcaggccaagtgcgttggctcatgcctgtaatcccagcactttgggaggctaagtggggcggatgacaaactcaagagatcgagaccatcctggccaacatggtgagaccccatctctaccaaaattacaaaaattagccaggtgtggtggcaggcacctgtagtcccagctactcaggaggctgaaacaggagaatcgcttgaacccaggaggtgggagttgcactccagcctggtgacagacggggactccatctcaaaaacaaaacaaaacataacaaaaacagatgttcaaacactgaatatgcatatatacatttatcaaaactcatctaactatctggacatggtggctcatgcctgtaattccagtacttcgggggttaaggtgcggggatcgcatgaggccaggaatctgagaccagcctgagcaacacggtatgacattgtatttacaaaaaaattttttttaattagctgggtgtggtggcacacacctatagtcccagttactctggaagcggaggcaggaggactgcttgaccccaggaggtaaaggctgcagtgagctatgatcatgccactgcactccagcctgggcaacactcagtctcttaaaagaaaacacaaacagaaaaaaacaaaaaacctcatttaatggtacacttaaattggatacctttcattatttcatttaaactatattttgataaagttgatttgaaaaggtaaaagaaaagcaaacaaaaccaaaacaccaccaccaacacagcacttcagagtattcctctcccaactgtcgcctctggaaccgaagaaaaagcagcccagggagacacctgagccgcggctcggggagacccatcaactcctgacccaagagcaccaggtggattctggcacaaatctctcagcgcctcactaaaaggacagaacaaacacctctcctcttagtttagtggaagccccaggctaactgggcagagctggggagagcctgagggcaggtgagaaggaactttaaggaatagaagtgagttgacactgacactgcaccagtcaccaccttctcccaacacaagcagatgcggctcagcctcctgtgcagcctcagctcctcagaaggcctggggggggagcaggcaccgcagccacgatggcgatgcaggcaccgcagcccttgaaaatttcagggagctgagactcctacaaagaggcaactacttcaccgaggtggtgatggcaggaaaactcaatacttttttttttttttttttttttgagacagagtcttgctctgtctcccaggctggagcgtagtaatgcaatcccagctcaatgcagcctcaacctcctcggcttaagtaatcatcctgcctcagccggtaagtagccaggaccacaggtgcttaccaccacacccagctaattgttacattctgtagagaccggggtctcactgtgctgcccaggctgatcttgaacccctgggctcaagcaatcctcctgcctaggcctcccaaactgctgagattacaggcatgagccactgtacctggcccgaacccaaaacttctacaaaaattagctcttcaaatggaaactttactcacaagcactaaaagagaaaccatggcggtccttcaaagctgatatctcaaatacacccaactccccacatgaactgggggttttcacaggggttgcccagggatccctgaggtctcaggagctcagactcagtagtctcaaatgggccctggatctttatttccaaagccccctccaggcgagtctaatgcccacttaggttcaggaacagctgcataaacttctgtcagagagcacactgtgtgtgttccaaagaaaaaggaagaatatgtgatacggctgaagaaatgaagtacttgtttcaggacttacgtgaaaattagagacgcaaggctgggcacggtggctcatgcctgtaatccctgcactttgggaggccgagggaggcggaccacttaaggtcaggattttgagaccagcctgaccaacatgatgaaaccctgtctctactaaaaattagccaggtgtggtggcgaacgcctgtaaccccagctactcgggaggcggaggcaggagaattgcttgaacccaggaggaggaggttgcagtgagccgaggtcgcaccagtgcactccagtatgagtgatagaatgagactccacctcaaaaaaataaataagtaaataaataaaataaataaataaataaataaaaaggaaaggccaggtgcgctggctcatgcctgtaatcccagcactttgggaggacaagacgggcggatcatgaggtcaggagttagagaccagcctgaccaacatggtgaaaccccgtctctactaaaaatacaaaaatgaactgggtatggtagtgcacacctgtaatcccagctactcaggaggctgaggcaggagaatagcttgaaacggggcagcggagtttgcagtgagccgagaaggtgagctttctgtaccactgcactctagcctgggcgacagaggaagactccatctcaaaaaaaaaaaaagggaaaataagagacattgtatactctgcaaaaagcagcatccacttctgtgtcccctctttcctgatttcactcattttcttttttttctttttgggatggagtctccttctgtcacccaggctggcgtacagtggtgcaatcacagctcactgcagccttgatctcccaggctcaagtaatccttgcgtctcagcctcccgagtaacgaggactacaggtgtctgccaccacacctgcgtagtttttgttttgtgtgtgtgtgtgtgtgtttttttttttttttttttttttttggtggagatgaggtttcactatggtgtccaggcttgatttcgctaattttcttataaaagacagcaggaggctccgtcaactaagtgagacagaaaccaggggaaggagctgaggccccgacagggagaacccaggctcctcggaacatgcagaggaagatccgctgaggccccgacagggagaacccaggctcctcggcacacgcagaggaagatctgccaaggccactcggcaaagctgacagcaaggttgctcactcacatgacagagaatcaggtggggacagcatggtccccactcccaggccttctgggaagatcaggtattaggtagccgattggcaggtcacttaccttgaaccagtctgcatatgacaggaacgcagaggggccctccagtgctgcctggcgcacaaccaggaacgcagtgaccatgctgtccagctggcagctctcgaatgcctgggccatcaaacgcgccacccagtctagttaagaaccatgacatagtcacagcaaggcaagggcagccagcaggaacatgacgtgagttatgctgggtgatcaagtattccagaaggagactgtgcacacccaaacaccaagttttaaaagactacacagcaattacagcatgtcaagtgcaaaccactagagacctgaatgaagcagcagtggacactctggcctctcagagcagcagtcagtgcttatggaagcgtctgacaaagaatgttccatcgacaggaggcactgcaggttccgggcaggtagggaagggcttcactgagaggctcacccacagtcagctgggactctgctgacacccccctacacacactcttgaccagcaccaccgggctcgcgtaaaagctcaccttcaagcagctgctgcgcttctggaaagcagacaaccagggcagacacaaaggagagcactctctgccagtgaacctcctgcgtttccagaacttcttgcaaatggccaaccaactcctctgcactcagcatcacaaagagctgaaataaaagcatccgctcccttcaatatccaagcaaaccaatgtgcgacagatgacccctcaccttcctcccagccggtggccaccgcagccccctcacttcccactgcaaaggtaacacatggagctgtgacagctcacaccgtggcgtctctcccctcacagtggccagcacctgcttggagagaattctccctatctcaaggaggaggggctcggcccaagggacaagttcagtctcctgacctgagtggtggccttgatgaggacagccacatctcaccagacatccctgaacctctcgatgtgccgtccacggcaggcagcatgacaagtactaggcagatcttaatccccccgccacgagctcagaagcaggtataataccacatccactcaccctgcggtacagtgaggtgagcagagggtgtgtccgcgcaaagctccactctctctgcatctgaacagcatcagatgctgcagggggagaaacagacaaaaacttcaagtcagagatcaaaaagttgtgggtttttgttaaggaccagccccacagggtcggtgggtctctccccgtgtgcggcgacgagagagtgtagaaagaaagatacaagacaaagagataaaagacaagacagctgggcccgggggaccactaccatcaatgcgcggagaccggtagtggccctgaatgtctggttgtgctgttatttattggatacaaagcaaaaggggcagggtaaagagtgtgagtcatctccaatgataggtaaggtcacgtgtccactggatagggggcccttccctgcctggaagccgaggcagagagggagaggagatagagacaaagacagcttatgccattatttctgcatatcagagacttttagtactttcactaatttactactgctatctagaaggcagagccaggtgtacaggatggaacatgaaggtggactaggagcgtgaccactgaagcacagcatcacagggagacggttaggcctccggataactgtgggtgagcctgactgatgtcaggccctccacaagaggtggaggagcagagtcttctctaaactcccggggggaaagggagagtccctttcccggtctaagtagtgagtggtgttccttgacaccttttgctaccgctggaccacgatccgcttggtgacgggcgtcttcccagacgctgccgtcaccgctagaccaaggagccctctggtggccctgtccgggcataacagaaggctcacactcttgtcttatggtcacttctcaccatgtcccctcagctcctgtctctgtatggcctggcttttcctaggttatgattatagagcgaggattattataatattgcaataaacagtaattactaccaactaatgattaatgatattcatatgtaatcatatctaagatctatatctggtataactattcttgttttatattttattatactagaacagctcgtgtcctcggtctcttgccttggtgcctgggtggcttgccgcccacaggttttgtttttggacagggtctcactatcacccaggctggagtgcagtgctcaccacagcctcgacctccctggctcaagcaatccacctgcctcagtctcccaagtagctgcgaccacaggcgtgtgccaccatacccagatactttttgtatttttatttttttgatgctgagtctcactctgtcacccaggctggagtgcagtggtacaatctcggctcactgcaagctctgcctctcgggttcaagcgattctcctgcctcagcctcccgagtagctgggactacaggcgcccaccaccacgcccggctaatttttgtattttttagtagagatggggtttcactcttttggccaggctggtctcgaacttctgacctcgtgacctgcccgtctcagcctcccaaaatgctgggattacaggcgtgagccactgctcctggccaaaaagttgtgtttcaaagcttcagtgtgaagacagatcttaatatgtactttttcagttattaaagttcaccatctccctgtttgttgcctatttgctatatcatcaattctgtttctcaggcccggttacttacttgtaatgctttgtcatattcacaataaatattttccaatgtaccaactgcatttcaattttcctgcttttaaactgtcagtaaggtcaggctaggtggctcacgcctgtaatcccaccactttgggaggccgaagtgggtggatcacaaggtcaggagttctagaccagcctggccaagatggtgaaaccctgtctctactcaaaatacaaaaagtagctgggcatggtggcaggcgcctgtaattcaagcttggcagggaatagcttgaacccaggcggcagaggttgcagtgagctgagatcgcaccaccacactccagcctgggcaacagagtaagactctgtctcaaaaaaataaataaatacataaaataagataaactgggaataaaccaatcatggtggggatgctgttcaaaggaagctcagctcagtcaagtgatgataaactcctgagcacctcacagcacctgttgggagccatctgtgtatccctcatctcccaccagtttcctgcctgagcatctaccctggggatatgctagatacagaaaaagctcaaagtgttcatcgtggccttattcgtaagactgatatcttgggtacagtctgtcatacatgggtaacaggacacccactgggcagacgatgcctgggccatcaaacacgccaccgagtctagctgagaaccatgacacagtcacagcaaggcaagggtagccagcagaaagataacgtgagttgtgctgggtgatcaggtattccagaaggagaatgtgcatgctcaaacaccaagttttaaaagactagacagcggctgggcacagcggcacacgcctgtaatcccagtattttgggaggccgagacgggcggattacctgagattaggagttcgagaccagcctggccaacatggtgaaagcccgtctctactaaaaatacaaaaattagccgggcatggtggcacatgcccgtaatcccagctactgtggaggctgaggcaggagaatggtttgaacccgggaggtggaggttgcagtgagcccaaatcacgccactgtactccaacctggcaacagagcaagactccatctccaataaataaataaataaataaataaataaataaataaataaaataaagatatttctattttacgctgggtgcggtggctcacacctgtaatcccaacacttcgacactctgggaagccaaggcaggtggagcaccgaaggtcaggagttcgaggccagcctggccaacatggtgaaacccagtctctactaaaaatacaaaaaattaaccgggtgtggtggttggcgcctgtagtcccagctacttgagaggctgagacacgagaattgcttgaacctgggaggcagaggttgcagtgagctgagatcacgccactgcactccagcatgggcaagtgagtgagactctgactcaaacaaacaaacaaaaaagatatttctattttaatgacaattattttgtccactcataattctgaattttcttata
